United States Patent 8,781,750 (CELL-TYPE-SPECIFIC PATTERNS OF GENE EXPRESSION) - sequence listing, part 17

SEQ ID NO: 36468 - DNA, 37381 bp, Homo sapiens
ccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggtgagggaggccgcggcgcgcgggctgggcgcactcgggcggggcgcgcggtgggcggtgaagctccggggggcggagcctgggcgacctgcggcggcggggagcgctcaggtgggagggagcccgagaacgcgggcgcggagggtcgcagctgcgggtccctcgcctccctgctccagactgaaagtgcctggagggcggggaccgcgtctttctccgcccctggaggcgccgctgctcgggtatctgctttgcgaactgtggtcgtgagcatctttcgctgctgctcgactccgctagcctcttcccaaactgagggtggtcttttgatcacctgcctcagttccttgtgattcaggaattcgatttcgttgatggaatcaattcgtgggcacgggcctgggcatctccgttgtaactatgtccccatgtgactatgagacccaccatgttttgagaatgatcgtgtattccgttcatttagcaaatattggtgaacctgttagttgccagataccctttctggcaatggcaaaccctgcgtgattgatcatactttttgcacacattttgctatccctttaaattctataccaggcttttcttgagagagtcccggacattgttctaggcactggaggagacacagcaatggacaaaactgacaaaaatccctgccttttggcgcttgtgtgctagtggcagagacaagatagaggagataaacgagtaaacttcaggtttgttggtgacaagtgctgaagagaaaaaaggacattcgggaaagggagatgggcgtgtgtagaggcctgtgaaattttagataaagggggcagaggaaagctcaccgagaattacccaggccatgtttattacacaaatgctgacctagttaatgtcagctgcttaccagagccgccttcgggtgcttgtaggagaagtggcagcaatctttttgggaagtacagaactattactggaaacatgctgaactgtgcgacggttttgtcgtctggaaaaggaacagtgtacggaggtgggagctgttgggtttgaaggctattagactagtagtagagcaagtagaaaccacttggacatttctatcattggttttgggaagctcaaactcacttcaagggatattctgtggtctaggtttagatttttttttttttttagactcgccctgtcgcccaggctggagtgcagtggcgccatctcggctcactgcaacctccacttcctgggttcaagcgattctcctgcctcagcctctggagtagctggcattacaggcgtgcgccaccacgcctggctaatttttttttgtatctttagtagaaacggggtttcaccatcttcgccaggctggtctcaaactcctgacctcgtgatccgcccgcctcggcctcccaaagtgctgagactacaagtgtgagccaccgcacccggcctaggtttagatttgatagtataaactttatggtataaatttataactttagaatttagatttaatggtatatttattttttacttatttagagatacggtctaactttgtcacccagactggagtgtagcggcacctattagtcttccatctcccttttgctaatagtaactggttgctcttcttgttggtcacagataaattacacctgcacaattctccgaacactttaaactcagaagtcagcttcatcctcctaggctcaagtgatcctcctgcctctgcctcccaagtagttagctggggccacaggtgcacaccacacacccagctaaatttaaaaattttctgtagagacgagatctccctatgttgcccaggctggactcgaactcctgggcccaagcagtcctcccaccttgacctcccaaagtgttgggattacaggcatgaggcattgcgctctctgctggtataaagtttcttaaggaggtagggggtcaaaaacagattgggaaaatggagatatctttgactctagtttgcctccggtcctgtaatttctgtagttctgacatttctcctccttttttcatctgcagactcatcttttgttcttgtcttacttggtgttttccttcctgcgtgttgagtgttgactttttctccttgactgttccatcttgcctcacctgtccagtcggtgccattctctgatttctccattttctgcctctgcttccagcatttgcaatggtagcattccatcccattatttcatcagagagtggtagaaaaaacattctatgagccatttggctgtaaggcctatgtgtctgcagtcatgggataggaaaatctcagtgcttgagggtgttttgtctgctgtaggttcaagaacatgaagactcgggtgactcagaagtggagaatgaagcaaaaggtaattttccacctcaaaagaagccagtttgggtggatgaagaagatgaagatgaggaaatgtaagttgcctaacttttcttctgaatccctctgtacacttaaaaaagttattttgcagattttaaaatcattctttttaccaatttgtgattatgtgaagatttgaaaaatatttgaaagtatagaaaagatctttcatggttcctgatcccaccaccgagggagaactgctgttagcatgttgtcacacttctgtctcagtctcctctttgctgtatacagtagctaagagaatacagtgtttgaagtcagatctcgatttgcctcctcttttggccagtttctaattgaccatgggcagtttggaacctacattttttcctttgtgaaatgggcacaatgatagtaactacatcagaattttgttgggattaaacaaaatagtacttgtagaacttttagcacagtgcctgaaactgagtaaaggctaaaaagaaggtagctcacaccataggaactgtcatggatgagaatgtactgtatgcttgatttaacattttgactttttctacataaagttactttgtaaacatttctccctacttaaaaaaaatagacattttaaaatggctatgttggagtcaattatgtgaattaaccataatttacgtggctattgttgggtagattttctttttccctttttttttttttaattattttttttgaaacagagtcttgctgtttcacctaggctggagtgcagtggtgcgatcttggttcactgcaacctctgcctcctgggttcaagcgattctcctgcctcagcctcccgagtagctgtgactacaggcgtgtgccaccacacctggctaatttttgtatttttagtagagacagagttagacggagttttgctacgttggccaggctggtcttgaactcctgacctcaagtatacacccgtctctgcctcccaaagtgctgagattacaggcgtgaactgctgtgcccagccttatttttccctttaatgcagattatttcagcattaatgtttatcacctctttatgtataaacctttctttattttctaatttattgccttaagaaagattctttgaggtagaattacttaatcaaagagcacagttatttttaaggttcttgataagtactgccagactgcatgctatggggctctaccagtttgccttcccattgaaaggtgtcagtttcagtccattcttagacacaatggtttatttgttttttttttccagactctgtcagtttggtagtgggtaatatctctacctagtttgttttgaggaagtgtttttgtgtttagtcattgtcttcttttttttttttttgagactctcatcctttcatccaggctggagttcagtggcgcgatcttggctcactgcaacctccgcctcccaggttcaagcgattctcctgcttcagcctcccaagtagctgggactacaggcacatgtcaccatgcccagctaatttttgtatttttagtagagacggggttttaccatgttggccaggctggtctcgaactgttgacctcaagtgacctgtttgcctcggcctcctaaagtgctggggttacagacatgagcaaccacacctggcctcgtttcttataaatattctttattatgtccttgtctattggagactttttaaataatcttggtatattagttcctgacatattgagaatttcaaacctttatatgttagatttattgtaggttttccccagctttctgtgcatagaagttttgaatttttatatagtcaaatctgtgaatcttttccttcattatttttactgcttttttaatagtaagtagttaacagagagagacaaatgtttatctatatttttacttcatagtattttaaggtttgctcttttttttttttttgagatggagttttgctcttcttgcctgggctagagtgtagtggtgcgatcttggctcactgcagcttctgcttcccaggttcaagtgattcacctgcctcagcctcctgagtagatgggattacaggctcctgccaccacgctggactaattttgtgtttttagtagaggcagggttccaccacgttggccaggctggtctcgagctcccgaccttcagtgatccgcctgtgtctgcctcccaaagtgctgggattgcaggcatgagccaccgtgcccggcctttttttttttttttttttttgagacagtctcactcttttgcccaggctggagtacagtgccacaatctgggctcatttcaacctctgcctcctgggttcaagtggttcttctgcctcagcctcctgagtagctgggattacaggtgtgtgccaccccgcccagctaatttctgtatttttagtagagatggtgtttcaccacgttggccaagatggtctggatctcttgacctcgtgatccacctgcctcagcctctcaaagtgctgggattacaggcgtgagccaccacgctgggcctaaggtttgctctttatgtatttaactctttgatttacttggggtttattttggagaatttcataaactgtgtgcagataagtcatgatgaattttctcaaatagtagctctccaaagtgtaaaccagatgatctgaaatgttggcaactacttttttgttcttttaggaagaacagagaagatgcatttgaaatgttcacatcttaaaaatcttgacctatattgtttcattaaacatttttctccaagtgctaaaagcagcagctatttatattaactctttaaaagttatttaaaatatgctgttctgtttttgtagggttgacatgatgaacaatcggtttcggaaggatatgatgaaaaatgctagtgaaagtaaactttcgaaagacaaccttaaaaagagacttaaagaagagtaagtgtcttttttcatatgatttaccaagaggtgtatgtaaccaatgcccagtcattaaccgtaaccgcttcttgtgtagttttccattttgaaacagtaagaggattgctattgtgggcagtgactaaatttctgtagttttttttaggggagaggggacaaaacacagacacaaagaaaatttggaaaaaaattcttaccactcaaatataatcagtgataatattgcttacttgttcatttgcatatggtacaccataattttataatatgaacattttcaaaaatttaaatggccaccacctgggttcaatggtttttaacattttgtcatatttgctttgtgtatttgggggatgtgtgtgctttcccaatgtatttgagagtaaggtacagataatgcgacacttaactcattaatttgtcaatgtgcatctcttaagattaaggatgttttccttcatattcacaataccattgtcatacctaagaaaattaacagtttacggctagtccatgttagtttctccaattgttgtaaggtgcatacattttatttggattttatgtcctttaaatttatatatttttttgaggtaggatctcactctgtcacccaggctgaaatggagtggtgctgtcatggctcattgcaacctctatctcctgggctccccatagctgggactacaggcatgtaccaccttaatttttaaaatttttttgtaggaatggggtttcactatgttgctcaggctggtcttgagctcctggactcaagaaatcctcccacctcagcctcccgagtagctgggactgcaggtgtgtgccaccatgcccagctaatttttgtatttttttgtagagatgaggtttttcgccatgtcgcccaggctggtcttgaactgggctcaagcgatctgcccttcttggcctcgcaaagtgctgggaatacagaggtgagccactgtgctcagccattacctatcttttaagtgttcagacctgttgtcttgtagaatatcccacattctgacattttaagactcctgttttttattgaggtgaaattcacataacagtgttaggcattttaaagtgtaaatttggtggcatttagtatatttagaatgttgtgccaccacctcttcaatctagttctaaaactttttttttggtttttttttttttggttcttaaacatttttatcacctcaaaagaaaactctccattaattagtcactttgcatttcctcttccctcaatctgattattttttctttgtgttgtttaacttgttctgtcatctgtatttcctgttaagttgggcttaaagtcttgattagaattcaattacgtattttggtgaggagtatcttaagatgatgtgtaccagacactgcccctcaaagtccagttgtatcagtctctttcaagtctgatctttttctcagctttgtgtcagggtcttataaatgcctttaggggaaaatttgtggtggtgatggggttcatcttgcttatatcccttctctgagggatcacagtcctatgctgtcatccagtttccgaaaaaatttgtttcatatattttgtccaggtttctagttgtttatggctcgtgggcttagtttggtgagctagtctgtacttctgcatcaaaaaattaaaacaactctctttgccctcttccaggtaccagttgttgtttttttgttttttgttttttgtttttttttttttgagatggagcctggctctgtcgcccaggctggagtgcagcggcgtgatcgcggctcactgcaagctctgcctcccgggttcacaccattctcctgccttagcctcctgagtagctgggactaccagtagatgggactacaggcacctgccaacacgcccagctaatttttttgtatttttagtagagacggggtttcaccatgttagccaggatggtctcaatctcctgacctcgtgatccgcccgccttggcctcccaaagtgctgggattacaggcgtgagccatggcgcccggcccaggtaccagttcttacgaacacagctatcatgcttctgttaaagcttactttttccagagtgaagtgattctgttttattcagatgatatataatgaagttttgtatattcttaacaatctggtcagtttcttttagacgtgttctagtgtgtagtctatgtactgtggcataaaccacaaagagacttctttacatagtcctgatatctgggatgtgttgatatgaacaaataagacaaccatgtaactagatggaaataattaacaaaaaatatgtatccaggactagtttaagtgggcagaggttcatggaggtttccagtataggcaggttgggactgttctgtgtgagtaaagataataacttctgttcttaaagatagttacttctttggaagagagtccatacgtattctcaagggtgattcaacgtatatgctttaaatgtatcaagctttatggacatgtagtggttgccataaatatatttttcaaatatttttgcttagattccaacatgccatgggaggagtacctgcctgggcagagactactaagcggaaaacatcttcagatggtgagcgttgatatttctgtttaaattagtacataagtccctgttcctgttcgttattatttgagctttcttatgaggctcattaaaacctggcatttcttgcctggctcggtagctcacgcctgtcatcccagtgctttgggagcccgaggcgggtggatcgcttgagtccaggagtttaagaccagaccgggtgacatggcgaaaccccatctctacaaaaaatacaaaaattagccaggcctggtggtatgttcctgtagtcccgactacttggggggctgaggtgggaggattgcttgagctagggaagactagggtgcaataacctgtgataagtgataagtgccaccgtactccagcctgggtgacagagtgagactctgtctcaaaaaaaaaaaaaaaaaaaaaaaaaaaaaaaaccaaaaaaatctgttttttgactgtaggttttaaatttaacttgtaccatggctattttctgcttcttcgatcttttgagtttagctattataaatatggatggcttagctaaaatctggtttgtgtgcttggagttacatgttttagacttggaattaacctttgaaatcctgagagtccggagtatatcctctcacatcatgtgggagctccttccttagcatccttcatgtccgtagagcttcagtttgattatgaccacctcctttgtcccctttcttcctaccctgttagtcctcatggtacgtaaatgcagggagtccatacaaagagccagtgttttatataattctattagaaaagacaatctgttactaagtagaaattgaccgtctttgtttctagccatttgcttttagaggttgaaggaatcttagtgatgtggcctgactttatccactgcagtaatcttttctacattatcctctgcttaaatatatcaaataatgtattgtgtgtgtgtgtgtgtgtgtgtgtgtgtgtcagtgtcagaatctcactctgtcacccagggctggagtgcagtggggcaatctcagctcactacaacctctgcctcccgggttccagtgattgttttgtctcagccacctgagtagctggggttacaggtgtgcgccattacacctggctaatttttgtatttttagtagaatcggggtttcaccgtgttggccaggctggtcttgaactcttggccttccaaagtgttgggattacaggcatgagccactgtgcctggcctaaataatgtactttttactaaactgttttttccccttcttcccttttctttaagaactgttagacagtttttcctattttgaaatgtatgtcccaacaagtctctactcctacggtttgaaacatatagattatcttctttttctctcatttgggaagcctctttccatgtttgttttttaatatgttaaacatccctcgttattttgaccatttttttggtggcgtacttctagaccctagatcaccagtttgccctcctggatgaaacataattttattatccatttcagaatgctgcatttatagaaccccacaacattttagattcctgtaattttgggtatggttatgctagctgttgaaacaaaatcccacagatcccagtggcataatccaattgaagttggttttttcagcacataaaattggggtggtaggaaggtgatggtttactttagggacccaagtttatagaagttctgtcatcttcaggttggttcttccagagttgcctaagatgttgacatccacttggcttataggaggagaaagaggggatttttattggcctttcctggaaatggtacaggatacttttgcctacattttgttggctggaactcagtcataaggccacactagctgagaggatcctaggaagtgtagtttggctttgtgcacaggagaaaaaggaagtggattaagtcagcaattagtctgctacagtatgggatatgcttgtctaacacattcattttgtacatgagagaggttcaaagagatagtgacttgttgaaggtatacttattgttgacagaatggtgactagcactcagcttcatgattatctccagtgtgttatttttatctgtaaatatttactgagtttcgttataagaaaattctcccttttgaacataaccacagctccaaaaatcaacagcaattcattaatattatgaattgttgtattgtgttgctctttgtttatcccctctccctatcattttagcttgctttgtattttgcttagacttcatagtacttttgaactggcttgatgtcttctgtaagttttggaaattctcacctgtcttcaagtattgtttctgttccagtcttcctttctagattattagtaatacgtatattaaatgtcttccacctattttttggtttggtttttttttgagacagggtctcactctatcgcccagtctggagtgcagtgacgtgatcttggctcactgtagtctcgacctcctgggttcaagcaatcctcccacctcagcctctggagtagctaggactacaggcatgtgccaccatgcccagctaatgaaaaaaaaaatttttttttgtagtgacaggatcttattatgttgcccacattggtattcagtgttttttatcctttttctttctgtacttcagtctgggtatatttttctgattcgttttctagaccacaaattctctctacagctaattttgatgtactgttaaaaacatctattggaggcttaatttaattttatttgttattattttttgagttagtcttgctctgtcgtgtaggctggagtgcagtggcactacctccactcactgcgacctctgcctcctgagttcaaatgattctcctgcctcagccacccaagtagctgggattacaggtgtgcactaccatgcctggctaatttttgtatttttagtagacacggggtttcaccattttggtcaggctggtctcgaactcctgacctcaagtgatccacttgcctcggcctcccaaagtactggaattacagatatgagccaccatgcctggcctattgggggcttacttttaattacgtatttttcagctctagaatttctttttcaaatattctacatttctggctcaattttgaatcttgtctttcattcttaaatatattaaacatagttttttttgttgttgttgtttgtgtttttttgagacagagtcttattctgttgcccaggctggagtgcagtggcgcaatctcagctcactgcaacctctgcctcctgggttcaagtgattctcttgcttcagcctcccaagtagctgggattacagacataagccatcatgcccagttaatttttgtatttttagtagagacggggtttctccatgttggccaggttgatctctgactcctgacctcaggtgatccactcacctcggcctcgcaaagtgctgggattacagatgtgagccaccgcgcctggcctgaacatagtatttttaaggtttgtgtctgataattccgttgtttagatccctgtggggattgtctgtttttccttgtggtttttagtcaagttatcttgtcaatatttgcctggttatatttcattgagtggtggacattgcatatgaaaaataatgtagattaattagatctaggatgatggtttatatgtttacttctaggtaggtagcttggcagaggacactagtaatcccagaacgttttattttaatgaggaattgtgaagcagaatttcagttttgggaagattttcttataattctttgatttcgtctttaatcctagtggtagccctttgtggccgcaatccaaaatctggtggcttaccagaccctgtcaagaagcttagagctagtttttcccttcttagctccgcaagtgttttaagtttgctcagcttcttagctgtctccactggaatcatcagtcatctccagggggaaaagcagccctatttgctctttttgaagttctgatacatagattgctgacattgatcattcagctaaaagttctggtttttattcatgtgagttgttaaactagatcagtagccaacctgttgccaattttgccataattatgagttgctctttttaaatgaaatgctggctttaaacttttatttcacttcatcttgttttagtaaccatctgtgtatgtgttagtctttcattctagagttaaactttgattttaactatggatgttaagctttgtgtcatctttttcttctcctttaaaattttttttttttttttcctgttttgcttttgccagttgcagctttaaaaaaagcaattgaggtagggaggctggaaagggagttgatgttgaaaatatattcatagaagtttggggtaggtaaaaggggcagctcattgattctaaagatcagccttctgggtttgtttgacttagatgaaagtgaagaggatgaagatgatttgttgcaaaggactgggaatttcatatccacatcaacttctcttccaagaggaatcttgaaggtgagagtcagtgaagttgggggatcctatctaactacttacctctgcagtttaatttgcttcccagtagcagatgtatggattcctattatctgtggggttaaatatgtttgctgtcattttgccctggtaaatacttatgttattgttttttttttttccttttgcaaaaaatgttctagaggtattatgttcctattgcttgagctcaggagtttgaagctacggtgagctgtgatggaaccactgtactttagcccgggtgaaagcgagaccctgtctctaaaataataaataaataaataaataaataaataaataaattttccagtaattctaggaatcccgtttggtttatcttcattttcattggcatcagcctagttcatactgctgtcatctcttatctggcatattgcagtagctttgtgactggactctttacttctactttacctctttttaaatcattctttgtatggcagccagagggatcttttaaaaataaaacatcaggtcatgtcacttttcattgctttttgaaaacttctgaattccttatcgtattctacactgccctttacagtctggcttttgcctggatccttagcctcatatcagacctgtttcccatgatttcccacttgagtcacacaagcctttttctgtttcttggacatgctgctaggtcctttcttgcctgtgaacctttgctctttctcttttgttctgcctgccttgtcttcaggaagtcctaatggctagctcattcttacctttctgctcaaatggcaccttagacaagactttctctaaagtggtctacactattcactttctaactcatcactatgtctagcatgttcattatggtaaccagctgcctatgtagcacagtactttagttaaatatctgtcatactaacgggcagtactttagttaaatatctgtcatattaacagatctctctgtgacatagatatcttttgtttgtttgtttgtttttttgagacagagttttgctcttttgctcaggctggagtgcaagggcgtgatctcggctcactgcaacctccgcctcccgggttcaagcaattctcctgcctcagccacgcaagtagctgggattacaggcatgcaccaccatgcctggctaatttttttttgtttttgtttttttggtagagacagggtttctccatgttagtcaggctggtctcgaactcctgacctcaggtgatctgcccgcctcagctcccaacgtgctgggattacaggcgtgagccaccgcgcccagcgacataggtctcttttcttattacaccatggcaggagtatttaaatggggcaggggaaactattatgataaattagatacagtgattttgtcttgcaccttatgaggacaattcatttagctctttacgggtgaattcacctccattaaaaatgtagttaccacatggccgggcgcagtggctcacgcctgtaatcccagcactttgggaggccgaggcgggcagatcacctgaggttgggagtttgagaccagcgtgaccaacatggggaaacctcatctctactgaaaatacaaaattagctgggtgtggtggcacatgtctgtaatcccagctacttgggaggctgaggcaggagaatcacttgaacccaacaggcagaggttgtggtgagtcgagattacgccattgccctccagcctgggcaacaagagtgaaacccagtctcaaaaaaaaaaaaaaaaagttgtagttaccataaaaatttaacttggtggttacaaacaaaacacatacttttgtttttaactgaattttaaaaattcaaggggaaacctgtaaaaacaaaataaataacaaaatagtccaggtgatggatgtgagattaccattactttaaacttggaaccatgtaccctaagagaataaagcaacctgtgccaattgaagaactgtggggacaactgtgcagtgcctcttgcatttgtgccatgaatgcaaagatgccaggtgccaaagtagaagttttaagtgaaatttcctcagaagtgaaagtctcttaacacaaatggatgtattttggggaaatgactacatactagtgctccaagaatgagtaatacattcagacttctagatatggaaagcactttaatgatttaatctttttatttgaaagatggtaaaaatggattcttttgtggtaaagtgacttgctagttggtgccagagctgcggtttttttgttttttgttttttttttttgagttgtgtttggttaccattccagtgcatttttttccttcattataaactgtaatgtcttttcttcttactctaaagaaaataatgtttattcatttcaattgataaaatcccagctttcatttcctatagatgaagaactgccagcatgcgaatgctgaacgtcctactgttgctcggatctcatctgtgcagttccatcccggtgcacagattgtgatggttgctggattagataatgctgtatcactatttcaggtatgcatctttatttacttatttatttctaatgcattatttttatttaaggaccagacatttgcaaccccaaatgcaaaaatactgaaaaagatattcatagctaaaacatcatagcccgaagcatagctaagtctcacagaagtgacagagttcatttacttggaaatacaaaacagaacatccagtcagcatactgcccttgcttcttgctccaaagtctgtcgtcactgttttcaatcacagctgctcaccccttgcctgttcacagtttgggtcgctcaccatcccttgcccactcacatttttattgaatgcacctgtatgacttcagtgtacaaggaaccataataataggggatttggagtaaaatttttcttccactgaatataaaagttcagtaaaatagtggtttaaaataatagattgagaagtgaagaatatattaatcatgttagtgaatatattctctctacaaaaacgtgttcttttaattttctggtgagttattagagcaaagcgataatataacctcatgactttactgggtcttccatgtttaatctaacactgatgtacattgatggtttcttgggttgcaacaataaacaacagacctggcccttcacttcaggatgtcactctctgatgggggtatagatggtgaacacatggtcacaaatgtaaccattcagtcctgcaggtgcttcacagtatctgctcttggatagggtatcccagttttcttttagagaataacacttggtccagttcatgtagtttggatgggactgactcttatctccttatctgtgggtggacaaactcaagaaattagtagggcaaggtatggggaaggagcgtggagcttccgtgccttctcagggcacgccacctcctcagcacctccgtgtgttcagcaacccagaagctctctgaataccttctgttaagcctttttatgaaggcctcttgacataggcatggttgattaaatcactggccgtggctgcttaagtcagccttcagccccttggatatgtatttttaaatgaacacttgtagtgaaaagtatatactaccaggatacagggtctgtggaaataatcaaaagaaccattttgtacttctttataggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtaagatttctgttgaatgcacacaaccagtcattccccccaaggtgagtttatgtaacagtgtttacaacacttttttcactccataggattcttaaaaataagagtttctttaggtatagtgtttggaaaatgtctttgtgcttttgagataacacgtttgaatgaaaccagtgaacttttttactgaacacttacggaatgatcataatttggaaatatatattccccctacaccagacaagcaattgcaaatacttggctgtaaagttagcagttgatgcagcagaaaaagcatgagccatggagctagaagacctggattccatttctttggacaaactgtttcacctctctgatcttcaggaaacttggatactctgtagttttagtgttagttataataaaattttgatttatatttaaagggaataaagcactgcttttggaggtacttctgtattttaaagaatgaactacttaaaaaataacgcttttttaggaggtgaaaatttatctgccctctaccatacccattcttttcctatatttccctgctcctttatatcccaaaatacaccgacaccttcatgcatcctttgggaaccaaagcccttctaatgaggttgtctggctaatctcaggaggtagtgttggcgtatggcacggctcactggtgctctccctattaaactgtacatgcatgtggctggaaaggacaagagtagctctgtacaaccatttttctactagtggttgaaagtggatggggccaactttagaaacatttatgatgtttatctttagcatttccaatcttttctttcctgtgttcctgacactttgatcctttccaagtagatccttggtttaccctaaggcagagcttctcagaagtaaatgtgcacgtgaatcacctgggggtctcattaagctgcagattctgattctgtaggtcttaggtgggttgagtctgcatttctgattctctcaggtgatggtgatactgtgtggtccatggacctcacttggttaaaaagtcttaaaccatcttctcatattgaaatagaaaacaatatttagtagttactatttttacatgtcatttcactattcaaaagtaatggattctggcatctccttgtcttgcatcctcttgagagaaagcgcaccatgcgttggccaagatacagttagtgatctttaccatggatctgctaggtgggcaggagtgtgtgtccagtcaccaactgctttggagacatggcattgatctttccttcccagtatttctcctttttctgttttcacatttccaccgcctgatactgtgctgttaggattaggtctgtaggtgtttccagttgtagcttcacatggtgttagaacaagcctcctgtcctacctcatcacgtaatgatattttctttatgtttggaactacttcagtatactttagtcagtacatacggtttattcagaaatttggattaaaattacccttaataggcatagtggagtgcctttcatagtaaggagactagtcatcagcagaagtaaccccagtgattggaaatgtagtatgtgtctgaaataatattggggagcatgagtccaagcaagggaactaagatgtagtctttgggagacaggactagagtgggatgtccagtttgtagtagtggaaagtagccttaatttgtattttcctgtagtggaacaagggtccttaaccagatttttgtaactcctttttctctaattaatattgtaacttagtaacttaaaattttaaaaatatagacatatatttttgactaggcaatatattcacacggtgttaaaaatctactatgtagaaatgaatggatagtgaaaactctcttctgctctgtctccctgtcttcctgctttccttccttggaggtagccagttgtatgcattctgatgcatcctgttaggtaactttttaatgagtaacttggctctctaagcattttgatatcaggaggagtcccctgtatagtcaatatgaacctttcagtcatggaaaaagagacatgtccttttgtaagtaagttgactgtatatacctagctctcatatatgatttggttacatgtgtcacatccagagaagctagtcagtccttaagtaaactgacatattgtgaaaagttttggggttttttttgttttttgtttttgtttttgactcacaaagttaaagatgagattcctgtccatcatgagctgcttagtaagtggccagcagctagtttatatatgtttttatgtttttggctgtctctagtggcagtgtatttcccttctggtaatgaactttgtgacaaagaagtataatttatccttttagtaaattagaggtattactgcatatatttggaaaattagttgatatgtttactgtttggagagctgagtctctggcctgcagttaaaatggtgaatgctaaccaggacaaagaagagaagtttgttaagtgctttgtagtgaccttatgtttgggtcaaactcagtgatgcctgcgtttagacttattcggggtctgagccagggttttgtttaatttgagccacttacgtattttaaaaagtaagaaactcatttgtcaatagatgatagttttattgaaaactatataaaactttatttaattgcttcatttcctattttaggtttgaaagagaagatagtgaggagctttgaagtctccccagatgggtccttcttgctcataaatggcattgctggatatttgcatttgctagcaatgaaggtaaagcattattattgcttcttgttcttctcccacaagacactagtgtagggatagtcttgcaccttaactcagtgtgtccttaaatctgcatctccaagtagaggagcacaggtgggacttggagagaagttgtgggcagttgggggagagcttttgattacagggaaaaataaagttgagtaggtgctagaaaatagagaactaggttgtttttactctacattgtgtgattcttctgtatactttctaacagtttgataaataatatttattgttttagaccaaagaactgattggaagcatgaaaattaatggaagggttgcagcatccacattctcttcagatagtaagaaagtatacgcctcttcgggtaagacaacgacatgaaagaagctaaggatatttttacattttaaattttaggccaggcgcggtggctcacgtgtgtaatcccaccactttgggaggccgagatgggcagatcacttgaggtcagcgggtaagatcagcctggccaacatggtaaaactccgtctctactaaaaagaaaaaaagtagctgggcatggtggcatgggcctgtagtcccagctacttgagaggctgaggtgagagaatctcttgaacctgggagacagaggttgcagtgagctgtgattgggccactgcactctagcctgggggacagaacgagactccatctcaataaaaaaattttttttttagccatctatcctgggcgacagagcaagactctgtctcaaaaaacaaaagcaaaaaaacctaggaccaggcgcggtagcttacgcctgtaatcccagcactttgggaggctgaggcgagtggatcgtttgaggtcaggagtttaagaccagcctggccaacatggtaagaccctgtctctgctaaaaatacaaaaattagccaggcatgctggcgctcgcctgtaatcccagctagttgggaggctgaggcaaagaatcacttgaacctgggagacagaggctgcactgagctgagatcacgtctcaaaatatatatatatatatatatatattttttttaaacgaaaagttgtgtttggttttaaagtttctttttagctagaaaatcagatctatttttagaattcatttttgttgccattgccttctcattaataatagtggaggactaacaatttaacatgcagttttaacatgtttggggaaagaatgggaagataatgcttatttaaaagattattcaggggtaaatcattctcctatgattccccatgctatgaaaattaaaataaaattttacatgcctttttttctctattctctcttttgtcacttggttttcaggaaaccttcagggggcaaaggaaaaacttccactacagtttcatttatattaacattcttgaaatgatgaaatcgtagaaatagagaatagattagtggttgtgagggtttaaggaggatttgagggcaggagagaagtggaggtatctataaaagagcaacaggaggggtccttgtggtgatgggaagttttgtgtcttgactgtatcagtgtcactatcctggttgtaatgttgtcctgtagttatgcaaaatgttaacattgggggggaactggtaaagtaaagagtacactgtgttttctgtattattccttacagtgtgtgtgaatctaaaaggcataattttaaataagtagtcctacctttcttaaaaagataaggcagacattatttaaaaaaagatgattcatttgaaggttttctgactttctttttgaaagttacttaaaatcatcagcccttgtagcaatactctcttgactttgatggtgtgttaaattttctacattattgtccttcctgacatttctgtagctcttttgattaacctgcactgtcctgctcttctacctttctgacttccctaagacttgttaactcttactgtctatcccaaaggaccatgggggccatcccttgggacagctacataatcttagtatagctaatgctgtgtttggtagcgggagactttcaagtggttctgctctgtgggtagtagtcagcaacctctgtaaagctttttagcataatttttatttgacctcagctaggagcatttggtaatataacattaataaaattaatagcattaattaaaattattttttaacttttaaaaaggattaattttagcttaacattaatttttgttttgtttttgtcctagaatcagactttcacaaggttatttacattggtatgtttttaatcaatgcatataaggccaggagcagctatattttctatattatactagtttttgtgagaagaaagaagaaaatgaagagaaagaggaaggaagggagggagggaaggaaggaaagatggaaggaaggaaggaaggaaagaaagaaagaaagaattagttcagagtaatattcctgatgaaatggcccttggccctggtagagagagagtcggggagggagaagaggttggggagggaaaagaggtggggagggttggtcagcagaagtactgaaatttgatatatgaattggacgcagatataatgtatttacaaatttggtcatggctgtggagatctaatttatcataaggtcctaagaaagcagggaaggagaaatcaaaagttgagccttggtaagttaggggtaattttgaaatgttgatggttctcttcctctctctccgcttcttcctccttttcttcttcttcttcttctttttttttttttttttttgagacagagtctcactctgttgcttaggctggagtgcagtggcacgatctcggctcactgtaacctctgcctcccaagttctagcaattctcctgcctcagcctcctgagtagctggaattacaggcgcataccgccatacccagctaattttttgtattttagtagagacggggttttcttgtgttgcccaggctggtctcgaactcctgagctcaggcaacccacctgcctcggcctcccaaagtgctaggattacaggcgtgagccaccgcgcccagccacttctttttttttttttcagactgagtcttgttgtgttgcccaggctggagtgcagtggtgtgatctcgcctcactgcagcctctgcctcctgggttccagcaattctcctgcctcagcctcctgggtagctgggattacaggcacacaccaccacatcggctaatttttgtatttttaatagagacagggtttcatcatgttggccaggctggtcttgaactactgacctcaggtgatctgcccgccttggcctcccaaagtgctgggattataggtgtgagccactgcgtgtgcacccttttcttattctgtatggagtcgtttgtgtgattagtaacatattgttcacattacattgttacatgtaaagaataatttgagataaaaagagttgaagaatttacctttttctaactttactggttttgtctttgtttactcatggatttttttttttttttggagacagcattgctctgtctcctaggttggagtgcagtggtgtgatcttggctcactacatcctctgcctcctgggttcaggcgattctcatgcctcagcctccccgagtagctgggattacaggcatgtgccaccacgcccagctaatttttgtatttttagtagagatggtgattcaccattttggccaggttggtctcgaactcctggcctcaagtgagccacctgccttggcctcccaaagtgctgggattacaggcatgagccaccatgcctggccatctcatgttgccttttttgccataagtcatcaactcatgaccatttcatgcacttgctttctagatgttcttgcttttgatctcttcccattttagtctactgagagactaatctttaaaacactttcctttattataacattaatgtacaggcagacatataaggcaaaggttttaatatttgatcctattcagttttcccaaatgtgttttactactgcttaacctgcacgcttactctagcctggaacattttatttgttagggagttgaaactgagattcactgaattctcattgggagaataagagtacatatggaagggtgaactttagagcaatatcctgcaaggaaggatattgaggtactagaaaaaggaagacgtaaaatagtgaggatccacttttgagatggatgtagggtcattagagtaaactatttgtgcttattcgtaagcttgtgtttagccttttttttttaatcatttaaataacttggtaatagataaattgtgtgtgtcttcttaattataaattcccgtgttctggatccgttcatttttcacttcttcctcttccatcatcattaacattttggtatctaaatcgctaaccttgcctattaggtagtctaatacctgttgatagatgttggaagagttacactagtgagtggtgttttgttttgcttcagatttttgcttcaataatttatctgagtggaacttagaagctttttctaaaagttcaactcaaaccaacagcttgtgatttttttcctgtaaacctaaaggtactgtctattaatgactaactgatgcagttttcttttgtatatgtgaatgtatacaagaaatattcttaggccgggcatggtggctcacacctgtaatcccagcagtttgggaggccaaggcaggtggatcacctgaggtcaagagttcgagaccagcctggccaacatggtgaaaccctgtctctactaaaaatacaaaaattaactacgcatggtggcacaaacctgtaatcccagctactcgggaggctgaggcaggaaaatcacttgaacccgggagaaggaggttgcagtgtgctgagatggcgcagttacactccagcctgggcgacaagagaaaaactgcatctcaaaaaaaaaaaaaggaaaaaagaaaagaaatattcttagtccagttttccagaactaggagggttataataggtctgtatttgtagtctcctgtactgttaagagggactgagagtggccagtttacttgcctttcaagtttaaagcaaaattaacaactctttttttcgctcttttatgcaggggatggagaagtttatgtttgggatgtgaactcaaggaagtgccttaacagatttgttgatgaaggcagtttatatggattaagcattgccacatctaggaatggacagtatgttgcttgtgggtaagtaaagagaggttcttgtaaccttaatcacattgtgctaatgagaatatgttgaggaattgaatatactaggtggtgcatgagtagttctctttataaactattcagtaatatgaaattggtcaacccagctgagcttttttcattttatcatctttgtgcagtgttgaataataatattacagtagttccccccttatctgcagtttcactgtttgtggttttagttacctgtggttaatcacaatctgaaatctatgtaagatattttgagagcaagagaccacattcacgtaacttttattaggatatattgttacaattgttctgttttattattagttgtgttagtctgttactatgcctaatttataaattaaacttttttatagagatgtgtgtataggagaaaacacagtacacacagggttcagtaatccacagtttgaggcatccactgggggtcttggaacatacgccctgccagataagaagggattactataattgcagttgaacacctttttagcaaagaaaatgctggcgctaccttatatcattgtattttttcctatttaaaatacctgtttgatcacatcaagttttcctataattattttcagcttcttgtcattgatgaggagatagaataagtaactttgggtttaaatcttaaagatacctaaagcatttttcctttatccagctgggggtataaataaaaaacatgttcctaggaaataccatttgatagtattgtagaaactttaaaaatattatctagaacacattgtactgtgctattactgaaaacattggttattacactggggaaaagatggctgtgttctactacttgattctgaagatgcagggtgagaggatgaggcattggatacttcgcagtaattctaagctaccttactaaaccactaattagaacccataattctgtaacttcaagaagtaggtttttgtgattttcttagaccaaacacaattgagccatgaaatgatttcagtcaaatcctccctgggatgggaagtcaaggggtcttgttgtccagaaacttagcatactctctactctttgttcactctctccttccaggttaaaactggggaaactgcttgtatatatatccctaccaccgtttgcaaattggagtttgggaggaaaggcaagtagaactaggctgtggagcttggagaccaggccatctgccttaggcagtaagacagtaacagatcccttggagggagagtgccctgatgaaggccccttcctttcctacccatacccgtgccaaccctgtagcgagggacatctcagcacaagccaagcatttaccagggtagtgtgcgctatggcagcaattcatgagtagcagatcttctgggaataaagctcctttaaaatgaagactgctgtttaaactcattataagtagtttttaaattttttttattatacttttaagttttagggtacatgtgcataacgtgcaggtttgttacatatgtatacatgtgccatgttggtgtgctgcacccattaactcatcatttagcattaagtatatctcctaatgctatccctcccccttccccccccgacccacaggccccggtatgtgatgttccccttcctgtgtccattataagtagttttaagaactgcatttgcctctatatggggcaagaaaaactgcgcagaaatgatcttcactcagatttgtgaagccagtcttcattgccctctcttttttgtatcactttttattagccccctttgaagggcctatataggaaagaatctaatactagtagcttaaactcatttaattttaattgcccttcagtgtaattgatttctgatgtgcttggccaacaaccatttaagcttttagaatcttcaagttattcttaaagaatcttaagcaaatctttaagcttttagaagaggaagaaaggacagggagatgagccttgaggtcactgcagcaataggcaggcatcaggtaatgagtcaccaggacagtaggaatggcagtgggggaataagcaaaggatgtttgtaatgtatttgataagtgcttagaagatggggagtgggagagaagtattcacattctcaggctccaggcctgtgcaaccagaggagtggaattgtcattgaagggaggcgggaggaggggtgatggtgttagaagagataatatgcatgtggccacccccacaaacctttaggaatgcagtgcataattaggactaaaggcactgatttggatgtggtgggtgataggtggtctgtgggagtaaatgagatgaatgagacactagaagtaggttggaaatagaatcctggggacaagaatcagtggagaaagaggtgactgtgaaggaatcaggatgcaagaagagtcagtaaagtttagccttcaagaagtcaacagaagggggagaatttgaattctgttttcaacctgtttggttggaggttctataggacatctgtggctatagtggtgatagctggtctctttgtaacatgattcctgtaaataccagtttgtggggttaaatctatattcacttaggttgtgaaagcccttttacttggtttttaatctattttaatccttttctctttgtagttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggtaaatatttcattacccctttattattgttattttttaaatttaagttgaaaacatgcaagagtaacaggaaaggagagcgttgaattatttttaaaacagtggcttcttttgatataggaattattagtattgtagcttttggatgtggttgttggaaggatgcacagtagccaccacatttgattatgtcacttctttcagtaaagctttgctgtccattctcaccattcctaaagtggtcctcattttcagaggtttcttttagtattaatgttaaggactatatttaaggcagacacttcattccttcacaattttctttcctcatttacctttttaaggcctgttgtcttaacagaacggaggcaattctcgggttttgaaagtaagttgaacttgaaaattaaattgtataaaagtattgtaatttaaatagctaggtagtacctttgaatataccctttgtgttaggaatccgcaggaccacctccaggtttggtggctaacgagagatgacttccaggactctgcatatgttcattgaactcatggctaaaatgtattgcagtggaaaggatacaaagcaaaatcagcaaagggaaagggtacatggagtaaagtccggaggaaaccttctaagagtcctcttctagtagagtcacacaggacagtttaattcctccagtaatgagttgtaacaacatgtgttaagtgttttctacctgggaagctcattagagactcattgcagaaggtttttattgggacttcatatagggtaccctctgcctagcatgtaccaaaattctagattcccagaagaaaagccaggtgtttagcataaaccacattgtttgtacaaacagtttaggcacagtgagctacccatatcatttagggaaagtttcatgccagtataggaactgtgtgctagtcaaattctccgacactatgcagtggccacccttgtaagcagacctttctgttttttttgttttttttttttttgagaccaagtctcactctgttgcccaggctggactgcagtggtgtgatctcggctcactgcagcctccgcctcctgggttcaagcgattcttctgcctcagtctcctgagtagctgggattataggcatgcgccaccacgcccagctcatttttgtattttttttttttttttaagtagagacggggtttcaccattttggtcaggctggtctcgaactcccgacctcatggtccacctgcctcgggctcccaaagtgctgggattacaggagtgagccgccgtgcccagcccagaactttctaaggatagcagccttgggcctatgtaaactcttttctgcccaacatcagagctcactttcagtgtcaccccatctctgtgaagtttcctaatcttcaggcagagccaattttctcattcatttaacaattttttgctcaaggcaccaggtatacagaaggcatagaactttgaatagcagaattatgtttgctgctatgtgtgtactaccagattgtacgcactttacaaagtgtgttatttttattgtgctcacttggcaaaaagccttgcatctgccatcagctttgtattagaatatatcgtttacaaagatttacaaagagttctacaaaaagtttgagccaagtaacagttcttcagaggattaacttaaccaaagtaaacagttaataaagggcagaattgtgatttagattccacatttttttctagcagttcattggttttctggctgaattccacagagccctagattctgcacagggctttatatggcatgtagggcaaggaggaggctaagctccttaacttgtatcatgtagagcagtgtcattgttgtctgtggtatatatattgggattctgcatatgatttccttaagaaatgttttgttgcgctgggcacggtggctcagacctgtaatcccggcactttgggaggctgaggtgggtggatcacttgaggtcaggagttcaagaccagcctggccaacatggtgaaaccccatctctactaaaattacaaatattagctgggcattgtggtgggcgtctgtaatcccagctactcaggaggctgaggcaggagaatggcttgagcctggaaggtggaggttgcagtgagccaagatcgtgcctctgtactccagcctgggtgacagagtaagagtctgtctcaaaaacaacaacaacaacaacaaaatggtttgctggaaaaagagtgtgaaaattacagcatagcattttattgctatgctgttgaatgaatcatttgataaatgagaaggttctaattcaagtcagctttaaaatccctgctccctaatgggagtggtatactagtaatattaaccttttatcactttaatggtagtaaattgttttagaaaaccatgggatctatctcctgttgacataatatattctgcaagacacataatagttctgcattgtttgcttcagtgatcatgacagcatttatattttttttattgtggcaaaatcacataaggaattcattagtaaaagccaaatcacagtttttaaatggtagtcaaccataatatctaatggaaagaagccaggcatagcagctccatataatgccttgtaaaaaacattgttagcattgttaaatgcagtcaattccttataatgatctagacggttttgtcatcccattacaaagcactgtgaatttaagctgttggactagtaggagactcagaagtcaaattcctgttacatcgacaattttggatatagtagaacgtcatggaactttctacccattaaatcaaggatgagcgagcttttacttgttgaattttgatatctgtacacttaactgtcgtgatagaaatggtattagaaagctggctgcggtggctcacgcctgtaatcccagcactttgtgaggccgaggcagatggatcacctgaggccaggagttaaagaagttggatctttataggcatttttcctaattaatagttcaattataccttttaaaatgggggctataaatagatgtcagagcacagcatagttttaatcaggtgagatcattggcttgagggaagattcaccaatgcattgagagattacactggggaattttgcaggtagatgctgttgatctcttaggacattgtaaacaattcccctccttttcccgatattccaagtcagtagcagagataaagtttaaaaataggtcaggtgcagtggcccacaccttaatcccagcactttgagaggtcaaggtgagaggatcacttgaggccaggagtttgagaccagcctggccaacatggtgaaaccccatttctactaaaaatacaaaaattagctgggcgtggtagcccacacctgtaatcccagctactcaggaggctgagacagaagaattgcttgcccccaagaggcggaggttacagtgagctgagatcgcaccactgtactccagcctgggcaacagagtgagtgagacttgatctcaaaaaaaaaaaaaaagaaaagaaaagaaaagtcattcagatagaaaggttggttctagtgtattttgatgaggaagagtcagaaaaccagctccccaaacttcaaagtcattccaggaaagttggtgagtgaatgcctgaggcctagtttcatagtatcaggtgaatagggtgggaacaaaaggcagaggtagaacagctttgtcctcaccccttgtagcaaatgtttttttcctgatcatctgctttcctgatgctttggatcatctgttcatagttggggcatgcttgaaggatacaaacttacaataacccaagtgaaacacagttaagccaaggtacttatcacaaatttatataatatctgccttcccaaattaaatgtaaataaattttgcaatatccatgttgtggcttctctctgtaaaacaggagtctgcttttttactaagtgcttgaaaaaatatatatacttaaaagtaatttctcgaggaacctgtatagagagtggtatttaagaactttagaagtgaagtccaaattggggtactgccaacttcttagctttaatgggtcaagaccacttctcattagcaccattgccttcacattgatgccacgctgtgcaggcagaacctgccttctggcaaagttgaaaataattgaatgtggcttggagattcactgtaaacagtattttcttgacaaaatggtcagtaagtatgtatcagaatttggcctaatatgtgactgactgaaaccagtttaataggtgtatgtatcagtggtttttacccagcacttgcctgtgaaaatcactttgatggtataaagtctgacctagaagtgtggaggatgactaactgcccagctgaatgataacggttgtatatatttgaacatgaaggtgctatatctcttgggagagctagagaacatctgaaagtgagtgttgttacaattgtggcctaaaggtaactgcttccatacctgggttttattcatccacaaattgggtgaggacctgtctcaactctcctgaacttaggaagtagactctggagaaagagactgtgtgtgttcctcctcatacttacgtctggctttgaggtgagcttttggctctctctaaatcagaacagtttcacttggagttagattttcatgattcagccctcttcgaggagaaattgtaaaaggcaaagtgtatatacaatagttgaaaattaaaagtacaaaatggcaattttatgatagtagaatatatgtggtatgactttgcctaggcttcagttatgtaaaatcagactttataatgtttaatttttttcaccatttaactaaccagatgaaccttcatgtttaaaatctcttttccctgtgatcagattttagtattctttactgtggtcattaagctagagtgggtactttttgctttagtttattcattaatttactcattcagcaaacatttgaatctctgaggcatcatgctggatgctgtactgacgcttttttctctttcttccttttctgctcagttaataacacattaaagatcaaattttatagtgtgtacacatggacacagtagaataataggcattggagacttggaaaggtgggagcatgggagaggggtaggggatgagaaattatctgatgggtacagtgtacatcaatcttgtccaacccacggcgcaggacggtttgattgtggcccaacactaatttgtaaactttcttaaaacatgagttgttgttttttttttttttaagctcatcacctgtcgttagtgttagtgtattttatgtgtggcccaagacaattcttcttccgttgtggcccagggaagccaaaagattggacacccctgtccaccattggagtgatggtgacacttaagagcccagacttcaccactgtgcaagaaattcatgtagcaaaactgcagctgtatctcttaactataaaaataaagtaataaaaaaagatcaaacttaattttggaacactttgctgcactaatagactgtactttcttgtgtgctacaatcaaaatgagctttatgtttcagcaggaagatagagtgaagattacaatttaagaaacatgagctcccagttgttacactttaaagttttttattatctcctgcaggttcatcttccttcctgtacagtattttcaaacttcccagtcattaaaaataagaatatttctcatgttcataccatggatttttctccgagaagtggatactttgccttggggaatgaaaagggcaaggccctgatgtataggtaggtattatttatgtttaaaagtcagagatacctataaactacttctgacagtatgaagagatactatatattcctaattctacagttaataaattctagtctgtttatcttgactctcatcttcattatcttactttgggttattttattttattttattattattatactttaagttttagggtacatgtgtgcactgtgcaggtttgttacatatgtatacatgtgccatgttggtatgctgcacccattaactcgtcatttagcattaggtatatctcctaatgctatccctcccccctcccctcaccccacaacagtacctggagtgtcatgttctccttcctgtgtccatgtgttctcattgttcaattcccacctctgagtgagaacatgcggtgtttggttttttgcccttgtgatagtttgctgagaatgatggtttccagtttcatccatgtccctaaaaaggacatggactctttattttttatggctgcatagtattccatggtgtatatgtgccacattttcttaatccagtctatcattgttggacatttgagttggttccaagtcttttctattgtgaatagtgccgcatcaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgtgatggtatcttattgtggtttttatttgcatttctctgatggccagtgatgatgagcattttttcatgtgttttttggctgcataaatgtcttcttttgagaagtgtctgttcatatccttcgcccactttttgatggggttgtttttttcttgtaaatttgtttgagttcattgtagattgtggatattagccctttgtcagatgagtaggttgcgacaattttctcccattttgtaggttgcctgtttactctgatggtagtttcttttgctgtgcagaaactctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggacccagtttcagctttctacatatggctagccagttttcccagcaccatttattaaataggcaatcctttccccattttttgtttttgtcaggtttgtcaaagatcagatggttgtagatatgcagcattatttctgaggcctctgttctgttccattggtctatatctctgttttggtaccagtaccctgctgttttggttactgtagccttgtagtatagtttgaagtcaggtagcatgatgcctccagctttgttcttttggcttaggattgacttggctatgcgggctcttttttggttccatatgaactttaaagtagttttttccaattctgtgaagaaagtcattggtagcttgatggggatggcattgaatctataaataaccttgggcagtactttgggtaattttctaccataaaatgtcactagcaggaaacttcacctggggaatatatatattttttggaaagcactattttgagaatgtcaaattgagaaaaagccactttaataatatttccactttcttcgtgccttatgtttagattagcttttgctgatttaataattcagtttactccactagatttaattgatttctttttaaaaggtgtttctttccctgtagctgtaagctgtaaataagggtgttaaccacaaagataaccaaaacttatatgcgctgtccaggttcttttctgtacccaacatacttggctataaaacaggaacaaacaaaacctaattgcatcattgctagaagatataggtgacaaggtggatctttagggagaactaaagagctttcagtagaaaacttgtgatgtaaatcacagccctcttgccttgctccttgtgttggtagtgaatgctacatagaaccctgtgtttatgtttgtatgctttagggaattcctgctttcaaaacggactaaaatctggagtgaagaaaaggaggaatgtaaattggttttgaggaaatagttgtgaaaggagaatataccagacaataatgtggtttacagttctacttactttgaaaggaaaacaggttataccaggataatttcatcagtctcatttcagatcagatttggagtggttctgtttcagtttgtattttataaaaggatgcagattcttattgcacttagaattttcttccaaatcctttggtatttttataagtgaaatttttttttctctaagacccaaaggccattagattttccaccagagcattgctctttagaatgacactgtttctagctataccagtgactggaattgactgatgacatttttattgtttatgtctgatcaggtatttcatagaccccccatgtgaaactttggagtaagcctactcatgttacctaaaatctgaggcgttcagatcctccagaatgtcagattgaggagtctgaacctaactgcctggtgtgaatgattgtgattacatatttttcccactaaaatcttcctaagtgcccttctgtgatctaattgaaaacactgtgggtaattacaaagttgttcagatgacttattttttacttttccaggttgcaccattactcagacttctaaagagactatttgaagtaagaaaacccttttcttacaaattctgcaggttttaagatacacccattgctgtcagttggtggaagcagcacattagctgagctttgtttctctacccctaagttactgcatctttatttagaggggtgggttggaagtagatcaggaactgtctagctgaagttggaccctcctttcttatcccaaatcacagcaatctggctcggttcttctgaggtctgatctctaatgttgcattcaataattctcatcaaaattgtaattactgaacatgtttaatccacaaaagacttaataacacagagagatgggtcttcagatatagctatagcttgtatgagcttgaatcctcttattatatatatgtttcttgagagattagcagcttgctctgtttcacagagctagataatggggctggccattagttctgctgcccaatatttaaaaccatagaacatccttcccttctcatggtgtcctttcaggcctgagatgtggtggttctgagattgagctttgcaattggcctcttcatcacagttgactgtttggtctcctcagagattaatgaatgttgagggactttgagaatgcagatagatttaattaggacaaaggatttttaaaggtacaggcattttgggcaaagctttagcaaggaggggaaagcagtttagctctcctgtctcaaaagattacattgccagtacgtgtctgttgatgaccagcagctataaatcaggtatgtaatttcttttgttctttcctcaggtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttg

SEQ ID NO: 36469 - DNA, 31147 bp, Homo sapiens
attctcgccgcgcccgggcggacgatccagcgaacagccccgcttctaacccgagatgctgctgccggcgcccgcgctccgccgcgccctgctgtcccgcccctggaccggggccgggtgagtgagcacggggcccggggcggcccgagcgcgcgcctggggcccgggagcctgagagtcactgggcgtcccccgcgccgcactccctccctgccggacccccaagctgcctcggtcaacgccgggttcctcaggggctcccctccgacccccacccaggcctttctcccactgagatcccttagcctcctccctcaggtagtcaccttcctttagcgaggggacccctcttcccgaatcctgcgaccgagtagggtgcctcggtggccctgccggttcccacgctcggaaagtagcctctgtagtcactcacctcactcctaatactggatcttcgcaatttgctggcttcccctgaggggcccttctatttttagcacaccacacatctcacttccccaccctcgtctcacgttcagtgtccccatcccgccccggattccccgagtcctctccttctaccaggatttctacctctctcttttccgctccccacacaccccgccgcccgtttttttttttttttttcaagttaaatgttggacagaaaaaaggattcctttcttcttgtaggtggaataatcatatttatagagtgcttataatgaaccaaatgctggccgggcaattggcaggtgtcttatgaggattaaatgagttaatacatggggagtgcactgaacagtgcccagcacaaaggcagcgcccggttattattattgccacgatcatcatcattatcacctctatttaaacttctcactcctgtgaggcaggtcattattccaaataatgaagaaacccaggagcagttcaggggtggacctgcccttcaaatcccgatttgcaaacctgacattgtggagccaggtgcctggacccttgcccactcaatgacaaatattctcagagcccctccagctcggagctaggtttggagaggtaggtgggacacagaccctgccccagaggggttcctagtctggtggggctgcccacctgtggatcagccccccctcccatttgaggtttgtttgcttgacccctggggctgttagtggcagtgtctttcctgatgagctgtgccctttctgagttaatcagtggccctctcccttcccccaagggatggcatggtggtgctctgagcacaagtgagttgcaacactgctgtgtgtcctctgtgggtgaagaggggataggaaagggcgcaggaagaggacatgggacagaggggttcctcttctaggctgagactggggccacacttgccatactccctgtgtgatcccgtttgcaggccttccctgcactctgagactcaggaagatggagcttatagagtcctgtgtttactgagtgcctactgtgagctggtgctctgccaaacaccctagagatgaggggtacccagggaatttacatggggtggggcctttgaggagttttcggcttaataggggagaaatgcataggaaaaccctccaatatctagtagaaagcaatccatattctaaaagataagcccatgataacaataatgattatcaagcaatcaagcaccatgggcctaacaccgagccggtaagtactgtctcattcctgtattatcatgggaaacgatctgccatcagagatatatgactgaaattacatttggtctaaatccagatttatgctctgaattatgaggcctcctgaattgagaggggaaagagaaagagcattttgcagctggttccctgggctcaagttacccctttgatacagcagctggccgcatgccctagacaggatttctcaacctcaccactattcgcatttggggctacattttggttgctgtggagtctgtcctgtgcactgtagaatgtttagcagcgtctctggcctttacccgctgcatgtcaggggcacccccggccctgacaattacgaaaaaaaccctggccctgacaggaaacacaagttcccagacattgtcagatgttacctgggggacaaaagtcacctccggttgagagccagtgctctagaggaacagctttgatgtttgatcacttgttcatttactcagtgaacatttagagcacacccgtgacatgccatgtctgcatttatggagaaacagtcgcagggcattttcagtgacatccctcagtgtcctacgtgtaaaactctagtcctgagaaaaaccgctgcttttgaggaacgggtataggagatgcttcttagtgttttcttttttgccttgagtgccaggaatctctgctagttttaaaaaatacccttgatacatgttttcttttagtttaatacatgtcaactgtgaaaagtacagataaggcaaaaaaatagaaaaatcacctggaattgtaccacacagaggtacccactgttaacattttgattcatgtcctttaactttccatgaatagatatgcttttaaaaaaaacctcatagaaacaagctcatctgcccatactttattgtagcttgttttttccctttatacacttgtctgccttacagtatgttcccaggccctggaactgtgtctggcacctggtaagcccttggcaaacatttagggaatgaatgaactaatcatgtgagcccttccttgtcaatcgatatttatcacggccagcctcaggacaatcaccataaagtgtggcctttataggtgggcccagggatggcagctggtgacaatgactgccatttacttttcatgtggattattttactcagcctctcagcaacctatgatgtaggggttaccacccccatttcacagattaaacaactgaggcccatggaaattaaggaaaacttgtccgaggccttgagctggtgaacaccaggcctcccaactgactgtctctttcctcctttaaccctgacttcctgtttttttctcaatcaactttaccatcagtatcctcagttctctttggaaacaggcaggatacagattaatagccagcccaggcatgtagtaggcttataagagttcacttctgttccttatttcttgtgccaagcccagacatgactccagctcagcccgtctgacatcagggggcttgtgggccggaattggttactaccgtgtcccctgcagtgatcctgggtggttttggactcttctcaggctacctgatggtttaattttcaaaatatcaaaagcacacaatgcttttcctagtctgcccagcccttggatgggcacagcttgccctgggtcgagggctggcatttcccaccattccttagacattctctgctcttgaactcctccaaccagtggctggggcagtgcctttggcctggaatgtcctgctggccacctcggtgagcccatccagtgctttgtggccttggcaaggcagcttctgtcccttcagtatcctcgtctgcaaaatggggatgattgtattaacagccacgtagcaggtggctgcaaggattagcggtgatgtgatcagtggtttcctggatgctggtaccgaatgcgtgctctgtgagtatttgagttggagaataattaaaacctgtgattatcatcacacttctaaagtagtgaaagcgccattgaggcagtgcttggcagtggcacccctgggagcagcctgcctcctgtgccctgcatctggcccggcacacagtaggcgttgaacggttgctgttgagatggtccagaacacagcatggcttggatcctggctccaactcttggcagctctgtggccccgggcaggttactcaccctctctgggctcccttatgttctcatatggaaaataaagatgacagtagtagtcacctcataggattgtcctgcgtgttaaatggtctcatacatggaaagcactttggagtgcccagcacctgaaatgctcagtaagtgctgctgtggttatgatgatccccctctcccaccaatgggcttcctggagtgatcatcttcgatcaggaatatcaagacagcagggcccagcagtgaaggatggtggcaggaggggaggtatggaactcagatgtcctcggtctcttctgtttattccaattaagtaccccagatgccaaacctcttctgttattattgttggtttgtttgtttgtttgttttggagacagagtctcactctgttgtccaggctggagtacagtgtcatgatctcagctcactacagcctcaacctcctgggctcagtcatcctcccacctcagcctcccaagtagctggaactacaggcgcacatcaccatacccagctaatttttgtattttttttttttcgtagagacggggtttcaccatgttggccaggatgatctcaacctcctgggctgaagtgatcctcctgcctcagcctcccaaagtgctgggattataggcgtgagccactgcgtccgaccttctgttagggttttgaccctgctcacctcaggggatggaaaagacttctccctttcttgcagcctccttaatccccaaaccttccctttcctggcagaggtcatggcatggagtgaagagtccctgggctgagctgctgtgccagtggacagctgagtgaccttgggcaagtcactgcccaccttggggcggcggctttcctcaggtggaaatgaggttctagctgtatggtgaggaggatgaacgtgtcccatcagccccacctgaccatgggcctctgagatgttccaggtgcttcagccatactgtaagtctcctgagtaaggaacagctggggtcaaatcctgctctgtcactcatgagctgtgaccctgagccaggagtgagtaactctgaacctcatccgtaaacagatcattctacggtcgagtgtccctcatctgaaatgcttcagaacagagtgtttcgttttttgggtttttgtttttttgagacggagtctcgctctacctcccaggctggagtatagtggccagatcttggctcactgcaaccttcacctcctgggctcaagccatcctcctacctcagcctcctaagtagctgagactacaggcacacgccaccacgtccagctaatttttgtacttttagtagagatggggttttgccatgttggccaggctggtctagaactcctgacctcaagtgatccgccctcttccgcctcccaaagcgctgggattataggcatgagccactgcgcctggccggaagtgttttgtatattggacttgcttggattttggagaatttgccgaacaagttgagcatccctactcccaagttccaaagtccaaaatgctccaatgagcatttcctttgagcgtcacgttgacactcaaaaagtttcagattttggaacatttcggattttggatttttggatcagggatgctcaacttgtcatgcgttcctcatacgcttatgtggtggattcagtgagatgatcctgtctcacttaggttaatgcttggcatgtggtggcaagtgcttgacaaatgttgcctgatgtttgctgggcagtggctgaagcagctcatccctggcattgggtctttctttcttttttttttttttgagacatcgtctcactctgttgcccaggctggagtgcagtggcacgattttggctcactccaacctcttcttcccgggtacaagcaattcctcttcctcagcctcccaagtagatgggattacaggcatgtgccaccatgtccagctaatttttgtatttttagtagagacggggtttcaccatgttggccaggctggtctcaaactcctgacctcaagtgatccaccctcctcagcctcccaaagtgttgggattacaggtgtgagccactttgcctggctgggcctttctttccctccaggccccgccctgggccctgcactttctctgctcacctagtgttgcctttatgtcggtgatagggaggattagccttatcaggctccagataatggctggaaaagtcaggaggctgcatgaagcaaagataatttcctttctatttctcctctccttgtccttggccacccctcaccttagccactggggaacccaaggggccagtgtccagccccaggtgatagcagaagagcactggccttggagtccagtcctgggggcctggtgtcagctctgacactcatgcattgattgtatttctcaggtgcttactgtggccagtcagtgtgttaggcttggggtgcctggtggtgaatgggatgggtacgggctggctgtgtggagcctgtggcctggcgggcacacagatggtcagtcagagctctataatagggttttcactagtgcttccagaaaagtctagagctatgagaggaatccgataggagccccattccggctatgtgaggttggaccagtggaggacatctcaagcagagaggaccccagaagagaccggggtgaccggattgcaccaaatggggcagggtgatggggaatacatttggaggccttggtaaggattctgatgtctttattttagaagaaatgagaagccactgagtagtttctcactgagctccccactgtgccatctctctgatgatcagattttcatgttaactttggttgcggtgtggacctgagtgacttggagactggagcagggctggcatggcgtgagtccaggttgaagtgactagtacctcggacgaggtgtcttgggcaaggtggagtctgggccctctgtgtcttttcagtttttccctctatagatttctgaagctgcattggctggcccacagctccttgcaaccctgacatctcctggtgcagaaggtgaaatggtgcctggcctttgtagatcagatcccagtacttgcaaccctgacatctggtgcaggaggtgaaatggtgcatgtcctttgtagatcatatctcagtacttgtagccctgacatctcctgccacaggaggtgaaatggtgcatggccttcatggatcggatcccagtacttgcagccctgacatgtcccgctgcaggaggtgaaacggtacatggccttcgtggatcagatcccagcatttgtagccctgacaacttccagtgcaggaggtgaaacggtgcatggccttcgtagattagatcccacttgtagagggtgagggggaccaacttgaggtctcaggctcagggcatgagcagaaagggcactgcagattttcagggaaacctgagtcagattcagactctgtcttgtgccgccttccctaagtgggaggactgagggctgctctgagaaaggttgggttggatccatatctgcctcccagagccaggcacttcctgggtgcttggaaaacgcatgctgaataattgagtgagctgttattgacctgatccaatttatctctgcatcgttgccatgtggaataaatgtgtactgactgcataaatgcgtgaatggatgaggaatgctgtcctgccaagaaggtcctcatggatcctcagagaggccccaagtcctgtgactgattcatctctgccttcacccgagcagccagtggatggatactcctgttagcccaaaattgttcatgaaccaaaaaaaaaaaaaaaaaaaaagaaagaaagaaagaaaaaagaaagcactgatgggtgggagtccttaggttatttttagctgcagtcgactcaggctgaactttgaactagtgtctgttctccaggccacactcagactgatggacggacagctgggccagtgcttggagacttccaggcacagggaaagccgtgggggcatgtgatcctgaggtcacagtgggcatctgggcctctgccctgtggaaggaggagggaggcctgcaggatctctgactctgacatttcctgggagggaacggagaaaggagaactggccgctactacatttatttatatattttgagatggagtcttgctctcttgcccaggctggagtgcagtggcacgatctgggctcactgctacctctacctcccaggttcaagtgattctcctgcctcagcctcctgagtagctgggtgtataggcgcgtgccaccacgtctggctaatttttttgtagttttagtagagatggtgttttgccatgttggccaggctggtctcgaactcctgacctcaagcaatccgcccacctcagcctcccaaagtgctgggattacaggcgtgagccactgcaaccggcctactccgttttaacctggggatggaatatggtgctgtgtattcctccagcagttgctgagtacctgggccagtccccgaggctgtgatttttgggggcatctgggagcccatttgtctctgaaagcctgatctactgaaatagcattctgagacctttacagttttctttggaaagcaagagcaggaggggtgaggaaaggccaacacttgtaatcctcctgatggccctgcaaggtgcatcatgtcaaccttaaatagtgagattcagaaagaaggattaagtagtttattcgagctcagaacttgaggatggccaccggggagcatagattcaagttacctcgaatatacactccgattagctgcagtaacaagtgggattttaaggtgcggaggaaagaggcagtttctaagtcatttaccaaaaatttatattaaaataatataagctaccggctgggcacagtggctcacgcctgtaatcccagcactttgggaggccaaggcgggtggatcacttgaggtcaggagttcgagaccagcctggccaacatggtgaaaccccatctctactaaaaatacaaaaaatgagctgggtgtggtggcgggcacctgtaatcccagctacttgggaggctgaggcaggagaattgcttgaattcgggaggcggaggttgcagtgagctgagatcgcaccactgcacttcagcctgggtgacagagtaagactccgactcaaaaaagaaaaaaaaaagctactgatttgctgtgcattgttctttgtgtgacgctttccaggatcatgaagttaatggatgaggcagctagtcagaaacaaaatgccttgaaataattgccatcgggtgtggatgcaaagggcatgactcaggtcccatattcgtgtctccctgggcctgatacattttgcatacttcacatagctcacgctgctctgagctatttttctcttttcggtagtattgtacccattttccaggtgaggaaactgaggctcgcagactttctaagaatgcactgaggtcatggagcaggtgtgagctttgcctccggatttgtccacttctggggcctgtgcttttcccatccactgggacctgggctccaaagaggggctgggacagactcagttatttggagtcccgcttctcggctgaaagagttgatggtgatatctggctcaccatctttggtgggtgtggtgctgttgaggcctggagcgcagcttgaatgcagggtcaggagcttagctgaggtccctgtcagaagcttccagatggtcccaggggattgacactgccttgtcccttcctgagggactgtggagactcgtggctgcctctccattcttctcatgatggtagatggaagagggccgtgcagattttaatgtatttatcgttatcaaatctccatattaaccccatgagggggtgtcagtgttttagggagggagggaaactggcttcaagacatgtgacttgcccaaggtcacacagctagtgggaggcagagtgggggtggggagtgcagagctaccggctcagggtggaggttggtggggaggggaggggagtggagagaaggtcctatgtgctcactttacctgtcaggatcttgggtgccctgcccctgcctctccctctccctctaccacgcaggcccctctcagcccccccccgcctccttctacctgggatgctcttcccagctcctctcaagcctcctttaagtccctctcagggtcacctcctcagagaggccttccctgaccaccctggctgaagcagccctattctcccccttgtttgccatgctcaccatctgcggttaccttgcttatttcctgaccaggcctcacactgaaggtcacctgtgtgcagccaggggcctcgctgtctctgtcactgctttatctccagggtctgagacggcaccagagacccagcaggtcctcagtcaacctcaagtcaagtggaatgaacacagggcctggccacactcctttggttttgtgtccttccttcaggcttcccaggctgggtctttgagccccagactccttctggcccccgacactcatagccgggccagtctgtctcccatagggcaaaaacaatcccgcagaacactagcctcaggccacgtccctctgagaccatgatcagatgagacacaataagccctcttcctgatttttttttttttccttgagatggaatcttgctctgtcatccaggctggagtgcagtggcgtgatctcagctcactgcaacctctgcctcccgggttcatgtgattcttctgcctcagcctcccaagtagctgggagtacaggagtgggccactacgcccagctaatttttgtatttttagtagagacggggttttaccatattggccaggctggtctcacactcctgacctcaagtgatccgcccaccttggcctcccaaagtcctgtgattacaggtgtgagccaccatgccgggccttctcttcatgatttttgtctaagcacggacaaaaacaaggtctctgtgccacccacaaagctctgcacatcttggtaaatgttccttttttcccagtcagcctcacccccactttctgatggcagccaatccagagctaaccgtggcttccttaaaccctccccaagtcaccctgccaaaccccatgggtttcctaacagcatcttactgagatgccctgtggttccctacgctgtgtgttttccctcattgcgccgaccagtgaaccccacctgtgcacttccagctgttcgggttgtctggggccattgacaccagagagagatggtatctgggccttctggactcaagtgcaggtttcccctactcttgatcttgaactagtcattttccttttaggaccaaaatgaccttatttctgtagagaggtggctggtgaggcccgtcctatgccacggtagatgggaagtttgtcaatttcaagtgccctttgggcattagttgactttgtcatcatcattcttctcatttacagagggggaaacaggcctgaaggggaagccccacagctgggaggtggcagggctgaggctccagctctggaatgactgaccccagcgtcctagctttgagccacctgacctcccaccttgtgaccctcagatgtggtagggggtggtggaaagaggtcagaggatttgagcaaggagttcttgagactcagtgtcctggaatcaggcacctcacccccagggccagccctcccggggctgtgagctgagctcagggcagctctccaagttcatggtccacatcttggacattcctgcccagccagagctctcagccctttgtgccaaggggatctcagctggttcacattctgagactgtgttctggaatgtgctgccctttcagcttagagagaggagtttgggtctttttgggataaagcctgccttgtgggagaagaaagggagagtaacgctttgcatgtggaaaatacttcaacgtggttttgcatctgtgtgtttaaacttcaaacaaccgcgtgagttcggtgcgattattcttacttgatagacgtagaaccacgttcacaggaggcaactcacaggctcaaggacacacaaccgtgggactgggacttgaaccttgggttgtggacccccaaggtgggtttttgttgttgttttgagatggagtttttcgctctctcacccaggctggagtgcagtggcacgatctcggctcactgcaacctctgcctcctgggttcaagcaattctcttgcctcagcctcctgagtagctcagactacaggcacacatgccaccacacctggctaacgtttaaaatatttttagtagagacgggatttcaccgtgttggccaggctggtctcgaactcctgacctcaagtgatttgcccgccttggtctcccaaagtgctgggattacaggtgtgagccaccatgcccagcccaaggtggggttttgaccccccactttctagttgcattggatttcaggctctgggtgcccacctaggaccccctgtcggaggtagaggggctggggtctggtggtggggccgctgctgacctctctgcctctgtcccctgcccttgtgttccagcctgcggtggaagcacacctcctccctgaaggtggccaacgagcccgtcttagccttcacgcagggcagccctgagcgagatgccctgcaaaaggtaatgggagggtgggaggcacccgagaggtgcagggcatggagcagaggccatccccagcagccctgagatagcgccccgtgcctgcagccatcacccgcttctacccttgctcccagccttgggtggaagcctgggagggctgtgggtctggagtgtgggaacagctgggaggaccaaggtggcagcctggagctactctggggcttctcaggccaggtcagatgtcataaacctagttgttttatagttaaacatgttttccagttaattgccagcattttaaaaatcatgagatttcatataagtttcaggtgcagtttttttatctctgtgtcatgggtagacctcaccttcctgcagggtgacaatggctggagcagagtccggctgtccccgagggcagcacatgttctctgatggccaccgacctggcctggcccccttctcatttctgtattgcctgggcacctccgtctgtggactctgcgttagggttttagatgggaggaagcgaggaaggcggtgaccatacccactcttgtccctctccccaggccttgaaggacctgaagggccggatggaagccatcccatgcgtggtgggggatgaggaggtgtggacgtcggacgtgcagtaccaagtgtcggtatgtccagcgggtgggcagagctcagcccctcccctgaatatgtgacctctttctctgacagctcgtaagcttataatgtgtgggctctgacttcaaggcctttatagtgcccctccccaccccagattttgaattctgtggaccagtaaaactcccaaagcaaaggacggcacccacactgcatccagcccatagcggcatcctgtgtctgggcaagaaaggccatgagggggccacacagcatcttctgttattcctcatagatttcttgccaagggggtttgggagctaatgacaaaaagctgggccccgggccccgagcacctcagatggcattggcctaagaagcccccatgcttggagtttatccatccagaaactggcatgcactttacgtgggccaggaaactcataggtctgtgatttgagggagaataaaaggtcagcccttttgcaaacagggcaagcacattctggctctgtccggctgaaaccctgggcagacgtgtgcagggggaggggtgactgagggggaggacccaggtcccccactctgaaggttcccaggacagcctggggcaggagttgaccacagcagtgtcctggagctctagttgctgggtcaggactacctggagctgtccaagcatggcctggggtctgcaggcattggccaggtcactctgtctgtcactgggtgtgtgtgcaggtgccagctgacagcagcacctgccacccagctccctggttgtctctgtagctgcctagagcttgccctcacctgtagctccgcaggcgtctgaggctgcatggcagctgggatttttccaggcagcgaggctccggcattctgataagcccctgggtggatactgctgattttcatttcccacattgccttgccgacctggctggagattctggccatgtgctgatcactgtggcacgagacatttggggttctggggcatgtgagggcaggatctatgtttgccgggacatagtgctgacggggttctgcagtccactggggcccaggtcgcagccaccttctctgcccttaagcatcacaggccaatctcaggtgtggcccgaatacagagtgactgtgccaagctttaacatgaaggagaatggtcactttctactcaagcctagaccagcgccggccagtagaatttcctgcagtgaggacagaaatgttccagatctgcattgtccgttccagcggccatgagccgccacgtgtggttgttgagcatgtgaaatgtggctcgtggctactcttttagacaggaaagctccaataacccaccagaagacggataggtagcaaaagtgtcagctattacgatataaactatcttgccagccctaggaaggaaagaagtgaaatttctccctgcttcattggtcatgctagcgttcaccactgccgggcattaggttttgaagggaagacaggggttaaagaaagacacacacacagagagagggcagctgaaacagcaacaccagtatattgcagaaacctgaggaagtgggggaccagcttaatgccagggcccaccgctgcttacaggctgaggtactcatcggtatgggtgagacgggtctgggcagtatggcttgctgcctggcaggatattgataagatgttgttatgatcaggtggtttggccctctccggtgggatgtcatcgtggtgttccttgtacctttacccagcaagatatgatagggatggtttttttttttctgagacggagtctcgctctgtcgcccaggctggagtgcagtggtgcgatctcggctcactgcaagctccgcctcccaggttcatgccattctcctgcctcagcctccccagtagctgggattacaggcatccgccaccacgcccagctaattttttgtatttttagtagagagagggtttcaccatgttagccaggatggtctcgatctcctgaccttgtgatccgcccgccttggcctcccaaagtgctgggatcacaggtgtgagccaccgcgcccggccaacagggaagtttctttaggtgggccttcgtccgccttgcggtcaggcggctgagccggatggttctcatggcctgagctcctgtgaaatgtttcacttggcccgaggtctgcaaaatagcggggagctgacaaaatggtgcggtttggaccaacaccaggttgtgtttataaatgtttgttgaggatcttcctatttagattagtaaatctggggcttaggaaacaattgctctgtccatgatggcttcggggcagggcggaagtcccaagcatgtcacaacaccggtgcattcttttgggcctcacctggttttgttgcccatagtcgcagcctcatactggaccaaagaattttcatccatgatcccctttggttctcctgtccatgctaagagacagggagggcagtccccatttcctagatgaagagacttagggaaggaagtgagcttacctggggccccacagctagtaggtggcagagccaggattcgaacccatgtctctctgaccacaaaggtccgtgctttcctggaaagaccctggggtctatgcctttctcctggactctgagccttctggagaaggagccatgtcttactcatggtatagcgggtacaccagcacccttaacagggagcaacctgtgggccgggcactggggagggtttcatgggagcgggggaggggggacagcaggcgtgtccaggactttcctggaaaaccggctctgagtccagtcctcttcatccttatcctggcacctccctcccgggcaaggacctcactcttctctcctttcagccttttaaccatggacataaggtggccaagttctgttatgcagacaaggtgagtgagcctgtgtgcctggtgacccggggttagggttgctgcccctgctctgccctgccagctgctgatatggcgggggcagggggcatcagttgctgtgtccttctttggccatggtgggtaggtgggcagggggtggctgacactgagggagtccctgggtgatgtctttgactgggccaggcatacaaaggttaacttgagccaaacacaagctgcctcagccagggctgagacattcccagacatgcccattgtggtggggcagaccttggactggggaggaggtggattctggaaggctgagtcagggcaattggagacaccattgatggaaagctaggccaagaattggcactggaaagggccagcaggaggggctggggtggctgggggtccaggaactggcattgtgtggcgatgagggcagttggggtctgggaggccagcagcagagccgtgtctcaggctccagttgacctcaagtttctggatggtgggttaaggggcaccaggtcccaagaataaggtaaggttttgattagaccatgagagaaagtggagccagtgtaacagctgcgggactcagtgccaaggcctcggagagctgaccaacctggccgggcccttcaggcttcagactggcagccactacaggctctgatgggacgctgttgttggcagctatggtggcagggggctgagggcccagggagacaggcattgtccccggatggaagagagtggcctcccaggtctctcctccctcgctcactccccagggcctttcccgctgcaggtggcagtccccaacctctccctctccctttagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacaggtgaggtgctggtgggcccgggtgggtggggcggggtggggtgggagtcaggtgtgccctacccatggcagcagacatcagctgaagcgcttctgggtcctaagcccttttggggacccagagatgtcctcaagggacaaggcctaggagctgggatggatgatcacagattattaggcgagacagattgtgcagagcccatgtgtcctgcctcggaaatgtcccctctcctccatccctctgtcctcgctcctaggcctttgtcatgctttgcctggactggtggtggcctgcactgtctccctgcctcctagcttggtcagcccctcgccgccctcagagtggtctttccaacacctccaggatgttactcctggcttatgacccacccagacctctccaccactgagaggcaagtcccaagacctgagccccatacccagggcccttctgcccacctctgtccagctcgcccactgctctgcatttccctgccaagctgtcctgcccatagtgtagccatttggcacttagcaggactccccggccatggcaggcatcctctctgcctctgcccacgtgtcctcctgcctggaatgcctgctgtctcttccgtgctcagtgaactcttacctcctggtccagcccagatgtcaccccctccgtgagacttcctgagccttctccagccgaaaggactattcctgcctctgtttccccagagcatgttgttcctgcatcagttacagctcagattgcactggagtgtattgagttcctaggtactgcccctttacaagctttttggacatagtaaacatgtcttgacattctcggtctttttctgggctttgcatgatacctttcaggaggcatagcaagcccctgatcaatggttttctctgcacagagctggcatgacagctcctcaccctgctaaatgcaagttgagtgaggagtggctctagcaggcagagtgtgcgggggacaggagtcgagggagaaagggttatttcaccacctccaggacctgagccctacgctgccaactaacctgggttcctgaagggtaaattgcaggagccagaacccaggctgctttctggatcaggcatttgccactgcctgctcctcggtccccatggtgagcgccccctctgctgcacagagctggtatgacagcccctcagcctgctaaatgccttcttagattggctcagcagccctctggggtgggcgtcagctctgcgtgttcctggtgagccgcacgttgctgggaagacagtctaggatcagtttaggctttctctgtatttggcctaagactcaggaacttctaggaagcaaggtacacatcttagctcagcttcatgggctgtgtgtctctaataggtcgtgcacctgccagtgaccttgggtgccaagaggaggccacgtcaatctggaaaagccccgttcttggctgtccacagttcttttccctgcagctcacatttgctgttattaagaattgacggtttaagggaatcacagtcactcgcctcttggtttttggcccaaactaaccagcaaggccgaacatcattcctggggaaggagccatccacctcccacacaccgagtctctctcctggttttccagtgaccaatctccagctcatgctaatctgcccttctgtctggaaggctctgatcctgaatttagtctgaggcttgaccatagatcctttgccatgcaccaccattcagagttgctatgaaatgaagacagtgcatggcaagtacctggcctgctacagaggatcactaaaattcttctgatccccgtccagcccagagggccggctacaggaggtgctagctcaggggcttgagaatcctttccccctcagcccctgggatgggacctggtgagccctccaaatgtttcctggtccctcctggggcccggctcagtgctcgctttgggcacagcgtcagatgtgagaagaggatggacaggaggctgttggctgctcctgacccccggccctctgccttgcagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggaggtacctgcaggaggcagtgggcgagcaggcggggcagcccaatgccatgggcctgatctcaccgctgcctccttccccagggcttcgtggcggccatctcgccctttaacttcactgcaatcggcggcaacctggcgggggcaccggccctgatggtgagatgtgggcacaggtgggacagcggcagctggttgtcctcctggtcccaacagacagacagaggccaccctgagccccttgggtctcagcctagtcatggggagaggcacagaaggtggaggcagcttggggctgtgggtaggctttgggaccagagacccagtttgaatcccagcgtcgtgcctctctgcctgggagaccctggcaatccctgaacttctctgaggcacagtttcctcatctgcaaagtggaaataataggaaagcctccatgactgggttgtgaggctcaaatgagacacatccagcagcaggcagggctggcccggagctggctgagtgttggtggctctgttgatgatcattaccgctgaccttcagtgctcaccacgtgcctgctgctgtcaagcacggcatggagatgatctcatttcatcctctcagcagcttcgagagggagttgtgactctgcctctttgccagatgacaaaactgagacacacagccgtgacttacttggcaagactgagtgactagtaaataaatgatggagcagagaaagatttggatgtagtctctctcggggttgatggtattcaagtcactcctctgccattatcggagtgaggttggctattactggatgaagtcccaggcctgtgggggaggtgcagcccagctcccagacagcctgggtgggagaggtccacatagttgtcgggaaccccgagccccagacaggggcactggatgctgatgccggagtgtgtactagggacatggatggggacgtcctcatgcatctgtgcacagacaaacacggtgcatggccaggcgcccacgtgcctggctgctgcacatgcctgacccaggacatgtgctgagagagcccgtgtgtacttgccccgccgcgcccggtgagcactcagtgactctagcagtaagaacagacctgcctaggtgatggcaggaccggttggtgcaggcttctggggaaagggagccttggccagagcgtggggcagattgggctgtgccgtggcctccttggcagggacttttggagatagggccagacgccttggaggagtggggtcgggtaggggatgtcctggttggcacagagtctggtggttccaggtgagggacaaccatgctgtagggtagggtggggtgggggttgggggctggtggcgccatcctcatgcatcactgaaacacctcccgggcagggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgccgtaagtccctggggatggtgtaggctgtggtggctaggggacgttcacctgctcacctgctgtctgcctggggatggggctgtgaacccaggggtcatgcacggactctactcccttacttgctgtgtggctatgagtgagccacttcacctctctgagcttccatttcttcacctgtacagggagtgattatccttaatttgcagagtcattgcaaggattaaacatgttaatgaacaggaaagagcttcgcagactggaagtgcaccctacagctgtgggtaatattgatttcagtgctacctctgctactggaaagggcacaggggagcacagaatgaactggaggagtcaggaagccttcctggaggaggtgacatctaagcagaggagttggccaggcagaggggaagaggcaggagaagaatatatatgttgggagagggaatagcacatacaatgttgccaagccaaaaacttgtgctctggggcatggcaggatcctgtgtggctggagtgtggagtttgggggcgacagggcaagagagtgagggcagggcatggtttgagttgaggtaggggaggcaggccactacctgatctcgaccatccatgcactcactggctgagcaggaaatttggagctcacactaaggctcagtggtgagcacacaccagggacaaggtcccggctctcaggctggaggtggcggcagggagtggttcagtgaccataagatacttaggagtctgcaaaggtgtctggcctttatcctgaaggtgatgggagccatggaaggcttcaagcagggagagtggctgagtcagagttctgtgtcaggcagagattgcaaataatggcccccaaattggatctggcaagaggctctactttctttgactcctaacagtgatggcccaactttgtataattgggacaatttcatagataaatccaaatattggcctgtcttggtcccctggacctggatgctctgatcttgcatttcctggtggtaccactggctggaagtgggtgggtgccctctggctccctgcatacctgatccacgctgtttcctttccctgctggctcctctgggcccctgtgttggcaccctcattctcagtgatctctctgtgacctgatgcaggagactggccagggactgttgacctccagggaggggtggtaggggcttgaaccaggggagagatgggggatgtggagaagggggcaggttcaggtgagaaggatgcagggaggcacagtggccattgcctgtcctggagttggggttggggtgcgtgtggggatgaggggggttgtcagcgagaatgttcaagatgggcacctgggagggcgagcgggctcgggggaagatgaatctcctgttggtcacttcgggtgttatctgggtggagatgcctggaggcagccagacgcccgggtctgcagctcagggtccttcttacctcctcttccaggccccaggctctgccacccccttccccgcagctttgctgggggtgggagtgggtggtggcagcgttagaactgctgagaagggccgttttccaaaaggcctgctctgccagccacgggcccctgggctccccgcctatcagcgggcggagcgggcctggaccccattctccacgctctgatgagcagcgggcttaaaggtgggaaggccataaattagtattagctactgtgtcgctggctcccgggtgattagcatttttattgttttgtggtgctgaggttggtcacacttggagcctggggaggaggcgaggccctccagggtggtggcttcgggcggggcctgagctccctctcccaggactctcctcggtttggcctctcaggcctgggcgctgggcttgggggggatccttcgcagaccacagcggggtctgttccctgccaggtacctgcagtgtgcccagcatgtcttaagcacatgcctcacacttgaactcatcacaaaacaaccctgccaggtcaggattgttctccctgtttcccagatgaggtgcagaattcgaggctcagagaggttaagtaatgaacccaggatcacacagcccttagtgtcctcctggctgcagaacatggacctcctctgcagcatcttgctgcctagccccccgttgcccgctccccgtagtcttggaatgcagcctgttcccagccgccatccccgacttggctcccacctcctgctgggctgcccccggcaatgctcctccctgggcttttccgcccccttcctctggcctggctccctgaaccccaccctttctcctgtggttccagcaccttcaaacacctgtggaagcaggtggcccagaacctggaccggttccacaccttcccacgcctggctggaggtaaggcctgcctcacctcctcctcccgtgtggccccagggacccctcccctggccattatgaaagaggagggaggtagaggggatccagccacaagtcaggtggatgaaccatttcaggcaccagcactgcccagtagaactttttgtgatgagggatgcgtccagtaccttcactctccaatatgcagccaccagccacacatggccatggagcccttgaagggtggcctgtgcgactgaggaactgcattatctagttttctttcattttaattaagttaaatcttagtagccagtcgtggctggtggctgccgtgtcgggcattgcagctgtaagcggaggcaagtgcaaatgcagagaccagaagtgggaatgaacttgtatttgaagaaacaaagcaaggcccatgagtagggagggaggagggctggtaggagaagacgggctgagacgtaggcagggctggaccttgttggcatattaaagttttcccacaaagaaacagtttcatggtcaaggaaatttggcatgtgtggtgttaaagcaaaatggactcctcccgtgcagaacttctcagagccttgaatgctctaatacgcatggcacatcttcaaggacaaggtctgccatgtagtgtttcccacacgcattgggccatggaaccccgtttctgcaaagacccccatggaccaagtgttttgtggagcacattttgggaatgtgctgaggcctagagggagggagagttgcagccagcacgtgaccagcagagctgggaccggtggtccagcatgtttctctgtggcgtgaattggggcccactggggagtctggaccctgttcctggactggtgggagttcggatgggggtgtcagggaaggtgagcgctcctcagggtcagctgtgtggctttctgctctcagagcctccttccctgcctccctgagggagagaggccgctggttaccactttccaacctggagcaggtgacttcatctctctgtgcctcagttttcttggcttgaaattggggatagtaatgggaggttgttgtgaggctttggtcagacaaagcacagcgtacttcgtccagagttgggcagctgttaagtgctttcagctgctgttagctgctgcttcccacggagggaggaaactgaggccgggagagtgaagtgacctgtctgaagctccctcccactggggaaatgggggagcggtttccagcacgcgtggggaggaggggcccaaccctggcagccgacatagggtaggctccaatgtccctcgtggacgagggctcaggagaacctcacaaaaagctgtgcccacttctgggaatggctggctctcgggggccttgggttctcatctgtcctctgctgttgtgttgggtagtttcagttttcccatcagtgtaatggggctgttggacctgatcacctctgatgcccttcacccctccctgggcctcagtttcctcatctgtggagtgggagaatgggcctggcccgtgggtctctgggatgttggccagcgctcactctgagcctccgcccgctctgggctgctccgtgctcgtgttggtcccgggccatggatggcgtaggtggtgttttgggcccctgggcaaccgggggagccagctcctctggtcatttccccacccccgacccctgtagagtgcggcggaaagaacttccacttcgtgcaccgctcggccgacgtggagagcgtggtgagcgggaccctccgctcagccttcgagtacggtggccagaagtgttccgcgtgctcgcgtctctacgtgccgcactcgctgtggccgcagatcaaagggcggctgctggaggagcacagtcggatcaaagtgggcgacgtgagtggcaccgtcacccccgccgcggcccagcggggggctgatgggattgggtccctgggaggctcctctgcagccggggctggggtgtgcggggaggggtctcccttggtctcggcctgcagtgactcgtctcttctggcgcctcccttgcctccagcctgcagaggattttgggaccttcttctctgcagtgattgatgccaaggtacggggtgggaagtgggcgttcctgggtgggggcaagccctggagtgggtggaagagggaggaagagatacagggtaccctgacccagggcatgacccagccccactgctttgatcaaggcagctcagcagccacacacgcacctccagcttcagaaagggcagaatcagccgtagccagacaagagctcatcttgcggccaccctggaaccaggctcagcgagctcctaatagcatttgcatgagtgcatgtacacgtgtgtttgtgaatgtgttcatatagggctccgtgtggctccacatgtaggtctttccatataaacacgtacatatccatttgcacataagcacacacacgcatatgtcgataagtccacccacacgcatgtacatggagaaggcatgcagatccctacatgcttagacatgtgaccatgcatatgcctatatatgcattgattgatgtgtgtctgtgtttatatgcgagtgcacctgtagtactaacacacgtacacttgtgtgtgtacacacacacacacacacagtgttcatgtctgtccttgtctctgctgtggctcagccagaccctggcttttgcccttggcgtcccctacccctgcccctgtttcaggagttgggcccttcaggtgcaggtgtttcggggtgagtgtgttgtgggggctgccgcagggatgccttcccagcctcttagacctccctcctccctgcccaccccagtcctttgcccgtatcaagaagtggctggagcacgcacgctcctcacccagcctcaccatcctggccgggggcaagtgtgatgactccgtgggctactttgtggagccctgcatcgtggagagcaaggaccctcaggagcccatcatgaaggaggtgactggggtgggcagcctggggtccagaggaggacaatcccaccggagcacagcacacacacagttctcctggagacattctcccatttcacagatgaggccctaaagggagaccctaaaagggaatgcctccgaccgggagagagtagagccaggttttgagctcaggctgcctaactccaaatccggggctgtgtccttgaccctggctggggtctgagcatttccagtgccctcagcaaccacgtccactgcagccatcataatggctgacactgatagacttttactgtggggccagctgtggctgagcacttggctgagatgacgtgggtgttactgttcccattttacagatgagaaactgaggtcaaggcacttgcccaagttggtagtgcagggctggagtgtgcctgagaagatcttccccccagccccttggtggcagagggaaccatgaacccttctggagggaatggtatctctgggcaactctcatgccagctgctgctggaagcctctgggacctggacccttagttctccgggtgtgggtttggcagggagagccagaaaatgtttgcatcttttgccggcttgtggtgggatggacaggacagggagctgggcacgttgctgtcctggagggaacccaggaggaggcgacacctgacccttcttgcagacactgaagtgtaaactgaggcccagggactggggagagggtgagccagagcaggggcactgggagggctcagggccctggtccctggtcccgtggagggtctgacgccggggcctctctcctaggagatcttcgggcctgtactgtctgtgtacgtctacccggatgacaagtacaaggagacgctgcagctggttgacagcaccaccagctatggcctcacgggggcagtgttctcccaggataagtgagtggccaggccgcagccctggtgctgtgctccgggtgtcctgtccgtgtccccatccccacctcctggacgtggttcccagtaataatgctgcccctaccttctctctgtcccctcccctcagcccagacaggcagccagggctcgccacatgggcccacagcagcaggctctttgttgccggtactggtggtgccggtgccagggtgccactggggaccagtggatctgaacctctaggggcagggctaggaattggtgtcttcgactggctctgcgggatctggtgttgccccactgagtgaggtgattgtcccatgctacaaagcagggcaggccaggggctgcagaggcaggattcgaacctgggtcacatgaggctaaacttgaggcttcgcctcttctttcctccgtggcactggttgcccccatgtctgcctctatgagaaagtggaggtgagcttggagagggaggaagggtgtgggcctgggagctggagtttccgctgctcctgagggacaggaacattggaccaggacaggccactcccttcaacttcgcagtagccctgtaacgaggcgtgccaagcccctccccagaggaggaagctgggctcagagactgggtaacctgaccgaaggcccacagccaacagctggcagcatccctcatccctgactcggcctcctgttgaacctggaaagccagtgtgggctggagcaggggtgttgaggctggagctggggctggaggggagatgagctggttgctctgtcaccactgctctgctttgtagggacgtcgtgcaggaggccacaaaggtgctgaggaatgctgccggcaacttctacatcaacgacaagtccactggctcgatagtgggccagcagccctttgggggggcccgagcctctggtgagtgggtcccccttcccacaggggagctgagttcctggtgggagaccctagatgttacgtctcgaggggcttcagagtaataggaaggataccatttactgagcacttattgtgggccaagcaagtgcactagctcagggtcctttcagcaaactcgtgagcaaagggactattcttcccattttacagaggaggaaactgaggctcaaggccacatgaccctggtgggattgtaattttggctccagcagccgcactttctgcaccatagccagtgtcccttaagtccaacaacctctacttcacaatggggaactgaggctcaggaggagcaatggcttgccaaaggtgactgctcctgagtggcagagccagggctgaacccaggcgtgctggggtttcccacaccgaccagttctccagctcttgatggatgctggctgggtgtcctacagtttaacttgatgctcactgcctggggttagtgcagaccccacaggttaagaactcagtcccgtaagactgaccccccaacttcagatgccaatcacaagtactgggaccccaggttacccacaccttgtctgactttgcgacgcattagaagctcccatgatgccctcttgagttttgatacgttgttagaacagctcacggaaccgaggggaagcgtgcttactattacccatgtattgcagagggtattttaaaggatacagatgaacagccagatgcgcagacacatagggcaaagactggaagggtccccggcaggggcaccgccgtccccctggagttcgggctgtgccacccccttggcatgtggacgtgttcaccaatctggaagctctcccgaccctgtccttttaggtttttatggaggctgcattacacaggcacgattgattcaatcattggccattggggtcgactcaacctccagcccctctgccctccctggggctgaaggttccaagcctctaatcacagggttggttcctttgccaatcagtgccatcctgcaagagccctcattagcataaactcatgtgtgattagaaggggcttgttatgaataacggaagacactcctttcacccccatcactctggaaattccaagagctttaggaattctggctaggaaccaggggtgaaggctagatatgtacctcttatggcaccccaggaccatgccaagtccctgcctctcagtctagtgttctctccacgccacaccctgcctcttagacatcctcgcatcccagcaaggatgcaaggctgggtgcgactggagagaacaatggaggctccccacagactggagactggaggcagggtctcctgtccatccctctggctcttctgcatgccccaagcttggcagcaggctcgctgctggccgctacactgctggtccgttgattccatcatctcctcccttccccttctgcccaggctgttgcatcttttcagagaaaaacagaagtgtcttttccgcaggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctttgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 36470 - DNA, 3137 bp, Homo sapiens
cagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggtgagtcggcctgcggactcttccggcccgaacttctcttacctaccccgcgctccccggtgcagccgggctgtggaaggcttgcaggggaggaagctaaaaagtttgcacagggcaactcccgcccttgctccctcgggactctccgtggagctcccacggactgaaagagcgtgccccccaacccgaacgagccccgccggggcctttgcaaagggcagcagtggccgtcgctgcccgtgcggctcccgtggctggcagcctgtggcaggggcactctcgggacttctcacgggacgcccggtccttgggcgtgcaggggtcatggggggtgacggggccgcgggagcgccgggttttcgtagagcccaggtgcgcggtggtgcttgcattcgagagggaggggcgtggtaccggacgaggggggcggcgatggccccgagggcaccggggctgacgggacccctcgcccttgcccgcgtgtaggatggataaggtgggggatgccctggaggaagtgctcagcaaagccctgagtcagcgcacgatcactgtcggggtgtacgaagcggccaagctgctcaacgtgtaagtggggcccttgcgcgtcccccatggcaccccttcccgccccagcccgggaggtcgccttggctgggcgcccctcgcccggccgcgccacttcctgtcgcttttctgcctgtctcggaagggagggggcgagcgggccgggcggcgacccccagggacccgggcagtggttgagggcgcccgcgcttctgcgctcactggccccgcccgctgcccccagcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacggtaagggactgggggactgcagcctgcagggtagagccccggaaggacgggagtcagggctgggttgcctgattgtggatctgtggtaggtgggggtcaggagggtggctgcctttgtccgactagagtgtggctggactttcagccgagatgtgctagtttcatcaccaggattttctgtggtacagaacatgtctaagcatgctggggactgccagcagcggaagagatccctgtgagtcagcagtcagcccagctactccctacctacatctgcactgcctcccgtgactaattcctttagcagggcagattagataaagccaaatgaattcctggctcacccctcattaaggagtcagcttcattctctgccagtcagagctaaaaatagaaattgtgtaggagacaaaccttgttaattccctagaaatacattaagaggatagagtggaattttttttctctgcaatcttgcatttttttaatggctctttttttttttcctgataaaaacctttggtaggtagggaagttatgttttcaggggtaaatgtgctacttttgtcttctaaattttgctcttttttgactggtctagtcaagtgacagcccgattattttgctactccttaaaagtactattctgtctcttggagtatggttgatggcaattccagttaactgctgtgcagctctcatctcattgtgcacacagcatggaaatctttctcaaaactgtttcactcaggtcagggtaacaagtttggtagagcaaaccggtgaatgatactctcatgcaaaactgaacagatatgcaaacatatgtatgtggttcagcttgggttgcatgggttcagactttgcaatgtgtagtttaataggtaattacccttaacgcttttgcagggaacccaactaccttgaagaaactttaatttttttgtgcttctaatttgtctccatgtcacatagccaaaatatagaatgttcaagtgttttctcctcaaaagtataattactagaatatactggtttttaaaataagtttatttttataaatttgtttccagaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatcatt

SEQ ID NO: 36471 - DNA, 5169 bp, Homo sapiens
gaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggtaagtttccagtccgttattcagggctgggacttcttaatttacttgggaatgtagcagtttgggaaggacacccccaggctgggagagacgtccctgactcttggaaatccttttaatttaataagtgatctcttagcacttgaggtggggatatgggaaggggtggggcccggcaaagttttggggtcccagcagagccctccactggaaaacttcctgcagtttttccctcagcggtgtccactgtcctctggggtccctgagatcagggcattgcatgagaacaccccaaatctgggagacctctaggtcccctgttcctgggcaccaaagagtcctgggaggctaactccttcttgggcctctcttccccccagcgcgaatcctatccatttcctccagaagatgtccaacagtcaccagtctggcagcagggtggggtgaggacctcgtggacatagccaggggctggggtttccctggtgcttagagatgggggggggtggggatgagtcaccagatgactcaccaggtccccctcctcccctcaacccaggagaggagtggtgtgagtcaagaatgcctgttgctgggggcagctcctcaatcctgatgtcggggtgcagggtggggtctcaacttgaattttcactatctggcctgtatgtaacccagagtcagggttctggggagagaggagccacattgctagtcctcctcattcaaggaacccaagagtccatctttggccctctccacccctccagccaatggggatctcaggaatccaggccccagcggtctcctccctgagagacccaggagtctgcacccatgcccttcctccatcaggagacatctcacctgcctttatgccaaatttttttttttttttgagacggagtctttctctgtcacccaggctggagtgcaatggcatgatcttggctcattgcaacctttgcctcctggattccagtgattctcctgcctcagcctcccgagtagctgggattacaggtgtgcaccaccacacccagctaattttgtatttttagtagagatggggtttcaccatgttggccaggctggtctcgatctcctgacctcaggtgatcctcccgcctcggcctcccaaagtgctggggttataggcgtgagtgtgcctggcctgtgccaacctcttgagactccgtcccctgctccccctccccaggcttccactgcagccatgtcactcctcttgctggtggtctcagcccttcacatcctcattcttatactgcttttcgtggccactttggacaaggtaagcctacttggagctcagggcccttctgttcccctttggaatcttgccacgcccctcctctaaaggcattctggccccaccccctttacctagtatttcttttttattttatttcatttattttgagacaagggtctcactctgtcccccaggctggagtgcagtggtgcgatctcggctcactgcaacctcggcctcccgggttcaagcgattctcctgtctcagccccccaagtagctgggattagaggcacctgccaccaagcccggctaatttttttattttggtagagacggggtttcaccatgttgcccaggctggtctcgaacccctggcctcaagtgatccacctgcctcggcctcccacagtgctgggattacaggcatgaaccaccaggttaacccttttagctctacctccgatgcctcctccctgtcctgaccctaccccctctcatattaaatcctaactctccccagttctgccccatcccagataccctgcccttttcccagcccttcccacagtctgcctgaccctatcccctctcctttcctaaccctgccccttgtttcgttctctgtccatcccagtcctggtggactctccctgggaaagagtccctgaatctctggtacgactgcacgtggaacaacgacaccaaaacatgggcctgcagtaatgtcagcgagaatggtgaggggtgagggcggcgggactggtcttcaaaggggaaggtaaacccttcgtgtcctcatgggactgagaattgggaaccctcccccaacaaagttggagtgggcggggtccaggcctgagtggctgagtgcctagggctaatgcatgtcccgcctgtctggatgtacctacctcttgttttttttgtttttgttttttgagaccgagttttcctctggttgcccaggctggagtgcagtggcgcaatcttggctcactgcaacctctccctccggggtccgagcaattctcctgcctcagcctcccgagtagctgggactgcaggtgtgtgccaccacgcctggctaattttgcatttttagtagagacaggtttcaccatgttggccaggctggtcttgaacttctgacttcagctaatccacctgcttcagcctcccaaagtgctgagattacaggcgtgagccaccacatccagccagtacctcctgttctgaagaggccatatagataaaagcatgctataggtttaaagaatagagaggggaggccaaggcgggtagatcacgaggccaggagttcgagaccagcctggccaagatgatgaaaccccgtctctactaaaaatacaaaaaaattagccgggcatggtggcgtgcgcctgtagtcccagctacttgggaggctgaggcagaagaatcgcttgaacccaggaggtggaggttgcagtgagctgagattgcactactgcactccagcctgggcaacagagcaagattctgtctcaaaaaaaaaaaaaaaaaaaaagaatagagaaaaatctcccaagattctgagaagacaagagtatttttccaaagctctaaggagatggggctggtgctctgaatggatgcctgggaccatttcatccaaattccaaggggatggggctgaaaccacttaaggttctaaaggggtggggccaggtgcattggagttctaaaggaatagagctgcatctatctaaagttctgtgtgaaagatttaatgcaaaactaagattaaaggaagtggtctgctctcaccacttctattcaaccttttactggagtagccaatgcaagaaggcaagaaaaagaaataaagggcatgggaaataaattaggaaaaagtgtctctattcccagtaaacatgttgtttatgtagaaaatccattaaaattctgcaaagcagacagacacagtggctcacacctgtaatcccagcaccttgggaggctgaggaggaaggatcacttaagcccaggagttcaagaccagcctggacaacatagggaaaccctgtctctacaaaaatttaaaaattacccaggttgtggtggcttgtgcctgtggtcccagctactcaggaggcaggggtgagagaatttcttgagccctgaaggacgaggctgcagtgagccatgattataccactgcactccagcttgggcaacagagcaagacctggtttcagaaaaaaaagaaaaaggaaattggcaaagcaactactagaactgagaagggaatatagcaaggtaacagggctcaaggtcaaaataagtgatacatctaagtatctaggcttgtatgggcctaaacgggagcagggatggggcagagaagggtcacatggtgagcaagcaggtgaagctggaactctggacccacggtgatgtccccctctgtgtcctccttactgcaggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagtgagcactgcccctccccaaccctaatcccccaagaattgagcagaagggagtggggtgtgtcaagatgctgggggccctgagaatgggcctctcgtagaaaaaaacaactttcaacaccccacgagccacaagaggtgcctccgtgggctacatctctgcccccagggattgctgggacttgtagttttcagtggctaatgatagttatggcttgtgcgtatgagtcatcagggaactcagagtttcagggagccggggctggggaaggaggtataggtaaatagttttggtcccagggatcggccgtgacgtggggggataaactaattagtacctcagtagagagctctaaatcataataataatggtatttatatcagccaaccgctgtttcttgcgtgcctattgtgcatcagatacttcaagaagttttgcgtactttttaattttttgacttaaggtgcaaagggctaacttaatcacagtcagtttggggaacattataggttcttgcaaagcttctctcttggtttatgaatttactactgcatgtttggcttatagaaacacactcaaaaatattccttggatggatagagagatattattggacctagagagattaaatcagttacctaaggccgcgctacagttgcacggcgctgggcgggggggaaagaaccacaactcccagcaggcagcggcgctgcccacgggccctccggcgcttctttgcccccatgggatattgggaaatgtagtcttgagggggcactgcatgacgtgtggttttcatcttccgcaggcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcgg

SEQ ID NO: 36472 - DNA, 13508 bp, Homo sapiens
gcgcgaggacctgcggggcggggcgggagagaaggctgccgggaccggccctagacactgagccgcggtgggatccccaccggctctgcgaggccctgcgagcgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccaggggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccgcaacccatgccctggaccagccgcccagatcatgccgccgcagctggttgggggcaccatctggacggggatggttccccaggaggagaccctcccctgcctccgaggcctgtaagtgccctctctgaacaggatgagggcgggttggggcgctagcaagggagagggaggaattcccaggccggatacacacccctccctcaggcttctcctccgttcacctcctccaggtctaactggatgccaggaatggccagactcctcttaagcccttcgtttgggctggaaagcttcctccagcaaaggggacagctggtgaaaaggaaggagaccccgagactaagttacatttggggtagctctgtgacttacccccaaagcttatggaaaaagccttcgctcccaaatccatttgaggcagagctgtcagctcctcctccagtcctcatcctggcttgatgatgaccttggcttttgggggattctcgcttgtcctagaaggataaagatttaggggtgtcagaagacacagggagccaggcacgaatcacctttgtactgtggcccttggggtagctgggtggggattaagtgcaggggctctaggccaaagctgtgagaggagaaatcgcaagcaaagaagcccgtacttccttttggccttgggtttgctgctattttggagtcaggtttcagggtgccccagctcatcagttctgcagctcagaactgcaggggctgccagttttgtaggctcccttcacagaacaggcaggcagggagctggtgccagggctcgctttgtctgcagtgtttgcaagcgctcagggggctcttaggtcctcgggagaaggcaccacagggtcattgcactgagatggtcaagtcctgtctttggggctgtgacgagggagctttgcatccagcatccagcccactgtgtatgtgagaggtagggaaatgaaggtccaggaaggagtaagacttggtcatagtcacaaggaagagaggcagctagactcaattagagagaacacgtgagccagacaagctgtcaggcagctgccaggtctggtgagggtcacagggcaggcaggaacgccttggctcagcccctgagactggacagtactggagtgtcactgggcacagggtctaagtggcaatgaagaggggatgctgagatatggtgggcaagggctcctttaggaaaatggacactaatgccattcaccgcaagcaggctgagtccacccctctcctgcattacctggctttgccaagacaaccacaggcagagggtgtcttagttcagtctgctataacagaacaccataggctgggggacttaaacatttatctcttactgttcttataagggcattaatcccacccatgaaggctctgccttcgtgacctaatcacctccctaaggccgcaccccgcaataccatcatttgggatcagagtttcaacatatgaagtttgaggagacacaaacattgagtctgttgcagatggtggtacagggtggggtaggacctactgacagcatagctggcggcagagggctctcctaatgggttcacagtgagatttctttgaagaaaaagcttcagttgagctcagtaacatcttagcgagaaccaagtgccagggggagtgtgtgccaggtgctctgcacacctccccagcctgcctgcctgcctgccatccatccgtccgttcttttacagaatgaatgcttgttggttcagtacagtgcctggtgattgaacacagtgaacaagacagaccaagccttggccctttggcacttggtgaggaagactagtaggaacccaaacaagagaatcagattttttcggaactatgaaggcaggcaagaaggacatgagcttccctgttgtgttcactgccatgtcctcaacacttaaaactgtgcctggcctctagtagacggtctctgtaggtgtagacatggagtgaaacagaagtgaaacggtaggatagagatggtgggctgctttagctgaggggtcagagaaagcctctctaaggagatgatgcttttgagctgagccttaatttgatagaaggatctggagaaaagcagtccaggctgagggaatcagtggtgccaagaccttcaggtgagagagagttggtttttccgcaaccaaaaggaggcccatgtggctggagaacagccccaggaaaggtcagtgaggtgggtgggagccataccatggaggacctggaaggccatagccaagagcagtggaaagccattggaaggttctaggcaggagatgacacaatcccattcccattttgcaaaaatgactctggcaattgtggacagaatgagctgaggggtaagaggggaagcagggccaccacctcagatgctgttagttgtccaggccagaggtgacagaggcttggatgaggggagtttagtgaagatagagaaacatgaacagactgagaacaactctcaaaagtagaacctatggaatccattcaaaatctgtactgagcattgattgtatcgcactcctgtgtctaggccctttgcatatgcactcactcattcaacagactttgaccctgcctgctcttctgccaggccgtgtgctaagggcctgcgatcccaagataaatccctgtctccaagccaagcatttgactttgaagcagtgtaacttggtgaggaacgtcttattttatctctttaccacatcaacagaaacacttccccttccaaatgaaaacattggcatattctgaactaaaaactgaatcccaaatgcttcgacatattttgcagcaaacgctgtttaagcagaaacaccaggaaatatctctcagggacacccttgcaaagctctcggggtgtcagggcctgaccctgggaagtggggaggcctggagaagtggtggaagccatgcacagccttccctcctccccaccctcaaatccaagccaaggaggccttgcccccaagtgccgaggaagctcagaaccccagggtatgagaggggtagctagcagcagggaagccgccaggaaagacctcaagatgatctgaccgagcctcatctccaggcccctttccataagcaggggaacgccggtagtcagtcctgctctttctcagccattctcatgtggtcacatgtgttccccacacgccaatccaggaaacagtgactaagggcgtggagcatgtcacacagtggggcccaggatgaatctcaagatgaacaggtgcacctacttttgctccctcttttttttttttttctcttatgtgtggacccacataattcagttcctcaaacatttgctgagcacctacttgaggaggcagtattagggtcatggttaagagccagggccctgggttcacatcccagggtagctgtgaccttgggcatgctgcttaacctccctgtactttggtttcctcttctagaagatggaaataatgaaaatctcccttgttgtgaggattaggtgagatatacataaagcacttagatctccttgtatatagtaagagatgtattaatattaaccactcatattcatagtcggatacaatggaaagcgtgttatacccatgcccttgcaaatgtacaaacctgcacctatactcatgcatgaatatttatatcctgtgagcagaagaggacaggctgcctgagtgccagggaggtccaggtctagcctagctgggggagacttcccactctgccttcccagccccaggacccttaggagaactttcttgctgccctgtggtccccagggcaccagaaccctggatagccggctctgtggttttcctagagtgttaattgttgcccaggagcagggaatggggaatcgggagctccctccttcccaggagaaagggctgcagtggctggcctgggagccagggagagtcttcacgtcccagcagttctggtgcagaggcagctcagttggattattcgtcccggttcctaatgaaagtgaaagctgctggtacctgccagccctctcttggcacacagcgagctgaaaatgcagagactggagaacgttgccaccagagtcagcttgtcctggtgcagctcagatttggagctgagggttatcgatgcattggtctatcttattccaggatttcctaggcttcagttatctcccaactaggaaccacagctgctccttcctaacctggtccctccttgccaatctgtggcctgtgctatcagcagaacccctgtgccggacatagagctgcccaggtcagaaacccaaaccttccacagggacacagtcagatttgagttatgggagatcccacagccaggggtcagggcggatgcaggaaaccaggccaggaagctgtggctgtcatctaagcaagagacagacaatggtgacacagggaggcaagtatacccccaggcctggccacctctccagctctgctcctgacatgaggctcacccagaaggtccttggccatagggtacattggtgccagctgcgtcttcagacaggagaaaaccccagtatgtgtctcaagacagtgagatgtcaagagtcctgctctcttagccctgaattatacaaactggagatttcagccaagaaacaggcagggtctgccccacttacagctcatgtgtctgttttgccgaactaagaaagtgagggcttctctcaatttggatattcatatttctggtttatctgctagctttcctcccagaacttctgaaagcatactcggcttttgggaaacctaagatcacaataaaagtggcagacctctttatccctgtctcacaaataaatggaggcacagaatggggaagtggaggccgagggaacaaagccaactaagactgccagcccggttccctggccacagcactgagggtttgaggggtgcctccagtgagggctccccatccccgaccttggaacaccagctcatagtttctgccaggcctatttcatacgcactcttccaactttttcctgaattaaaaacaaacaaacaaacaaaaacctctgttatgaagtaatttcacacttacagaaaagttgcaagagcacaaacaatgcccgcccaaactcaccagttgcaccagttagcactttgctcatgtacacgtgcatgctcttccctctgtttgtatatgcatgcctgtgtatatgcacacatgtgtatatgtgtaattttcataagcatttgaaaatgggttcattatgcacctttactcctaaataattcagtatttatttccttagaacaaggacaaatttgcataaccacagtagggttgtcaaaatcagcaaatctaatattgatacactatacaatcctatgaccaatctcatctacaactttattcaaattttatagaggctgaggtggaaggatcacttgagtttgaaaccagcctgggcaacatagtgagaccccgtctctacaaaaagtaggaaaaaaaaaatagcgaggtgttgtggtacacgcccatagtcccagttactcggaaggctcaggcaggaggattgcttgagtccgggagttcaaggctgcagtgagttattattccaccactgcactccagcctgggtgactgagcgagaccctgtctcaaaacgaaaaaaaaaaaaaattgtcccagtagtgtcccttaacaataaaaaggggagagttgaggtccaagatgcaatcccagatcagcttttgcattaatctcgagccttcttcagtctggatcagctcttcagtctgtctttctctcttgtgacattgacatattaagcagagtacaaggctggtgttttgtaaactgtctctcaatttgggtttgtctgatggttatactcgagattagattcagatgaggcattcttggcaggaatattgcagaagtgagtgtgtgtcttcagtgcatcttatcgagaggcacatgccatctgtcccctttctggcgatgttaactttgatcagttggtgaaggtggtgtctgccaggtctctccactgtcaagttactattattccctttataatttgcagtttaagatgaaatgcactagttttagtgcttcatctgtaaaactacttttttatgtgaatttattttttaaaaaatgtctgtcactaaagagaaaatcatcatcgcttggcatggataaaaacactaactgccaaagtcattaacttttggccaaataccaaagccagctaaagtcacagggccttggcctgtattctttgttaaaaagagattaacaactgtcgggtgataaacataagatataccagcaccaaactgaactttctcctctaaataatcataaggattgaccaaaaactgaaaagcaaattgcttgctcactatatgtgattccttgttacttagggtcacctccgtataccctctaaaattgttacttacatgctttgcagttggacatattttggtttaaatcccagctccaccaacacctcagacttcatctcctaagcctcggtttccttctctgtaaaacagggataatagtagcacctgcctaagggcttgtgcaaattagattgggatagtgaatgatgtatagttggtgcttgcttaatgaatgacgtggtcagtgtcaatggcgtgtcagaccctgaaggggctctagcccaggaagccttccccctttccttgggtgcccttcctcctgaggactggttaccaaggagggtgtgtctgtgtgggcagcctttgaagtagcccaagggcggtgataattggtacccagcgagtccccagatggtgctggtgccctcacagctgccatcccaggccccaagcttggagtggcggggaactccctcaagggtaaggcttcatttctgggagtccctcctggcaaggggcttggctgggtggttaaaaataactgcctctcccacatctccatcacctgccccaagcatcaccctgtgaagccgccaaggagggttccattagaccagggaggaaactgaggcttgcagaagttcgatgactcatctcagatacccatctatgaggtggcagcattgggctcctggccacgctgtcctgatgtttcccccagtgaggtggtctgctggaggcgtcccagggcggtagtgaatacgcagcagcggatcagatcagctctcagggccccgacaccccctgagcacctactgctttgcccttttaactggcacaaggctcagttatacaggccaagggtatcaagctagacttcctggttccattttcattgtatttttagcattgccttctgtgtatgacaaattctactgctttgggtgttatatggtgacataaatgatcttattaaaaaattggagtttaaaaagtacattggtttaaaatactaagtaaataatagtccaggtggttcttggatgtggcaggacctggagggaggcactgggcaagtgctgcccttccagagggctcagggagtcttgggcgtgaccagctggaggcacgtggtagaccaggcatcttcacaaagcccgctgctgatcagctttggcagccaacgtgcaaatccgaagccaggtttgagaaagtggtcatcatttctctgtgacgttggctttcctcagggacatggacctgtgcagagacaggcagcttctcctttgccgtctgtctccttccggccaccaggagacagccagaccccagccatgccttcattctgagataaggtagagaccctcctgccacatagcctgtcaccagcgtggaggatcagaatggctgcgtgagtaggggagggtgacgtctgtctttagccactttaattgattttttggtacatggagaaaggaatgagcaatgggtttctagaaggcaaggtctttgaaggaggaaaagtgctgctgctttcagaaggcccctagccttgagaaggttccctgccggtattggtttctacctgggaacaggtggggctaaggagggaaggaaccaccctgtactgatgtctcgtgtgtgctgggtattgtcaggcactccatggacacaaacagcccaatgtggtgggcactgtccccttttccagatgaggaaactggcccagagagggtgggtgacttgtctgaggtcacacagccaggaaggggcagaaccacaatcagcacagacaggctaaatgcagatctcacagcatttgccctgaggagcaggacagcgggcagctgaactctaggaaagaattcccttctaccactttcagagcctcacccaccagtgcgcgtaaaacgccagggccatcttcttacttaagccacatcctgaaccaggcagcttctctgcagagttactgagctaagacattgcttcacgaaggggatctagcacccaactgtcattctgactacagaaaccagccagccagccacgtcctctgtccagctctggggaatggctggaatgaaaggttacagtttcagaaagggggaaaaaaatctagtggctgataacttgtctgctgtgctctgatgatgtcagaaggttggagaacctgctgccctgggttctataagctccagctctggggtgcttttcagcctggggctcttgatgccttagaagaaacttgttcaatccgtggtgcggcctgtaggctgcatacagctcaggacggctttgactgtggcccaacacagattcataaactttcttaaaacgttatgagattttagcctggccaacatggtgaaaccccatctctactaaaaaatacatcaattagccaggcatggtgacatgcgcctgtagtcccagctactcaggaggctgaggcatgagaattgcttgaacctggaactgcagtgagccaagatcatgccactgccctccagcctgggtgacaaagcaagaccctgtctcaaaaaaaaaaaaaaaaaaagaattttttttttggtttgtgtttttttgtgtgtgtgtgtgtgattttgttttattttttagctcatgagctatcattagtatattttatatgtggccccagacagttcttccactgtggcccagggaagccaaaagattggatacccccatctcagagaaaagggacgaacctgcagtgccgagtggtttcggctttggggtcaggccacgggggttcaaatcctggctctgccatttatgagctgtgtggccttgcacggcttgcttaacctctctgagctccatgtgaaatgcagggatgatggtcctacttggccctacctcctagagttgtttttgagggataagtgagttaagacatgagttcgagtagtacaaggtgaacacaaagtaaatgcttcataacacaagtgttgtcacgattttcatttagcgtttgccaaggctgccattgcaagacacaggagcgaaggggttgatctctaatagccaaagtgtgtgacaaatgagaattgaactgtgtcccagaacatcctcccgccctacacatagaaacctggggtcacctccctgtcctcgactcactgtgtgacttcaggcagaggtcaccaccctctctgggccctttcattctctgctatggactgagtgggaccagcttggatcaaaatcctcaaacctcatacaacactgtcagcagcttttcctgtatctgcctgttacctgaactattaacagttttctttaaattggctccttttaaagtaaaatgttttgaaaagagaaacttttgtgtttttttgagacagagtctcactctgtcacctaggctatagtgcagtggcgtgatctcggctcactgcaacctctgcctccctagctcaagcgattcttctgcctcagcctcccgagtagctgggacctcaggcacctgccaccatgcccagcgaattttgtatttttgtttgtttgtttttagtagagacgcggtttcgccatgttggccaggctagtcttgacctcatttcgccatgttggccaggctggtctcaaactcctgatctcaactgatccacccaccttagcctcccaaagtgttgggattacaggtgtgagcgacttggaaaagaaaaactatattactaccagaaatggaaacttggcatcacttgctataaatagaaggtaaccctacagataaacacaatgaaaaccggagtgttagtaaattccacgtgtagcccattcagactggagatctgcacacaagagggcagctacagccagactagcgcctggctgggactgtcggggatgcggtttgtggtcacaggactgggagaggagtgaggtcctcaccgagtgattccatcttctcttttttttgagacagggtctctgtcacccaggctgggtgcaggggcacagtcatagttcactgcagccttgaactgctgggctcacgcaatcctcctgcctcagccttccaagtagctgagactacactatgcctggctaatttttaaattttttatagagacagtctcactgtgttgcccaggctggtctcaaactcctggcctcaagtgatcctcccaccccagcctcccaaagtgctgggattacaagcatgaaccactctatccagctgattccatgttctctaacaccctatccacacaaatctgagatgggctcaaggatgaccacaggccttggagatctctgcagtgagcatctgtgcggctgaatctgagtaaaggattctgcttcaggctgctggccagcaggtgtctcaggagcaggctggtggagggcagctatggagagacattagctctgcctgcacttacagcctgaggaccaagcaggctctggaggcagagaaaggcctcagcaaagaagggcaggtcgacctgcaaggaagagtgagtggagggaatggggcggggcacccacagcctctgctaaggtctcatggcacttagcagggtcctcagcgtctgctaagagctcaggaaatggtacctgctctcattcagaccgtttccatcgttattaccaagccagtgccagctttgcctctcatagctgtgcatctttaggcaggttacttggcttctctgaacctcaatttcttatcctattaaatgataagaacctcagtttcttatcctatacgatgcatgggtctcaatggaaacagttccgcccccttaggtcgaccttggaaatagggtaggagggcatttttagttgttccagtggccaggggtgctactggcatttagtggcctggagccagagatgctgctaaatgctcagtgcccagaacagccaccccacctccaagaattgtcctaccccaaatgtcaatagcaccctgtcaaacaacaatacatgtcacatgtttaacatacaagttctgcgagatgttcagtgaagtttgcggaaaggatagtgagctgggagatgaggcttggaatcagagcagggcttgagggggctgcagaggggttgggcatgggaacacgaggtgctacagagacactggcacccggctaggcacacagagaaggcagtgggaaacggggacgtgccagggggccaggccatggagatgatgctgcatcctgggagaaagagccaagtggggctgctgagtaacttggctgtggctattgccttcctgtaggttgcaaagcatttttccgggcaaggtggaaggtgttgccaagccctgcccactacccagcgctggctcagctggcccagagctgcaagtcagccctcagaccctgggtgactcctgagcaggctgcaccagcatccccctcctccctcccaataaacaggacagtccttcctctcccgtgtgacattgcactggttctccagcccagggtctctgagaaattaggcaaattcattaaaaagagttttatatttgcagaaagacattttcagcctgagtctggggctcccagtggttccctaaatttgagggatggaggaagacttccctgccccaccccaagcctcccgagcctggtggattggtccctgtccccagccaacctggtggcagggtggggcttccgtgctaataacccccctttttccttcttgttagacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactcc

SEQ ID NO: 36473 - DNA, 171452 bp, Homo sapiens
gattcctgcagggagggaggagagaagggcggcagtgggagggggaggtacctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccaggtaagggcgttttgctccactcccagacgggagggaagtggcaccgttgtgtggctgcagctggctgttgcagctgctcctcctcttccccgggtcgatttccttgtgcaactcactcctgtttcccaatgggaacgggcactttttgggggtggtgggggtggaggggtagggcttaactcctggggcttggaccgagcttgtacgtgaagaatactccaggattggacgtttaggtcttgtctgtatccttagacccccacaccctaggctcccggtaatacctgagaaccccaaccagaggggcgtgtgtgtctctctgtctgtgtgtattgaggcatttaaaaatgccacaaaaaattatggatcatcgactcaaaaattatgctcgttgaaaagaaaaaaaaagttttgtatttttttgtctccttgtggcctattatatattaaaagaatatcaatgttagtcttatatatcaatgtaaaatatccttttgtgtaatccagtcaggatgtgagaaattcacttggggtgtttattaattatgagcttgcgggaaaactcgtctcttgggggcacacttctaaaactgcaactagtattcactcattttaaccgagaaatcccttcagctgccagctttatatctggagaggttaggatggctgctgagaatcttcagatctgtttcctgtggctgcttgaggggcgagctggtagttgtgttttcagggatcttttttagagaagggagttttaacagggaaacgcggtggaaggcgtggcatataaactcttaattatagggacgtgaagttttcaacatgtgggaccaaaacaaatccttgctttcagtaagaactgcggagagcaatagaaaaagaacttgatttcaaagtccaagtttggtattttgagaaagcaattgcgggaggaaaaagatacttttaagaagtgaaagaatagaattctgatttttgtttatttcctatttcaaaccctgtctttttcctatgtggagattttgtgtgcccaggtcactaactgggtgtgattgactttctcgagggggcggggaaattgactccatacaccgattcaggaccctctcatcagtgctttaaggctctcttttggagcaggaaggaaaaaaaaaaaaaaaaaaaaaaagtaagcgctgagactcctgagtcaagtttcccctttccttcaccgaagttcctcctcagcagtgaggatcctactgttgccaggtctggaggaaatgggagtggacttcattgtgagtcaaaatccgtatcccaggcccctgaagggaaaaggcatttccaggagatggagaaagaaagaagccacaacagtaggtctagtaaacccaagtcaggaaaagggatagaggactatagatggggttctctatctttctagccaaatgatcattaggtttcagaactagaaagaagtgtttggttgtgctgttgtttatgacatacctgggtctgtattgttgttagttcctgaaaaaattaaatagagtggataaaatagcaggctttttgagaaaggaaaattcgctttattggaaagacaacattttaattttggtttgtattttggcttaagacacagaaattgcaaatggctctgcaataatggtgaacaagtcttttctatttatgttctatggggagtacataaaacatactgtattttccagtgtactttttcagtaggatagagctgtggagtggagttcctgtgggctaatgtgaactcacggtagtgttccttggctgatagtgttccaactgcatttgtaataccaaaagatggggctgcaaaagccagacggttcagtaaagaagagtatctttaggatgttatccttatgtgccaaattcagatttacactttctttccaagaaactagtcctagtttagggacttgaatataccaaaactctaaatttgattcacagtttgaataatagcagtaattttacatacttaatttaaaccaatatttctctttctcagtccatgtttatgaggcagatatggtgtaggaaaacacggaatacttaaaagatgtttgagttattgagaaaggtaggatcagtttttggttaaattcctgtgaccaacaactgtcatatttccaagagcaactttaaaaattaaggtcggccaggcttggtggctcacacctgtaatccaagcactttaggaggctgaggcacgcagatcacctgaggtcaggagttggagaccagcctggctaacatggtgaaaccccatttctactaaaaatacaaaaaaattgccgggtgtggtggtgggcacctgtaatctcagctacttgggaggctgaggcaggagaatcgcttgaacccaggaggcggaggttgcagtgagctgagatctcgttattgcactccagcctgggcgactagagcaaaactccatctcaaaaataaataaataaaataaaaattaaggtcatctggccttaatggataaatgttgatttgaaatccaggacacactgaagttccagatcaatagtgcctaatttcaagggcatcactgacatttttttgggaacaagttcaccgagggacagttaattaactgtttatgtagtctttttgtagctccctgttccaccgtgagataaatcagaacaaggtcatttttcccctcagttactgactagctgacttcttttaaaacctttcctattcataaaatatttgtataagtaaatttagattatgttgataatttgttacattaaaattaacttttcgtttatatcccaaaccagcataattttcaaactgttaactgaaagaagacctcattcagcactctgtcttttcttttttctttttttttttgagacagggtctcgctctgccgccctggatggagtgcagtggtgcagtctcggctcactgtagcctctgcctcccaggttcaaatgatcctcccacctcagccttccctgggactacagtcatgcaccaacatgcccggttaatttttgtatttttagtagaggcgggttctcaccatgttgctcaggctggtcttgaactcctgggctcaagcagtcgacccaccttgacctcccaaagtgctaggattacatgagtgagccctgggtgcccagcctgtcttttcaaagatgttattacgtgtctctggcctagtttgaattaccttttcaaaacgatgaaggagtgaattaatgaatgcatattcattcatgtttgggtctgtgtcttgattctttattaaagaaacgtcgcttcaaggcgaaaacataggcaagaaatgttgcgtaatgacgtttttattttcagagatttccttagaaagtcatattagctccaaaattaagaaaaaaaaaaatcacagttgagcagccagttgtgaaatctttcagggagccataatcataactatcatgattattttgttatttttaaccgtggccaaacagatggatttaaatatgcgagtcaaagctgttagggttactgtctcattttgatgcagggtattctttgcttttttgtttgtttgtttgtttttgagacagagtcgctctctgttgcccgggctggagtgcagtggcgtgatcttgcctcgctgcaacctccacttcccgggttcaaatgattctcatgcctcagggtcccagttagctaggattacaggtgtataccacaacgcctggctaatttttgtatttttagtagagacggggtttcaccatgttagccaggctggtctcgaactcctgacctcaggtgatctgtctgcctcagcctcccaaagtgctgggattataggagtgagccaccacgcctggttatgcagggtattctttgtgaataaagggaacaaaatgtcttctggccagcattttctgttcaaccaaaggtggataacttcacaattaaatcagttatcaaactgtccaaaaactgctctgggctcttgtaattcagtgcatcagtagtgtgttatgtcagttatttttcaaatttattgcagtgcacgtcagaaccttcttcctagtaaaaaacaaaacaaaaccctacagcttttgtcatatatgtcactgccgcaaaaattgatgctgcgttaaatggagctcataaatttaaaactaaactgaattattccaccctacaaaatacatagaatctttcttttacacccttcattttagatataataattactgatgctcaattggtgttcagtgataatgtttccagaagccaagtggtgagcattttttttccacttcaaaaaaaaacctaacataccagacaactggattttagataaaagaaatatgggttcttctaggagttttaagtttacgcactttttaggcagtttgggggaggaggagagagaacctgaggtaaatacgtaccagtctaaacccactggagagtgtctatttctgaaaggtgggtttggactctgagtggtccaagtggatgtgttgtcacagtttgtgagtgctctttggttatgcttctccctggaacttgatgggactcacattttgactggcccacacacacatccttgtttttgttggcaagtgtaatgagttcagaatagaaagatcatgtagtggttttatgtacaggggtgcacctaacaatgtccatgcctgaaggaattgtataaactcaaattgcactgagtatccgtcattctggccaagggtcatgtcttaaatatggatcatgtaggaggaagatcaagtaccaccatcacgtttggggctggccctagattttatggacaccctctggactccacaataggcctggatattttcacctctcctttaatttagggaaattattcatttgacatgaaaagacaagttcagaagagtaggtatgctcattcttagtgtgtctttgttaagaggtgaaactccatttcacctggtgaaagaggtactaaggcttttttcagtggcaagtctattcctaaagaagtggccaggctggacgcgatggctcatgcctgtaatcccagcactttgggaggctgaggtggatggatcacttggggtcaggagttcgagaccagcctggccaacatggcaaaaccccgtctctactaaaaatacaaaaattggccgaatgtggtggcgcatgcctgtagtcccagctactcaggaggctgaggcaggagaattgcttgaagccgggaggcggaggttacagtgagctgagatcacgccactgcactccagcctgggcaacagagcaagactctgtctaaaataataataatagtaagttgccaaattttaatttttccttttagcaataatagctgaactcttaagaagtggccagattcttcaggccagcaaggtagttttggggaagaactaggtaggcccattgggaagagtgtggactcttttatggtatgcagtaatactgtaccatatcactaaatgtacctgtgttttcttgtatttccgtgcctaggatcaagctcactgatgtccttttgctggcactttgttatccttctcttcatccatagtactctacacaaatattatcttactaccacagaattgcaaaagtttttcatgaggaaagtttattgtatttactttatttagaaaaaatgaaaacaaggttgaaactctgtggtctacttttttcatctagtgacttgacagggcggctgctattgcataaagaatgcctttgcaaccgttatctttttctaaagatgctgcctcttataacaacacagtatagaattttcttttgtttgcattggaatttgaatacatctactttttcttgtgaatgatggaagagtcgaatgaacctgtgggttctcgaaattaactctgggaagtgagagggtggaagggaaacagtgacgactcacaggagacacactggttgaacctgtgatcttgccagggccatttgtgtgaagtcacctgaatctcggtgtttttcctctggatcagctgcctggatggttttgtcaaactttcagatccttccatcctccacccccatcaatgtgtgactttgcataactgagaaagctactaaacacagaattaagtttcttttattgtttttctctactaagggaatttgattctctaggatgacttgcacttcatgtgggaaagacacagctggatgcccaactgatatccattcccccctccttttctgtaactgaacccattttgtttaattcaccactatgtccagttaagtgctagatttcccagaatcccttgcagctgggaggtggttcagtgacagtagtcctggctgatgagatgtaaatagctggatgccccgttccccaaagctcttaaaaggggaagcctctgtgagcttgcctgttaagccttttgctctttgtacttcttccctggagaaagtaagcaggccatcgcgtgaccaaagacaagatgcttgagggttaaggatgagtgggtggaaggttagaaggaggctgagaagctgatagcattctgcaactgctctactggacccatttcttgactctgtgagaaaaataaaatctctacttggttaaaccacagaacttgggtcagttacttgcagccaaatgtgatcttaactgagtctagatgtctaaaaatcatagttcatcttttctttaaaaataaaaacgtgttattttgtacgagaaaaacaggactttggagccatgcagatcctcaacttgaatcctggctttgctatttattacagtctaatattggcaagtaacttaacctctctgggtctcagctttctcatctataaaatggtagctctgatatatgtgccatagcattttttgaaggattagaaataattagaaattattattatttttttttgagacagtctcgtgctgtcacccaggctggagtgcagtgttgcaatctcggctcactgcaacctccacctcctgggttcaagcgattctccagcctcagcctcccagggagctgggattgcaggtccccaccagcatgagcagctaatttttttttttttttgtatttttagtagagacagggtttcaccatcgtggccaggctggtctcaaactcctgatctcagatgatctgctggcctcagcctcccaaagtgctgggattacaggcatgagccaccacgtccggccagaaattattaataggaataataatggcatattcagcacatggaagatcttcaacaaatggtggcactgttaccaaagggaagtgtagtggggagtctgaaagggggaggcaaagaattcagctctttctcctagaaggttctcggtaggtttatagctacaatcccttgactccatctacttggcatttattccgcctcctgtctcttatcctcattcccacctgcccacaccagactacttggaactcttctgttttccagctttggtttataaggatgtccttataaaaattttattaactatagcatagggatgaagggcggggactccagagtcagacagatgtggattagaatcccctgttgttactagctgtgtgattttggttaagtcttctgtgaaatgggaataattgggtggttatgaagattacatctgataatgtatgtgaagcactaacagctggtttcttggcacacgacatgcactgctttgatgacagatattgttgttactatttcattaagcacgtgttaagcaattcccagccttggtacaagatcctcttggagacggaaagacaaacaaaacatgatctttaccttaagagtattcacatacaggagatgggggcagaaagagatggcacaccttattcataactgtaataaaatgcagatttagaatactgtttagctgttaaaaagattgaatatactgacttgtacagatgtctattatatatattttaagaagtaaaaaaccaagcacacgtgtatggtttacatttgtcagtgcatgaaaaactgccaagtgggatggcttatgggagttgggatgaagggaactttgtatttttttttttttttacagtatattacatctatattacattactcgagaaatacaaaatatgttaaaattttaaacatctatttattggtccttttggaggttggttggggaagagcattctgtgaactagactagtcaccagagcaaaggaagagactgggtttcttgaggtttcattagaagaggtgggatttgactgggtcttaaagggtggggaggagattttgaggaggcagtggggacagatgagcatacttgggtttggagcaaaatgtagaatagagtgagattcgatttagagaaaagagagaacaatattgtttgaaaagacgtaagctatattggggcaaatcttacagggttttaaagagagtgacaagattgtaccttaaaacaggatgtttttaagaaaagaagaagtaagggaactattgttttataaaaatgactctggaaatagcagattgggtatttctagtgggtatatgggcaaggggagggagaaggacagaacaccctaaatcaagaatggcccgtatacaaaagttaattttcttttaaagatgatgtcttgctatgttgcccaggctggagagcagtggctattcacagttgtgatcattgtgcactcatgggctcaagcaatccttctgactcagcctcccgagtagctggaactacagggacatgcctccatgcctggctaagtgaaagttgaattttaatgggaaatatgagttaagatttgaacatctggagtttgaaattccatcatgacccacattatccttaattttctcattgtataaatggataaaataataatacctatcttatcaggtttttaggagaataacaataataataggtaacacttacctggtaggttatactttttatgtaccaagcactactctaagcaccttaaatatttcaacctagattaatcccatattacgatgaggaatctgaggcacaaggaggctaagtaactttcccaggatcacacagatcatgtgtgtcagactcagaatttgaactcaggcaggtgcagctccagggccagtatcttcagcctcttcatagtcctacctctggcatggttctgtacttggggtgttaaaagccagtatgaactgttagttgacattattcatatgaagatgttaagcaagaatttagaaatttaggcttggagtttaggccaaagcctggactaatggatcatctctatagggctgttatgtaaagagtgagaatggttgagctccccgaacaagagtatgtagagtaaaaagagaagcaagcatacagtcttcaggggactcctgatatttagaaatggtcaggcaaaaaagaagttaggagaggagatagagcaggatctgcagagaagtggaggatgatggtggccaagggaagaagcacaacgtaagtgaactaatcatgccatccagtgcaacagactcgttacaaagctgtatccaacagactgtccctggtcctgctgtcaggtcagttcatgaacctggaatccagaatgcaaaaaattgaggactacacgggggctgatgaactgcaggtggcctggttagttcatcctttcaaggaactgatccgagagagacatggtagatagcttgggtttgaggaaggctcaggtagagaggaggatattaaaagaagaaaaagggaggaaggaatgagtgcatggtccagggtagagagatggggctagacccaaaatcaagtggagggcagtgggttagcctcgaaatccataagaacccttcttctgatgcgatggaagagaggataggggaaatggaaaaaaaaaagatgtgatcagaagggatacgaattgagtaagttcactgcaggcggtctgcattgatttatcagtagagtaagaagcagtgaaaggaaattcacagacaagtaactcaggctcctgagaggatggctctggggattattgtcatggaggaaaaatttgaaagaatgacagaagtctctcatctgaacaatacaaactgacacatttgccagaatgtgtctcgaggcaggaagttggtttattgaagtggaaagtagtggttataaaaaaaaaaaagagaatgaaattagacaaagggaaacttgactgtctttgaaggaggaatttttagacaaccagacttgatggttcacaggccaacttcttgggggaaacctgagctctgagtggtgagagacaactggttttggagcccacagctagggtttggttaaaacagatacatcaaagcaccaggaaatactctgtagaaaggagttgtccaacagagacagcactggattaaattctcctcctgataaggtggtctctgatcttcagtttacttatttctagaaagatctttagttgaaaagacataggcttgtggcatttcagcagatttgttgtggtaatgacattaggggtatgtgagaaaaggattgaagaatgcaatgattaagaatgtggtactgaaaaccactaccccatcagtccattggtgggtcttatggtggttgctttgaaagatgtcagtaaaggcttgttcaagtgtgtacagtataaattgataggcataatattcttgagttcaatggttttcagctgggccaactatagaatccgtggagcctgttgcaaaatgaaaatgtgtgaccccttattcaaaaggcaagaaaaaagtgctgttaaaggtactaaaatatgaagcttctttcctttctcatacagtttttttctcttgacttgtcatagtattggctacttgtcattctatgtgaagaaaaattaaaaattaaaattacagcatgaattcaatttaaaaattaaaaaactaagcagtgaagtttttagcatgaatttactcttcatctttttattatacaatgttgtttttgttgttgttgttgtttgttttgttttgttttgttttttgagacaggatctcactctgtcacccaagctacagcgaggtggtgtggtcacggctcattgcagcttctactttctgggctcaggtgatcctccccctcagcttcccaagtagctggaactacagatgcgtgcctggcaatttttttttgtagagacaggatctcaccatgttgctcaggctggtcttgaaatcctggactcgagcaatcctcttgccttggcttcccaagatgctggtattgcaggcgtgagccactgcgcccagtgcaatgctggctttaaatgaaaatatagagcattgaactcatatgcagaattactgaagttgtcgacgcatatgtatattgttatgagaacagtagaaacactgcacaaaactaaactacttttatttcacttcttgacatgtgcacattctactgacacctacctacctttggcttatgatgtgtaatgaaagactgaaaggagaagcaactatgagttgccttatctttccttttccttttgtgccgtcattttcagcataagtggttggctaatatggttaagtaacatgagaaagagataaaacgctaagcctccttggtcatttgtgtttcttagaaagacatttctgtatgcaatcaagttctggttcaaatggaagtcattgcctctttgggcagtcagcacccacctgcctgcttactcagttgtattggtaacacacttaccttgcactcgcttgaagtcttgctgaactcccacgcaccaggagttcacgggaattctgagctcatggtgcattgggaaaactgtgtgaatagagaggccaggaatggtggctgtacatattacgtcgtatgttaggctgttttgcattgctatataggaaaactaggactggataatttatgaagaaaaaaggtttatttggctcacggttctgcaggctgtacgtgaagcatagtgccagcatctgcttctggcgaggcccccaggaagcttccgatcatggcagaaggcaaggggaaccagcttgtcacacggtgagatagggagcaagagagacagaagggagaggccccagactcttaaacaaccagatctcccatgaacgaattgagcaagattcaccaaggggaatggcgctaaaccattcatgagggatccgcccccacgatccagtcacctcccaccaggccccacccccaacagtgggaatctcatttcaacatgcgatttggaggggccaaacatccaaatcatatcacatcgttctcctctgctcacttgtgggctccattgtcccattggacctgacttacaaaacgcaaattcaaaattattatcattctcaagatggtgacagtagagtattaaaccaactgtgggtcttttctgagcatggggtcctgtgttactgcccaggtcacaggtccatgaagatgtctcagaagtcaaagagctcacttttgaggctaagtttcccttggtcctaacgtctcagcttcattattaaagtttgcaatgtaacaggtttgtgggtggtagcctaggggactctcttctggtcatcagcaaggtcatttttgcctttcaataattttttaatcactcttcattccccctaccagtatatctgggttcgcatcctccttctctctgatacagaccttgccgttgtctcctactggagccctgcaggtagtcccttctctctctcttttttttttgagacggagtctctcacggtcacctaggctggagtgcaatggtgtgatctcagctcactacaacctctgcctccctggttcaagtgattctcctgcctcagcctcctgagtagctgggattacagatgcctgccaccacgtccagctaattttttgtgtttttagtagagatggggtttcactatgttggccaggctggtctcaaactcctgacctcgtgatccgccggcctcggcctcccaaagtgctgggattacagacgtgagccaccgcgcccggccccccgtttccttattctgcaccttactgccagacaaattttccaagtaagtttggttccaggccaccctgcctactccaaagctttctttgacctcctgtgagccatggcttacagcagagttctcatcctgtgttcccggggtggagactgcatggagacagggttggtttggcctgcgtgttattaataaagaagtttcagccaacacttgctttgggagggtttacttactgaaattcacctattgaaattcagattttaaaaagaggtctggccactgtgggctcttgtttccttgtcctgcgctggtgccttaaagaacaagatggactgggcatggggagaaagatgcccagtccatcttgttcttgggtttactcttaaggcagagtgattctttgctgtggcaaaatcttcacttttagctatgtaaatggaaagcaggtatctggctattcttaagaatggtgtgaagcaacctgaatgttgatcttttagtctgagaaattaaattccccgttcataacggaaattgggtgtatgctttgtagcagcctttggttgctttttttaggagaaatatttcttaagtctcgcctggctattattaccactgtatcatcttgtgacctcatctgatcttgacctttctccaagcttgcctttccctgctcttctgtgcagaggactccggctccaatccctggatggctttaagtccagcaaacctttctgtttttcctatcgctcttctctttgcttaacctctcctctttcctccagacccacttaaaagcagttcatcaggaaaacttagctgacagtctcagtcagaactcactcgtgcaggaactttgcaggaagcaggtaatcaaattttggggttttaactgctcaagtaccaattcggtggtgagttaaggttgtctttgaaggttccttccagcccagtgattttgagatctggcatctacttgttatttgaaattgtactttgtgataggaactttacttgcagtatctcagttaattatgacgtagcactagcattacctccattttacagatgaggaaactgagaattttttccaacactgactctcaaaatggctcttttctggatttgtcttatttcttcaaatagattatggactagttgaagaccatgactgcctttgttgacaatgcttgctacctggtaggaactcagtaaatatgtgatgagatgattggttcattcaaccaatatgcattaggcctataccaggctccatggagatgcaaagatgccccagctagaaaatgcagtattagttatactctaagcttggcctcctacctgggcacgaaagtagtatggaatggtggatcttgggctctggagttagatggacctcatttgtcaaataggggcagtaatactgtatacttttgtagcagtagttttcaattgcagtgattttgacctgtagcagtcatttggcaatgtcaagagacattttttgtgtcacaacctgggggtgggggtgctgctggcatttggtgggtacgttccagggatgtggctaaccatcctacaatgcacaggacagccccccaccaatgaagaattatcctgcctctaagtatcagtagtgctgaggttgagaaatgctgctttaaagagttgtgaagatgaaacaagataatgactgcaaagagtttggtgtagttagctgttactccaagaaagccatcccaaagactgcaaaatcatactttgaaaggcaaacaccaaaaggcttaatttcatcagcatcagtgattcttgccagtgagaagccttatgctaaggatttcatgctgtcctgtttaggagtggtgacagactcactggagattgtttatgttacactgtgtactaccatgagctggcgtgggtttatcagagctgtaaaagccattattagtttttaggatattcctggtaaacttcctgcttgctttactagtttgttctgtggagataattttggtgtgcgggtttaaatcttctgatggaaaatgttttgactatcaaattcccaaaacctgttttgatacgtgagacatgaaacgttttggttttcacatcaagaagccctatgtttttctagccttggattttaaacaaagcagctttccccactgtttactgccttacctgcctatctgtgggagtagaagggtggagagctagctgctggatttccatctattgtttattgtggatttatatttgaaattgttacactttttttgtaattataaaggtaatatatgtatcttatagaaaatttgagtaacatagaaaaaatagagaagacacagttaaaaaaaaggcatcagtaatactttcacatgaaggtataattagctttggtgtgttggtgtgttttcttctttttctattcctatattttttccatagatgaaatattctgcgtatgtaattttgtgtcccactatttttaaaacttcacattgttttattttcatttccttacactactaaaatgtctgtaaatatttctaaggactgtaaaacattccatctgtgggtgtttcattatttaatcccattgtaaaaatataaaatatagcctattttcaatttttttttttttttagagacagggtcttcctctgtcacccaggctggagtgatgtgattatagcttactgcagcctcaaaatgctaggcccaagtgatcctcctgcctcagcctcccatgtagtaggattataggcatgtgccaccatgtctggctaatttttttttttttgtagagactctgtctcaaaatatcagtagtactgaggttgagaaacgctgccttgaagggttgtaaagatgaaacaagataatgaatgcaaagagtttggcgtagttagctggtaccccgagaaagccatcccaaagactgcaaaatcatcctttgaaaggcaaacaccaaaagtcttaatttcatcagcatcagtgattcttgccagtgaccctgtctctacaaaaaaaaaaaaaagtgatcttcagcctcacaaagtgttgggattacaggcatgggctattgcacccagcctattttcaattttgacgagcatttgtgcattcagtattttctgtatttcagatcattcctgtctatacaatagatgatcacatgtggaacaaaaggattggatatgtgtggatattttgattagtattgttgtcagctgccccaaagcttctactaatttttgctcctgttagcacagtgatgttctcatattagtagcatttgataattttctaggagaaaataaattttgtttttctttttaatgtatttgatattattgagctaaatcatgttcatatgactattggctgtttcttaacaaactgttcatgttctctgcccatttattgggaattagtatttttctcatttgtcataaactctagttcgtgtatttcacttatgaatcctctatcatagttgctgcaaatattttcacctgctgtttctaatttttaaattcggtttgtcttttatttttgttagtgatatggaggtttaaaatatttatgcaggctaatctattgattgtcttttgcacttgcggttctccaactttcctctgtctatactaaaatgaacccttactgctctggaagtctctattctgaataatcagtgtttaaaattatatcccaaagtagggtatcacagggtttcctgatgaggataaatgggcctgaagtgcttatgggcacccactatgtatcatgggaaaacttgcacgtgtgtgtgtgtgtgagagagagagaaaaaaaaaaatagagaaagttggtgagaaaaggggaggctgtttttgggccgagggttgtttgtttggctttttcatttcttttcccttgatagaagtgagcttactgaaggcagcggggcttccatagattcctgaaacatctgagtgactgaaaccagcggcttgctgagcgagctgtgactacacctggcaaggggtgtgttaggcatgtgttgagtctgtgagaaggcaggcggagcagagactcaggccacatcccatccagttctcaccccttaagttttgctctttgaggctgcaggctgttgctcagcctcacccaggttgagtcctgtgggaggactcataggagcccacagccctattgcagctcaccagctgcactaactgtagcttgaagacgaaggtaacaactagcacttacctggcacttagctgttttgcaaaaccctttcactagggcttttatagatgcttctcacctcaaccttatgagcttaaatactgtttccatctccattaatttggaggaaaccaccactcaatagatgcatcattaaaatccagagcttccgactccagggctgacctgctctacttcagaaagaattccatcattgtgttttctggtcgtagtttcttggtggtactattaggcagagggtggcaccaactgttttaggttttggagtcagacatatcttgactggaatccctacatagccctatcttggcactgtgactttgttacttacccatcctgaaccctggttttctcatctgtgaaatggaaataacaatgtgtaccttgtaggaatatggtagaccctctggatctgagggttccacatctggggattcaaccaatagcagatggaaaatatttgaaaaaacaaaataaccatacaacaataaaaatacaaataaaaaatacaatgcaacaactatttacatagcatttacgttgtattaggtcttaagtaatccagagatgatttaaagtatatgagagaatgggaagatgtgtgtaggttatatgtgaatatgtaaggaactttagcatctgcggatttgggtatgtgtgtgggtatcctggaaaccaattccccatggatactgagggacaactgtattaaaaagattaagttgagattggtgcaaaagtaattgcggtttttgccattacttgcaatgccaaaacagcaattaattttgcgcccacctagtatatgcaagatgcctagtgcagcaccactgtgctcattcattgtagaagctcagtaatgattgtttctgaatctcaaagctgaaaatgctgctgttctttttttgtttgtttaaaagttttagaattgctggtagatctgcacagacgggaaattctagtgaatatcactatatttagatgctagaaacacttctttatctgatctatttatttttctgttgagtagactttcttttctgttgtggataagtcatctgcatctctcaaatccttatgcttagagaattgcgtgatgactcctcagcttaggattgtgctcgtaggcaaaacatgttttgtctacgtgttcatgtaaaaagcacagacggctctcttgaagggcaataacccttctcttacacatagttgagatttttggcatcattcatggagttgttacttgcctaggcttcataaacattcaggtaccagagcaacattaaaaaagaagattgtagaaactcatgagaaaagacaaatctgttacataacccaggggaggcaagttgctaagtaaatttttatttttcatcccatctaaaagttaggttagatttgatgggtctttacgccagaccttgttcaaccacataaaaaaaactccctgaaattaaatcatttttgcctgaagaatttcaacatgaggttgtcttgccattgaatgtataatgtgtgtttatttaggctttttcattttaataaattgagccaagtaactactataaatactttaatttagaattataatccaatgcagtcttttttctatggagttaaaaataccctttgggaatcctctttaaatgtgtcctggaccttcttatttttttatccctgctaccatggttgcattttcaataagaaatcaacttagtattagaatatgaagttatgctaatgtaagtggggctttattgggttaagggttaacattcttacatctgttctgggaactttagatccgttgccctatggttttttcattttttccaccttttggtaggaagggagagacaatgaggagaaagtcttttttatatgatttatacaagtttataaattagagttttaatataattcacgccatgtatatgcttcacctaaaacatagatacagttaaggtcagtgattatgtgaaatttacatgatttctaagtttcctgtcatgtttagagttcaaggatcaaattgagcataccgttggctaaatcttataacgtttgcaagctgagtgcaggacgttgtgaaatgcctcacccaattgtaatagtcagtaggaaattcttttcctaaaatttcaagcctgttgcttgtctttttttcccagccccccaccccgcccctgcttttttttttttttttttaagacaaggtctcactctgttgtccaggctggagtgcagtgtcgtgatcatagctcactgcagcctcaacctccaggctcaagctatcctcccacctaagcctctcaagtagctgggattacagatgcacaccaccatgcccaactaattttttgattttttaattagacataaggtctggctgtattatccaggctggtctcaaactcctgggctcaagtgatccttctgtctcagcctcccaaagtgctgaaattataggcatgagccatcatgtcccccctgatttttaaatttgcagccaaagtggacatttggaggcagaggtgtttgtggtgataatggttaggagagaatggacaaacaaacttggtactgacttgactattaactgacaggatacaaaggactaaaaaatatgcctagtgatgggcaaagacttcatgactaaaacaccaaaagcaatggcaacaaaagccaaaattgacaaatgggatctaattaaactaaagatcttccgtacagcaaaataaactgtcgtcggagtgaacaggcagcctacagaatgggagaaaagttttgcaatctatccatctgacaaaggactaatatctagaatctacaaagaacttcaacaaatttacaagaaaaaaacaaacaaccccatcaaaaagtgcgcaaaggatgtgaacagacactaatcaaaagaagacatttatgtggtcaacaaacatatgaaaaaaagctcatcatcactgatcattagagaaatgcaaatgaaaaccacaatgagataccatctcacgcccgttagaatggcaatcattaaatagtctggaaacaacagatgctggagaggatgtagagaaataggaacgctgttggtgggagtgtaaattagttcaaccattgtggaagacagtgtggcgattcctcaaggatctagaactagaaataccatttgacccagcaatcccattactgggtatatacccaaaggattataagtaattttactataaagatacatgcacacgtgtgtttattgcagcactattcacaatagcaaagacttggaaccaacccaaatgcccatcaatgatagactagataaagaaaatgtggcacatacacaacatggaatactatgcagccataaaaaagaatgagttcatgtcctttcagggacatggatgaagctggaaaccatcattctcagcaaactaacacaggaacagaaaaccaaacaccacatgttctcactcataagtggaagttgaacaatgagaacatatgggcacagggaggggaacatcacacattggggcctgttggaggggtggggggcaaagggagggatagcattaggagaaatacctaatgtagatgacgggttgatgggtgcagcaaatcaccatggcacatgtatgcctatgtaacaatcctgcacgttctgcacgtgtatcccagaacttaagtataataagaaaaaaaataagcctagtgatcctgagataacaatccagttgggtagcctcatgctgatcccttcaaatcactttgtcaccagccctttgaaacagagccaggatagtacatatgagaacccagcaagtttcaccagggatttcttgttgctggctggttggctcagggagtaaatagagtaattagtgctcattagcactcccacgagctataatgcatctacctgaggcagagagatgcttgcctgtgttcctgaagcatagaaatctccatgtgatctcttcagtccagacatttttgcactgcagaaacaaatgccaacttggcaagagtaaaatcctccaagtgcctcaaataacagtaggcaaaacccgtggactagggacagaaggctttcctaggaacggttagtgtgtctaagaaattggtgtgctgtttaaagctttctcttctcccccaaccggccgcctctcagtgtatgcgactgaggtgaaccagattagtcagagatgttggacacggtagtcgtataacttgatcccctcagcctcttgtcagctgtacttcagaagctatagtctccattaatggagggtctggattgtagagtcattgagaaagaagagagagcaacctttgacggtgatctgcggccctgtccaggaccttgtgccattgatagttcttgttcctgtgaaatattaatctgtggtatgaaggtgggagtcacaaagggaggagggagccaagttttgggggcttggtacacatgcctggagaaacatgtagataagttgcgaattggcagattgttgtgggaaagaagcctcaactaagaatctggcactctgatccctacattgattagctgtgtgatattgggcaagtcacttaagcagttataaaattgttagaacgataccagcccagccctcactgggagggctttaaggatcaaatgagatcacatgtaaaatgctgtaaaaaattaaataatagtgtgatttttgagtttttatatggagtacattagctacattttagacatcctcacccaaacctctggtaaaagcacctgcttttccactgacttccaggcctgtgactctaattccatccctgtaccctaaactagactggagcctgtttggatgccaggtagttcccttgaagttttttggaagatagtgctgtctcctgggcaagacaatagcaggagctcctgattcctgcattggcctgtctgcaatcccctttcttgggaatgcagtaaattctacaaagtcatcattcatctatcagttacacaggaattgttccctgttcttaaaagtttggaacattggctggctgcagtggttcatgcctgtaatcccagcattttggggagactgaggtgggtggatcacttgagcccaggagttcgagaccagcctgggcaacatggtgaaaccccatctctacaaaaaatgcaaaaaactggccaggcatggttgtcccagctaccagggaggatgaggtgggaagatcacttgggctcaggaggttgaggctacagtgagccacgattgcaccactgtactccagcctgggagacagagtgagaccctgcctcaaaaaacaaaaacaaataaccagtttggaatgttatgaataaagtgttcaggactcagtttcatacttaggtggaactgttcttgccgggtagctttagaatgaagatttgctaggatttgaggttataaagtaaatatgtcttttgtgggcagccatactctgatggttaaggttgggaaccccagatgtggcctcctttgctctggtggcagttttcaatgccacatgatgttgggacaagcaaatcactacctttgctaggtctcgccgcctttacttgtgaacttgctgtattcctgtgcattaactcctgtccctgttgactgggttggtgttcagaaagtgatctgagctgaatatcaaaaatgtgtagtttttaaactgagtggctgtatgacgagtatttttcaaagacggttatcagcctttgtagggcctctgaaggagcctgtgacttcctcgtacaattagaaaaataatgctctgcattagttatcttagaaaactgctgctggtcttaaattaggttccctagaagcagactctgagaccaggagtggggtgctgaaggattttgggggtgagctctcaggagacacctgtaaggaaggaacaaggcaagattgggcagaggagaagctgactggcaaatgtggttgcgtctgagaccccagccacttctatggggagcgctggatggttcttcagagctgtccccatttgagcaaggggctggacttttgtttgcctacatcagctaattcctggcaactggccaccccttctgggggtatcactttgggtgaggctgtgtcctgcagctggctgaggaccttccttgtgaaccatcagcagctggggatgggtgtattggccctaaaaaggacgtctgggtggagcaatatagtgtctactatactgtcccaaagaatctaaccctttgagaaagaaacaagtgggtagcgccaaatgcccggcatatggcaagtccctttatatggaaagttagaaagtctggatcccttagcaaaactgagggaagagattataactgctttgtgaactattaaataaacagatctccagcctcttggaagtttatgagatccttggataatatgtacacctgattacggtgtaacagggcttagcctctatatttgtgaaatgactgacccataattgaataattttccccaagcatgaattactgcacgttcagaatattcatcctatgtgtatataaatgcagttgaatgggtcgccgtaacaaaaggcaagcaagtgagtgaggcacacaaactcagacttagaaccttccagggggccctggggatggaaggcaaatataggaggttatagctttggttcctgaatcaccttatgtgatattttagtcatagtcgaggataatgatttaggagttaaattgccaaaggataagtcaatatgctttggcgggggtagggaagaatcaattttctggcatttccgaaagccagttgcactgaacaaatgtctaaaactggcatggtttgttgtataagtgggatgagtagacaaagccaaagttatacctaatctctttcccaactgcagattaagtcatatctgtaaaaggcaacatggtttttcttctgcattttctgccttctagtaagtgaaggaggcaatgggttgtgctcctccatcatctgagtagtttgagtgtattttggggactggaggtggggaagcctgatgacttcgtcgtggcatagagcaaaggtgatcgggggtgtgtgttcagaccatggacttcgcttcccagtgagccccctggactctgtgtattctttgcctttatctgcattgccacctggaagctccgtaatgtcaagtcctggaagatattactaacctgtttccattatgggtgtagtagaaatataagtaggtcactgttcctaattcagaaactgaagagagtcaagctgccatggtgacaggttctgtataaaaacacccacctctgaacctcttggagagatgtgatgatttggtcattggatgtgaaggggataatctgccagctggtttattgcattggctagaaataggagatgcagaaactaaaaagctctcaagaagtcatcagatgagaaggaaattaatgtagcatagtgattctgctgtagaggaaaggctaaaggtgagactcttgaatatgtgcaccatttcttctgcagctcttgacttggatgatccttctcagtgtgatcccacgagtgtttggtgatgatctgatagtagaaagggcagagcgatttaactttgtgcacatcttcctctgacttctccatctttctaacatgcctgtacgtgtgcctttatcattggcattctggagttagggacatgaccttttctacagtccggatgaggaatctccaactatgacttttcattgtgactcacgtctgcaaagaatgaataaagaagaatttgttggccaggaagtgtgtactatgcagagagaaataattgttgttgggaaagaaacttttgaagaaccagaattaaaaaaaaaaaaaaaagaagaatgaaggaagtctatcaagaaaaggaagaaccagaagtgatctgcagggtgttgcctggagatatgggaaataaatcaagaacagagaaatgggaaaagataaaataaaaaacattgccggttaggaccagctggggtcctaggaaagtggcagttccagcggggcttggaaagctactgaaccactcacttatgcacacacaactgccccgccctctccccttctttggcccccattcacctggtgtaggagggtctgacaccctcaccagggagagtgctatttggctgttttgaaggcgagaccttgaagcgtgggagagcttcgcctctttcgtaagctgatgttgcgtaacctcccggagagtcaggacctagtggttaaggacacaggctttgaagccaggcagatagggtgtgacttaaatgctggacctcagaaaaatggcttattgtgaagggtttaatggagcataatgaagtaagtgctcaaaactgttgttaatatatgccaagagttataactaaatttgtaaaaagcaccttcttatactctcaggcaaactttgaacccgagctcggcttcaacagggagctggactctatcagtggccccatgggggagctgggcagtaatccaaggctccgggtggggtgtttgaagcagctgcagatcctcgtgaagggctctgggtgcccatacattgtccctatggagtttctgtacttaaagcccctgattttttttgtaagctgctccagctgggatgtctgcacactcacacatgttaacctagaatggattcaggaactattttaacatttacatggataatgggttgctttgttaagtcatatgtaaatttttatttagctcctaaccatctcctgtacacaagacactggactcacaggagtgcaaaatgcaatggtgttaggggtttgtatggatatgttattcgtgctttatgacaactcagagagaggtaggtaatattaccagttttacagagattaaataacttgcccgagatcaaacagagattataccttactacatggactctgtgccaccgcgaattgtaagacacattccaatattggagatgttaaattaacctttaaaattaacgaaatgtggtaagtcacagagcctcgattctaccccatacttggctgatttcaaagtttgtggttttttccctcatcacatgtaagggcttgcaatcctgtcttaactggtgaacataaaacaaacacaaataagaggacaattaacatttgtaagacttgaaagggtggcattaataataataataatggttggtgtttatcactcacttactctgtggcagtgctttcatgtgctttgtttgggggtgggcactaattttatatatatatatatttttttttttttaacaaacgtgaaaactgagataggtactcttattcccatcttctaaagagaaaactgaaacaaagattagttatgtgaccttgggagatcttctccaagatcacatagcttgtagtaaaagtcaatctgcaccatggtagttaagagttcaagtttacttataaccacgacagacctggtttgagttccagaagagtgtgatctgatagacaggtgctcagtgctccaggagcacctaacccagccttgtgggggtctgcaggcactcccaaagtggacggcacctaaactgagaaggcagtgtccatctctctatcgcaggccaccgtgctgctaaaaataatcatggttgccctatgttactgacctccactagtactacgaaggtctaaacctggcattagctagtaggaactggctttatttatagtttacatcctttccacttcccaagagcaacagaggaggtttaaaaggaacattgtaaattagacagttgctgagaaccagaatgatggctacataaaaggtcttggaaatccaaaaaaatagaaaaaaaattatttgatgttccattgtgtaatgtaagtctctggagatgaacagctgggtattcttcctacaacttttaggctacggcgtgtagtctccggtgccaagagagctcacacactggccagccaaagtctctgtaacaactcaatcacttggcttttcatgttcgtcttaattctttttacagaattaatgatttttattttgagttaacatattgctaaaggatgtgaagattgtgtgtcaagctggcatcttgaaataaaacagtatgtttacaaatggatagatatcctgtcattaaaaataaattttgacagactgtggttcataaggagacccatattagaagacaccgaaagagccttcagaacatcaaatcataattgctgagtagcagactgcgttccaggtccgtgtctgccccttcaagaacatctgacccctagtttcctcatctttaaaacaagggggatgggttagatattcccagatttcttgagctctaaaatttgtttgactcaaacatttctaatgaattctcacacagcgtttgttctgactaattcatcagggtgcctgcctaacagtaaatgttgaatttgtttatctccgagttctgttgtcaatgaattgaaatgggtgttatattttaaattctgattgtccactgattgcatgtcaaagagaatgtattgcgggcatttctcctgcatgtctttggaatagagaaatttattgttaatgaagagaattgaaccgctatcaggttaggggtcaagaaaccttttggctgcagtaatcccagacagtcgactccagagccaccggccagccaagttgtcttgaactgcagtcaggaacgctgacactggatcaaaaggcaactgttttggttagtttgagagaggttctgctgcaatggaactttgagggtgggactaaggagaaggcagggctgaggatgggagagaaaaattgtactcactgttatgtaccagaggtggaattctagttgtgattccaaatcgatgtttctcagggagaaaaagctcttctctttttctctggttcaagaccatctgacaactcggaacataactcatttgataactctgaacttaagttaaagaaaacattattcaatgatacttgttaaagcatggaacaaaggatcattgctacagggctttgcagtgggggagagagattgcgttcgattctgaatattgcatggacaagtgggcatttatagccaaggagcagggtgggagtcagtggatggaaaaatactaagaggaatgttggggtaagggggattctggctaaattaacctaacaggattcttgctgaagataggccagggtgatcggacacctgggggatggtggaggatgaggagactgatcagataccgagagtgggaggttcttgctaaactgacttagcagggttctttgctaaacttggattttacaaggaagtgcacgcagaggcctaggagaagatttatgagcctgactaaagtttggccagaaaaagaatctttgctacataactcatttgataactgaacttaactcattgccagatgaccccatatactgcccaggctggggatagagggtgactgaaaataaagacgaactcaagcttacgatgacatgaagagagtgaaactacaagtctgatctctccccaggccctcaacaatgccaccactgtcaccactcagtccagctgggccggggatggtgctcacccacactctggatgaatgctgttttgtgctctgctgtgttggttcttctgcagccctttctgtcttaccgataggttgcccctgccccgcaggagccaagagtgcccagtgaagctttctctgtggatgggactgatacacaccatgacatgtgttgggaaagtccctggtgctggatgagttctccttcaatagctttgaagttatgtggctgaccctgtaggagtaattggtttcttatgaatgatgacctatgaattaaataggaagcaattcttgtctacaaagtttatctccagtgataaggaaaagacccccaaggaagctcatcgatattcggggactcagcattcacaactgcagggggcaccattcataccattcatgtggccctaattcaatgctcttgtaattcttcatacttagaacatttttgggtgatcctctattagaacaggcagatggagttaagctggctgcagccaacgatcaaatggttccttaagtattcctacttttcttccctcctctttatcttccaattgagtaaatagatgctttctgaattatacgtgttacttaaaaaactgattaaagaagcagtttataagcaactcttgctaagtgccttgggtaaacctgctgtctcacagaattgagcagggcagaaaaaggcatcttttggaatgccagtgtttcatctaagtttaatttgataccaagggctgcttgacagcacccatctggttaacactgagtgcttagatgtatattacggtaaatggcttaaaactggcaacttctagacattagctcacaatcccgttaagattcctgttaagccctggggataatgcacagcctggtgtaatcaagaaaactgtagcagttacactcatcccaacatcccaattattcctaacttaaatgttgccatccgccagatttctcagcctagtgaagctgttccctccatttaaaacaattgctttctgaaaatttgtgtttctttggtaaaaagatatacactaggaggaaatgatttggaatttagaagtgctcactacagggttcttattcagtatttttatcagtgattgggagttgcggttgaaaccaggctgggagagacagctgatgacagtcagaatccagaaaataatccgtacaaacgatgacaatggtaaagtgaagttgataatgctttaaataacaaagctgtatgtcacgctgtgaatatacttgaaaaaaaatcaactgaaaactgacatgacttggtttggtaaaaactccctggaggtttgtagttcagcagaagccaaatctgtgatattgctgtgaatggaaagttcatctaaccgtgtttagcaaatttaatgcaagttagtgtccagtttctggagataatggttcctttgtgcacgttgtcggagatcctacatctggagtcttgtgcttgactccatacactttaagaggaatgttgccaaattggaatgttcccagtgttggggtgtggagatcgtgctgacaccagaggtctggaaattgtgtccccttcggagtggtttgaagaactggggctgtgatgtcctaggaagttaagggagacagggctgctattataaaacatttgcctgcttgccaagcagaagaaggaataggcttgtattttttgatccctgaggacggacctcaaatggcaacagaggctggggtggggcgtgcattcttgttcgttcatggaaggcaggcccttccagtaagcaaacgagccaagctgttgacaggaggtggcaagatttatggagatgcctcagaaaatattcgggctttcagcctagatgttggctcaggtccccttcgacaataaggttctatggttttgtaaaatagctagcacccctggttcttttcaaaaattattttcttcagagagatagaatggtggaagaaaggcactctttgctgtggcatagatcatagaaagcacaataactgcttgtttctcatgagagctgaaaatgctctggagatttctctaaatgtggcttttcttgttctttattttctgcagatcctgtcaggactatagattccttattcctttatttgatttggtgtttcactcgagcgggctaaataacagtgattattatatgcaaaaaaggttgctacagttatttttccccctgatatgaaagctaagccttgttttcctcttcttggcagaaattgtgcttttctttggaggaaatcataaatcatgattgaaagcaaaagctgttttgacccaactcttccccttttctctatggagaaacaatcacttggcgatgatatagcacgtacgagacagatgatcagaattaaattcttttatctgttaacaagctcatcttttcattgactcaaatccttttaagaaatattattttgggggaaaaagcccccattttgtgttaatttttctgatcctttgacaaatatgtttattattcttttaagcaagttgggcaccattttacataaaattatagcttaaatcagagccttatgattgaaagagactttgcataaaaaaagcaattacttatttgtccatgttaaacttagatgcagtgtttagaacttaaactgtgaagtttaagttgaattatgagtaatgaatacagaatattttggaattaacaattagcctactgaataaagctgcttcctgaatacatctattgcttttgaagtcaagtattttcttggcatcacaacaggccagttttgagtaaccttgttgtggttgatatgctagtttcaaaatctgctggagaaatcaaagctcggtgtggttttctgacttcccacatgattaactgtaagatccctgccatatagatggctaataatattttccatagccacctgggagtaacaaagagcattaacattcattactgcatgttaatgaaacacataaatattgaaaataaatattgtatgacttgaatctttagcaaggtttctattctttgccagtgataacgtttgttatcatagagtgaaaaaccagtttcaggcgtcacaccaaacaggagctatcatggtaatacccagaaaatgtgacaaaaggctaactgttgtggacttagcttgcgttgttagttatacagattttttgcagagatttgatatgaagttgggtttataggaattaggaattcatgatggagtctcatgtttattgcttcttggtccgcattgggaaagttgtcagttactgagggaacaggaaatttccattgtgctttgctgctggcagtctggatttgtgttgttttagaagttttcctgctgtaagctacttttaagccaacacacccctaatattcaagcgttcagcaggagagagcaagttagaagactgtctctcagaattactaacaagtcatctcacctgtctgctttaagcttcaaacaggttaatccttggaattgtcgggggctaataaattaatatatgtaggcctgtacttttaaggggagtgattattttacatttgctcaaacatatatgtttgaagggaaggagagagggggattaagcttcctaaaatctcaataaagaccccacccctcaaaaaaaaaaacctcaaaatcttgaaataggtcttactgatatgtctaagtggcttggattttgtttaatttcaaaatctgaaattgctttgagtctttttatttgaaaatccttcatgactggtttccatatgtgttttaggaaaaagaagggggtgtcagctttagaaatctcttcatggcttgatttattttgaaattagtgaagaacaagattttctctccttctgctggccttttttgtatcaagctaaagtttttaggagtaataccatggtaacaatttttttttttttttgagatggagtcttgctgtgttgcccagggtggagtgcagcagcgagatctcggctctctgcgagctccacctcctgggttcaagcgattctcctgtctcagcctcccgagtagctgggactacaggtgcccgccaccacgcctggctaattttgtgtatttttagtagagatggggtttcaccatgttagccaggatggtctcaatctcctgacctcgtgatccacccgccttggcacacgcctgctgggattacaggcatgagccaccacgcccggctacatcatggtaacaatattgaacttttaatctgaaaaattaaaactgtggtgtttcccaggaaccctaaaagtctatagaatgatatttaatatagatgttggcatgagtacatttacaatataaaagaactctgtcttttgaacatcagcttttatactcatggtatttttacctttaagtcagatcatgaaaagtctccaacactgttggcatagtacattttgtctatttaagtgctaaatgcctccctataggggttttatatgaaaaatgagtgatgcagatgtattggggacaaacctggaattactggaatgtgaacttccttatatttattttcaagcactcaggaaaattctctgtctcttagatctaaataaattctctagttttgtttcctgataatcctgggagcagatcacttggttgtttaagggatcctgttttatttgaagctctattcctttatttccaagagtcagttcttttcttcaacatagccttatcgtactccacaagactttgggtatatgtagaaagtgttctttctacatacgtggttcttaggacttttgtaatgcagtgaatatatttgggtggaagtggatgagaaatagtttggaatacaattattagacattttattgtttacaaatgctttattagtatgctcacatattctctttcttatacctttttcttttccctaaagaccttctgggttttttttttgttttgttttgttttgttttgttttaagattatttggtgcttgagacctgtagctatgattttgaatgaacagggctacttccagtaattagatcatataatgaagatttgaaagtgcttattttcattttatctcctgcccttcccacaatggatgcagtacagaaaatcaagactatatgtaattacacagtatgttatacacacacacacacacacacacacacacgatattctatatagatcaagaaatgtcttacttctttgtgggcattggggaaaatagtttaggtatatatactcttccttcctgcccccacctctccaccaacacacacacacacacacacacacacacaaacatacacacacgctgcctagagttaattataaattatgcgtatgtttgatcttcagcaaagtggaagcataaagaatggtgtttaaatgcactgtagggccccaattcggaagttgtgttatcgcaaagctttactagcatgcaaagcttaattaggttaaacttacctaacctaaacttgccattaacctatttttctggatataaatcatagctataacagtgattttttttctttttatttatttttatagaggaagggtcttgctttattacccaggctggagtgcagtggcgtgaccacactcacttgaagttttgggctcaggtgatcatcctgtctcagcctcccaactctaataggtgggactacagacatgtgccaccacacctgactaagttttttattttttatttttgtagaaatggggcctcactctattgcccccaggctggtctcaaactcctggcctcaagcgatcctcctgccttagccttccaaagtgctgggtttataggcattagccacaacaccaggcccttaatagtgattttttttttttagacggagtctcgctctgttgcccaggctggagtgtagtgcagtctcagctcactgcaagccccgcctcccaggttcatgccgttctcctgcctcagcctgctgagtagctgggactacaggcgcccaccaccaagcctggctaatttttgtatttttagtagagacggggtttcaccatgttggtcaggctggtctcgaactcctgacctcgtgatccatccacctcggcctcccaaagtgctgggattacaggcgtgagccaccgtgcccgacccataatagtgatttttcaacatcaatgagtatgtatgatattctcatcagtgctaaatactgatatcagctgtattcgcttaattctttatttacaaaacaactttttaactagaagattttctcttgtttcctaaggtttcaggaatgtaatggttcaaggggaaaaaacgccaacccaataacacagtaccaaaactctctgtgattttacaattggatcataaggatacctgtggtatttgaaaacctaattatagttatacctcttggcataattataagctcctctccttccagacacaaaaattaaatggtgaaatttttatgtacatacatagcaccaatgtggaataaaccctgctatttctctacatgaaaaataaatgtaattggggtaagttgacattttctagagaggacatataggctaggagatgctgaagctgtttctttctcccctcagaaacaaaacactgtaattgtgatttgaattagaatgtaccatgccagggactgaggctttctttaatgataaaatacaatctacgtaatgttcttctgtggagagaatttgtgttgacaggtaagtattacacatggacaactttactcaaatgtttttaaaatgtacacccagaagttttgtctttgtgtaaaatatattactgctttttcgtctttgaaatgccaaggttttcccctgtgttcccagatagcagtcagtaatcctgcactttaaattcaaattattggctggcttagatcctgactaaaaatttgggaggaataaaggatcatggatttgcctgaggaaagatgagttcacaaaacctcaggaatgaattaaatgcaaaatgagtctgtttctttcggtggtttggatttggggttctttgtagcaaaacctcaaggattctatcagtttggattttggaaattaaattagatgggactagtattgtctttgagagagacttgttgaggacagactgaagaggaaaagctcaggtgaacacatgatttgcatccagtacatgttgtaaattattggcatattttggctgttcctcaaagcaggactggctgcatctgtgcttagaggtaaaactaatagaggaccacattttggttcttcctgtgagctcagtactgtgtgagtgagttacttacatcaacacagccatacgagttgagtattattattacttctgttttaagatgagtagatagaggttgagagggcttgggtaatttgaaagggcacaaagtcaggatctaaatccagccctcctggtccagaggtttatccttgtgatcctgaccattctaccccacaggagctgctgttagctttatttctctgttgttgaaaactaacttaatatcctatgtactaaactttttcttttaataacacataaaactggaaaacaaaagttcagaaataatcacctcacctgaagagatgatttttgctagattttgtgtattgtggaggaatatttttcctctaacctcttaagatcctgagggcctaagaattaaaacaacaaaagacagaataacagtaaaaagtctgtgtgtaagaagcttgccaactggttaaagccagagacatgtatacctaacatagtggggtatagggagggaatagtgaggagagagaaaaggcctctgggagggaccactgggtttctttatggaaggggaaggggtttctagagataagcaagtttgttcttgcaattgtgagtggtcttttggtctttctgtcttcttcatggtcacaaaaatccctggagaggggatttatggtaggtttactcttggcctcctttctgggggtaaaagccaccttaagaggaaaattatggcagcctcattttctttaaatttctgcttctagtccagtaaaggaagctccaagaaagctgctttttgtgtcggttgaatctcaaatatctttagcttaaaataatctttataacaactatggagttctgagtgggtctctctgtaggtgttttgatcttctattttgtatcgttggataaaatgtgtcattttccttgccctcagaaccctctgatggcgtctcttttccctcaaaaggaaatcagtctttaaaatggcacagaagttatgcatggtctctcctctccagcttctctgacctctcctgatcatctcaaccttgttcagtttgctccagccacagctgcctgctttcgtttctgtagttctccgagcactcctctgcctctgcacatttgcacttgctcttctctctgcttgggatgctttcccccagagagctgcagagctcactcatttccttcacagccttccctggctaacttatataaagcaacaacaccaggctgggcaacatagtgatagcccatctgtacaaaaaaaaattaaaattaaaaattagctgggcatgtggtgtgtgcctgtagtctcagctacttgggagattgaagtgggaggttcacttgagcccaggagttggaggatgcagtgagccgtgattgccacagcactccagtctgggcaacagagtggtaccctgtcttaatcaaatagttaatcaacaaaatgaactagcgaccctcctctctgagctctctttttcccaactctgcattgttctctccatagtatcactgtctcttgtattttcacttgtttatttatttatttgctgttcctacgcagtgactgtattttgtttattgctatatcctcagcaactagatgagtgtctggcacatagaagatgctccataaatatttgttgaataaaagaaagaagtgaaaatgtgtgaaatctacacagacatgcctgtgcacacacaaacatgcacaatatcatacatggtattatgtagcctgctttgcattatatcaggactaatattacattgtatggctatttttgtaatttttacaattattaagatttttgacagtataaattatcttggtaaaagttattgagatttaattggagctacataatttgttaacctgggcttgtcctgtaaatgttagttggccatgattttattttttcctttatctttaatttacaaagccagttagttgataatcctgttagcaactttaaacatcaatattccctactcccattactactaagtcactctttttaaaggtcattattgtgccatacttttagaaatattaaagaaaatgagctttttagactgctaaaactgggtttaattctgattctcccattgccagctcttgtgttcctgggcaagttatttgacttctgaaccgcaatgttgttggttgttaagatggttatgataatatttaacagagtcatttgcagatttaattgaaataattcatataaaagcagtgccagttcatggttataccctgaaaaataactgccaggcagattggaatacttgaatctctattttttaacctcagaatataaatggatattgtgtgcataattctaaagatgtctccccacgctgcctgtcttctggttgttcaaacgctaatctaggcactgctgtgaaggaactttgcagatggaattaaggttactaatcagctgaccttaggttggggatagttttttgaatgatctaggtgggccgtatgtaaataattacataagcttttaaaagcagacaattcaggccaggtgtggtggctcacacctttaatcccagcactatgggaggctgaggtaggcggatcacgaggtcaagagatcaagaccatcctggctaacacggtgaaaacccatctctactaaaaaaaaaaaaaaaaaaaaaaaaaaaaaattagctgggtgtggtggccagcgcctgtggtcccagctactcaggaggctgaggcaggagaattgcttgaacctgggaggcggagtttgcagtgagctgagatagtgccactgcactccagtctgggcaacagagcgagactccatctcaaagaaaaaaaaaaaaaaaaagcagacaactcagagatgaggcagaagagggaaccagtggagagactgggcacaaagagaaaagacttgtagggtaagaggagactccacctgccattgccgactttgaagggaccataagccaaggaatgcaggtgatcccttgaagttgagaacaacccccacagccagcaaggaaataatgataaagcctcaagttcgcccatcatggatcctggtggcactactccctccttagtgtctttccccaggctgtcagtcagagttattccctgcatttaatatgtcattgtgcatatgtggggtttttttgttttttaacataaagggacttaaggaatatgcagaccccaaagactcagcactgggcaagccagccataaacacttcccttttttttttttttcttttttgagacggagtctctctctgtcacccaggctggagtgcaatggtgcgatcttggctcactgcaacccccgcctcctgtgttcaagcgattctcctgccttagcctcctgagtagctgggactacaggtgcgtgccaccacgactggctaatttttgtatttttagtagagacagagtttcaccatattggccaggctggtctcgaactcctgaccttgtgatccgcctgcctcggcctcccaaagtgctgggattacaggcgtgagccaccgtgcctggccaatgcttacctttttacatgaattcaacctgtgagacagtgagaaattacttaactttgaacttttggtctttcttcttcaaaacttgagataatatatacagtcctctgcatgtaagaagacagaatgagtgtactttttatctccaaatttgtatgtaaggatatttgaaagggagtcaagtgtgtagtttagaaatagtcttcttaaacattcacatagctcctttcacaaaaataaaattctctgagcccttttcattatgatttaccaagtctggtcttgttttcactgttgtcattgttgttgtttaaagaaaattcttttctagttgatttctggaagttgaatggcagggagatgaaggtaccttaaaggtaaatttttgcatgactaacttgtccctcttgtgctaattatacgtgctttcacttttctccaacagtctccaagttcatcttccctctggcctttgatgtgtgtctgtcagctaatatttttatacaggtaatattttcgagttcctgccagaagaattccagggaaaactttctcatcttgctttccgggtctctcctgcctctctccctccctcttcctaatctgctctttgttctcatggcgtcctctcctattttcccaggccgccagcccctttgactccccgtcaaggccaggtgctggccagtcacctcaccgaggaccccggtggtccccagaaccctttgtcttcctgtcttatgccatgactgccctgtgaccgctgcttccaggctgtagggcactgctagaaaaaatgatgaatcactgctgtctcttcagcagactaattaatagacagcagtcctttgattcttcatctcctgttgacttcccaacccatttccttcagtagctcttagaatgctttttacacagtttgtaagtcccagtctgcagtctccactcaatctctaaggatgacatcactaccttattttattgagaagatctgggtcaggggacacaattcaaatgtcaacaggggccatcgaaattattgaaatgaaaggggtgttaggcaggggctgttgtagacttgcaggaggctggccttgcccaaggaggggcagcactcattggagtccggggaaagctgggctcagtattgccccatcttctgttttctctagaaaaatcaaatatctggttttctagtgaaatctctacctgttgaagtcacatttttggaaatactgtgtgggctagaacaaaacacatctgggagctagtcatcttgattctagggcttctctttcttttttcacctcaccgtatttctctatattcatttgccagcatttctttgtctccagggtcacttcttttccttcctgtctcacatgtccagttgttttctctctaccttttatctgcataaaaacattcaggatgtcccccttcctaagcacataactaatgactcctccttctgtgctactccccgtgtcccgtcttttcttcgttctttcatactgagtttataaacagtgaaggggtctacgttcattgctcttacttcttcactccttttaacacctacagtcgtttgtcttcacgacttctctgaagctgtctcattccctggaccctatgattgtactaacccgaattttcctctctgagcactactttgccgtctgttttcaccagctcatcttgctacatcctaaccatgttatttctccatcttactcacttttccttcttaaatagcccccataactacccttaattataagttattttttcctggtttttcctagtatttcatctgcccatctcatgtgacagccttatgttagattacattataggtcattaatatgcttctcctaatggatcatgaaatttttttttcccagaaagagactttaccttattattaagtttttttggttccctataccatgtagcccagtggtaggtatcgaatacattttttaaatgataactttcacattattagtaattaaaacctaagaccataggatacctctgataccgccaccaccaagcccagcagattagaacttatgaaggtttttttgccacatgctaggtttggcccatgatagtcaaagaaaaaactatgtctctcacttgaatgcttcttccacagaagattagctctgtgattgtattccaggacagctgactccacctgctgttcgcaaaatatggaaagtatattatttgcatagcaaggatgggttttcttcagaagtactgttctagacagaaattggtaaaaactcaagtgaatcaaaagcctttaggataaaaccccatttagaatagtgatgggggacaggggtgaagaaaagaggtagtccctcaaagttaagctttagtttgaggaggagattttaacttttaattacggataacaactactaaaaatggataataatgaggacttttggggcagtgggtgagggcttattgtttgctaagctctctatgtgaattacatcacttaattctcacacagtaagtgggaattatggaatctccattttatagatgaggaccctgaagcacagagaagttaagtcagcttgtttaaggccacacggtcagcaagtactggagctgggattcagccaaatcccagagcccatcctactaaccgctctgtaccagaaaagggagttgaggagggaaagaaaggatcagtctggaacatctgtttcctacccctgttactaggatctaaatactactttataataagtctgttcctgccccaaaggcaattttgtggcacctttgcacattgtgcctcagtttatcttccatattactcagtgttagcagaagaggaaagcacactggttttgttctgtctgtctttctaatctatatcaataaagggcagaatatcaataaggaaaaattaacctacgtgaattttaaaggtgaactggaatgtattaaattgtacctgcaaatacaattcagaccatggggtgctctacaggcccaataactcaggttcttcagtgaataacttggaaggaaaaagaaaaaagatgaagaaggaacctgtagattgaaacactgtttaaagatctatcaaccaaccacagtggtgggtcctaatgaaaccctaatttaaacaaatggtttttagatacaacttttataaaataattgggaatgtgatcactgactagaaatggggtgatgctggcatagaaattcctctccctagcaataggaattattgctaatttgggggaatatgataatagtcttacaattaccttttagacatatgtactaaaatattcatggaacaaatgataggatttcttggatttgctgcaagataatatgggagtgtgggtggtgggaggatagatggaaccagattggcatgggtggtgattattgaagctggtcatgggtacttggcacttcattgtcttaatctacttatgttggtacatctttgacattttccataatgaaagtttcaggaaaaaaaataaactggtaaatccaacttaagcaataaattaatttaaaacttaaaatacttaaggtattttaaagtctggaaaggttgtttggtctcagtgaagtttaatcctggctcagcattcagatcaagtagatattgtcgggacactgattgaaacccaagataagtttatatcccatatcattaaggagacattctggacttaaaaaagtttaagaggtggggtattgctatgttgcccaggctggcctcaaactcctgggctcaagcaatcctcctgcctcagcctcccaagtagatgggattgcaggctctcaccacggtgcccagccaccagactttttaatttttaagggcaacgggaaaagaataaaatttgcctttaatctaactcatctttcctcttaagagactacatggcatggacccatagtggcctcaaaaagttacagcccttgatggtgttgtgaagaagaagggtcatgggatctcataagaaagagaagttgtcattaatgctggtcaggcagttaggcaaatgtagccacagtaatcttagaagttattttttcatgttttctggttcattagggagattttgcttttaatctcaaaaagtactgctgtattcttttttgtattggttgactatttaaaaatcaaagtttgcaggggagagtgttcttaagtgatatattaagcttaggatagtgtgtttaattactgctttctgtagaagttaagaatgccagtgttacatctttcttcaccaagcccatctcattcagcttccaactgtgtaaggatgagggatggaagtggaggggccttgttttgctttggaagcagatatgatgccaggatgttctcaatcacggagtgcttgtgggtgtagtgggtcacttaacagagccggcttccctagccagccttctccttccagcctctcccagacttctcccgtcttctagaaacttccttcctaaaattatttaatggctttgcttccatgacctgtgttctttcccagtgaatttatcaataacccatcttgttgctgaccacttttaaacagatgaagttcaaccatgaatgaacccagggatttttactaaactttctggacctgtttttccaactacattgtatatgtattcaccaagaggttccataggctttttgaactcaaatgtgataaaaatttaattatgcaccccctgccactttattttatgtcttctgaattctctgttaccacagagaaaaaggtcagaaaccagagtcatagagtcatcagtgatgtctgcttcttcatgccccaactgaatcccctaaatgcttttctcagttttactcttccctgcattctcactgctagttcatggccctgaaaccataattgcatcccctgcctccaaattcatcctctggtgtggtctccagaatgatctttttgaaattctaatttgatgttgatttttctcccgctttaaagccttctgcagtgggctctgaacctttttcatcagggtactgctgtcatcaaacttgtgagcatctccttcagtatgtatatttattataaataatacacacattattgcactgatatattaaatactgtaaacacacctacaaagtagaagtctcgtattatctttcatacaacacaaatagttgtatggctatacataaatagttggatggctgactatgccttctggtctgactgctgaggcactctttaattcacccctctgctttcctgcccactggctctctgtcaaaaagtctcccttcctcattctcacatgttcctactcacctcaatcattcctgtgcatatatctacatttttttgtttgtttgtttttgagacggagtcttgccctgttgcccaggctggagtgcaatggtacaatctcggctaactgcaacctctgcctcccagggggttcaagcaattctcctgcctcagcctcccgagtaactgggattacaggcactggctaccatgcccagctacttttttgtattttttagtggagacagggtttcaccatattggacaggctggtctcaaactcctgacctcatgatccacctgcctcggcctcccaaagtgctgggattaccggtgtgagccaccgcgtccagcctacattttatacagtttccaagtttagatattttagatcctgttctccatggtctttagcattatagccttgataatttcttaattttattgctttgacttccccaaattaattaaaccatttaccatccctctaataatggatattcagatatttccaattagttattgttatttagagttctacaacatcgccaccggtgagagttaggattttttgtgtgttttggtatatgtaaaatggtaactcatggctgtttaatatgcatttttggttaccattgcagatgaaattttcaccatatatttattttctttcccaataagactaggatttcaatttttttcttaaaatatatacacttaaataaagttgtattttacatactatatagtaatcattcctttatcgaatatgcagttctgttagcttccctaataataaaatagctggatactattctgcctatttgttggatgagaaaacttgaggcttagctaggctaagtaacttgacagatcatatagctaaaagttgtggacatggggtattaaaagtcaggctgattgatttcaaattctaccctctaagtcatcttgcttgcttcctttgacaaaaacaatacctaatgtttataataaaattataaagtacagataaacaaaatgaaaaattaaatcacatttaattaatctgaaatcctgccacacagtaacaaccactgtcaacatgttgtcatatgatagcatacctcagagggagacacaagacccactgactgggggtgggaagggttttgaaaaaatgtacataaggccaaggtgggcagatcatgaggtccggagatcgagaccatcctggctaacacagtgaaaccctgtctctacgaaaaatacaaaaaaaaattagccggttgtggtggcgggcgcctgtagtcccagctactcgggaggctgaggcaggagaatggcgtgaacccgggaggcagagcttgcagttagccgagatggcaccactgcactctagcctgggcgacagtgagactctgtctcaaagaaaaaaataaaaataaaaaaataaaaaaataaaatgtgcatatacctctcctttcatctcccctcccacatctctctctaattaaagatgttactggtagtagactgctctgggatctgtgatgaaggggaagaagaaagtgttgaaaaccatattcttcctgacttttatgtgtgtgtatatttatgaaaaagcagatcctttagtatattatgagggtccttctgtgtcatgaattattggtaaccactcctgtaacctggttctgcttaatattctgatggatgtacctcagtgtacaaacattggattgtttccattttttaattataaatattataacattcttgtgaaaggagtatatattcatcgttgctcatttttccaggtttttcttgtaagtctaataaatgtagaatgaagggccaaaggctattatatttttagggcttttgatgagcattgtcaattgccaatttacccaccgaaaaagcatgtatcaatctggtccgtggtaaaatgagagggaaaatgggggaggagatgaacccaccaatccatttttttttccctcaaacacacatgatgcagagaacatggttgtaatctgacaatgaaaatgtgcctattccatgtggggcattttatgggaaagagtctctactgttcttgctgggtcagtaatgatagaattcataatgagccaacccacttttcagacctatgatgacctcactggggtgtgttagttcctgcagttctaccgacatgataaagtgttatataccagtgggctgaagtcattgtttttattcaatcactatacaaatttcacattagttcagaatggcctttcacaatgcttgtgggatctcagtggtttgacttcatattttttgagtgatatttgcagtaacacattggttagtgatttagtggaaatacttgattttacaggatttcttaggtatgggtgcctgaattttgagagtggcgcagtcatttctctcacattttcaaaaagatagaacatatttcaggacatttatagaatgcttttttcctctgaggacatgatgactgactgtaatccgcaatctctgatttctaccctgatgcttcaagaaatgtacaaataatgagaacatctactctaaagttcttgcccccaactgaattgaaacccactgtttaaatatattgttatgtaatttttatgctataattcatatttttatatagttttaatacattgttatgtaaattttgcacttcagtccatattattctcatataaaataaagttttaaagtatttgccacaaagaaaaattggtatataattggtataccaggaagctgaaccatgttctttccttcactaggctgccagtacagtctcacacagcatattactctacatatgtttacttttatataaaactttatggcagactttaatcatttcagtcaattcagtcaaaattttcaaagaatgacaacttttgaattccacaattgctcagaatctttgaattaggattttactgtggaaaataaaaataatttggcagtattggcaaagaaagcaagccattactaaacacttcaaatatgattgcaaagcaacatgttaatttaaaaacatgtgggcctgtttgatgtaatatgtcaatagatattgcaaatactaaaattttgcaacctcgagggaaattgactacagtgacttttattttggcatggaaaatgggttcactgaggactttgggacatgggattatcagattattcattgagctagtatttacaacacagtgcttagtactgtgggaacacagaaaaaactgcacactaaaccctttaaagcataaggcatgaatcccaagccctcatccatccttagatttgcagatataccataacatgtaatttcttcatctctttaatgtctatttattttattggctaagggctatcactttcttgtaccacttgatcttcactttcattgctaggactgaccgctggcttttttctaacaatcccacaaagaaataagtttgaagtttgctcataagagttactagatagtcagaaaacaaagctttcttggaatgcagatgtttattggttggctgggctccatgtaactaacacagcccaagcttgtgatttgaatttgcttctcagctaagttagctctacttgtcaaggactcttcatctacaatttgaaaatgccaagcatctatttgaaagaatctgttatttgagaaacaatgtcttattgagaaagcaaaacagacttttggaatatttaaacagtgaacattaatacatgattaaatacccgaatgaatgggtggtggaaatagtaacgggtgttggcaatgagagaaaaggaagactacatagggacataatatgaaaaggcttcatgatttgggcaagatctaagaagccaaaaccatatttgagccacaaatatggttttgagtgtgttgctagtataggttttgatgttggtagtagaggagaaaatagggtctttaacaaagggtacagaatgagtatggcctcagaaacaggagtagatatgatatactgaagaaaaagccggccatcctggaggcatgaagaccaaacatggaaggagatgaggttggaaaagttagaaagacaagatgtggaaggtctttaaagtcaaactcaaggatctagactttactctgcagacattgaaaaccagttggagactagcgtgattaaaaagaaggttaaaagccggcgggtgcagtggcccatgcctgtaatcccagcattttgggaggctgagatggaagtactacttgaaaccaggagttagaaaccagcctgggttacaaagtgagacctcatcagtacaaaaaaataaaataataaactagtcaagcttgcacacctgtattcctagctactcaggagactgaagcaagaggattgctggagcccaggctttcgaggctgtagtgagttgtgattgtaccactgcactccagcttggatgacaaagtgagaccctgtctcttaaaaaaaaaaaaaaaagcccaaaacaacaaaaagattaagaccatctctgcacatgacttggtgatgagtaatttagtgctatgttttctctcgatttatttggaatcatataaacctatctttcagtacagaagggcactgagtcacatttaggtgacatatttcctcccaaaatcccagagaacttcaggaagtggtgggggtgattcagcaaggggacatcttcctgaccatgtgatggttgtggctggatagagctctttttgccaggctatgagaacaatctttccgtaaagtctgttgatgcttactcaacgttttctcagatggaaacttggtggggggtaagactagatgggaacaaacttggaagatttagagtctctctgctaagtcttcctcctgaagcctttctgaagggcctgaacttcctggagaggccttacttaccaaggaaaagatagatattggtcagttagcttgattctttgattacttatgctaaaaaataaagaatgataagcttttatattcccagtaccccaagattagctctaatcttagatgggtcttaaaagtccatggaagtccatgtatagtcttatttttggtatcttaacctaaattatgcagaggtatattttactggattgacctaacataactaacagaccttttgagattttattttgtataatttataaaatggaaagtattatcaacgtagcataaagattaagaaatgagctcaggagctggactgcctgggttctggtcctgatttctccactacttaaccttggacaagttatttaacccctctgccttgattatctcatttagaaggtggaaataatttacttctttcctaggatatttgtcagaattaaatgaacagatttgttgtttatttactaagagcaaagctcttaaaatattccctggtatataagttcccaacgaatatcacaattagtgtatcataaatgaaaaaattaaagcagttaaaggttaagtgacttaggtaattatccagcaacatgactataccaggattagcatttcttattttaagacagtctactgaagtagcaggctttttagaccagaggtcagcaaatcttttcttaaaaggccagatataaacattttatacttgtggatcttatggtctctgttgctactactcaactctgttattgtgtcttggaaaaatcaaccacagacaaaatgtaaatgtatgggtgtggctgtgttccaataaaattttatttacaaaaacaggtggcagacccacatttggccttcttacagacccttgctttagacacttaagtcatatctgaaaggagactatagattccatttcattttgaaggctgagatatggcattatgtattatgataaacagaaactttgatttttaatgattgtttaacatgttagtctcatgatggtcatactttaggatagcaaagggatttagaaaataagcaatagtaacaaatgtgttttttatctcaaagagatccatagaaatcacttatttaacagttggagaattatcttggaatttgagacctgaggttgtgggcaggatgttaagagtttgtttgattaaatggacccaaatatagactggtttcttttttgcttctctatgtatgggataggtttgtgagtcaaataacaagctatttgtatttatgcttgtcatttcactaagggtttttcttctagaaatgctgtttgcatgggtttggatttttttatggcttacttttcagttcgataatgtgttcttgttttcaaattaaacttgtcattgagattttttgcgagtggctatgttggttagttagtatttatagcttaagtctgtttctgaggaaatgactaaagtctcttcatttgatcaaaactgtagaacaaagaacatctttgacttacttaaacaagtcctatgatgaaaactcaaaaaatataatggttcatgtttataaatgtttttgtgtattcagtcctggttaggccaaataatcagagctctgtgctgagggagggattgaatatactcagtgcctgttagttaatgtgaatttctctggagcacattcaggcaatacttattttctcataatcctcctcccatctctgccccatcccccaccgctttttttttcatttaacatattgttttgaattggattttatagaacataggtttttgtcttcttcttctttttaaactattctactaattttctcctttcttattcctagccaagagccctgatccaggtgaagcgtgtaaaccttgcacatggaattcccagcaaagaggctggtggggatcgggacagggcctgggaagtgactgacttgcagaaacccgccatgtcttgttctctgctggagacctttgcttatccatcttgtgaacatctgcagcctccccctgcagcctaatcttgccctcttactgttgactcagtcctcatggaagtgtaggtgcccttccttctgctcattacgttccagagcaggagatgagggggctaagtagggaagaagagaaggcccagctcctgtctgctcagacccggactgacctctgccctggggctcaggctgggacttgtattttaccataaaggccctatgacaggtggcggttggattttggtgttagatcagctgtgttgtggactgactgggattttctgcactagattttaatctaattattctttggtaacattgattgtttcagctctttcataaacagctcaaggcaccacttctccaactaaatcttgtgtctaagtctgaaacagatgaaagtgaaatcgctgtgcccatggctgcacatccactcacttctgcctctgctctctgaagcatcttagggtgggagtcctaggagctcactttgaaaactgctcattaacatgactgtttactttcagagcgcaccctagtcttaaaattgagcttgcctgtttacatataataagttgcttaaaatttgctgggattggtgtgtatatatgggccatatatgaagccagtggtaggagaaagaggaatggacagatacttacctgatgtgatttgatggggtgttgagaaattccacgatgaaaatccacacccccattcattcctgaaatgccatagccagtaatgcattttatttcactgttaagcacctgccttttctgaagctttttttttttttaataaaaaatgtcctcatgaaggatatccattaagttgttgcaaccttggagctgatccttttgcttccctacttgattaaacatctggggttaatgaatcctcacaaggacagatagaaggaaggaaacagccacatccatacgtcataattttgtctagaactggccctgactctttatgcatttgtaaaacatgtatgggaatatctctggtatttaacttggagacaccttgctttctcctttggatgcagttagttctgaagtatttgaagagagggcatctcaaaaggaacgttcactgttcttaaatattcttttagtaccaaaatatattttattactgtatcatggtgaggatatatgttcctgtatatactagtggggattttcccctaagtatgagttattcaagagataagagaatcaaaaatgcaagtctgaaaaatagtgtatgtatttctacatattttatacaacttgttcctgttggacaacaaaataataaattgtggacatttcccatttttttttaccttaacgacaaaatattgcaaaaccgtggttcattcatttactcaacaaacattcatagagtacctaccatgtgctactactactttgtgctataaaaattaatgatggtggcttcagcagaaaaattagtcatcagggaatatttgaggttgtccagtaactgaggaaggaagggagagaagggtggagtgctggacggggaagaaggaagaaggaggataggagagaaaggatgaatggaaggaagtccttaacacgttttgttgtttttaattacactcatgttatctagtttaatattctttatataatcagccatttgccacttttattttttctgatgtgctataattttaacttgtcgtttttgtatttgtttcttttcagtataaaagaacgtgtggatcactttgctgagtacatccaagatttgaagaactgaaataaatcagctttaaacctgctttttaaaaatgtaagtgaactcacttctggccatggttcatttcagactctctaaaacctgcaatttcctctcagtgtgtgtgaatttttttccaggagtaaagttacttgactctagtgagtctactcattaagtctaggagtgtttgtatctgctcgcccttttaaaacctgtaaattctaagagtagtatgaataacataggtggctgtaggatttagacgcggtgtggcaggcagtgagcaaatcttcatttggcactgagaaggaagacacagacttggtagaacataaaataaaaagcacagccctcttctcgagtccttcatcactcttcacctcacagaccatttcactaccttatctacaccagcgagaattgctagttgacccattaatgacccagtaggcttagaatatgaggtattggtttctcacaggcatatttacccactttctccctatttctcttgctcagtaataataactactatttattgagcttctaccaagtgacaggcatttgattaattcgattccatgttcattctacaaatagtgtttctgaatgcttgccgtgtaccaggcatggccctgacactacttattaccttatcttcaaggcacccttgcagggtaacagttaacacttcagtgatctggatgaggatccgagagaggtaaggagcgtgctgacagtcacctagtcagtgagtgtgaactgtctgactttctctgatttgccatatcctaaagcgtgcttagatgcttttcctggcatggatgtcaataagagattggaaccttctggatcatattcataataggactgtgattctcaccctttaaaaccttggctggagtcacagaaagaaaggaagttagagaaacatcctgtcacacagctttggtacctgggtggggagctaagagatctgttgtccagttccagtcctttcaggaatttcctctgtgtccatgagctatctaaggtccatgggaaacagttgatcttatgcaaaccaaagggcacggaccagatgctttcaagggtctgtctcagtcagctctttgctgaaggaccttatgcgtagaggaaagtgcacacatcattaagtggatagcttgagggaataaatgtcacaaagtgaacacacctcttcaatcagcaccttgatgagtagaaaattaccagcacctcagagccttcctcccctcatgctccagaagcaaccggtatcctgccttgtgatgcctttgtttagtttgtctttatgaatagaatcatacagtgaatattcttttgtgtctagcttgttttgcttattatgtttgtgaaatctacaatattatgtacaatattttttgcattctctttgctctaatgctattcaattgtatacctattttacagttgctggacatttagatggtctcttgtttgggtgtattactaatagcgcttctatgaatgtgttgtgcatatcttttggtgatgattctattttgtttgttcaggtactaaagtcattttaattcgtggcactttggaatgatgttgaactttaggtagccaagtgatttgtctgcttcaatgtgatgttccaagctgcttactcaacaggaacagatgaagatgtttttgtagattactcttgtggggtgtggccaggtggaagccctctctgatatgtgagtgatgtggtggggcttattgtcctggcagagaagggttttgattgcatggtacaggaagggactatgtaggggaagaggaaatagatccagaaaagagatgtgtctggattcctatagaaactgtcaggatatcttaccaatcagatcaagaacctggaaaagtaagagccccagggaagactcagcttgtgagacccgatgtgtctagggagacgaatagagaaagaaaaatagaggcaggcctgagctcagaaggagctctcaaagaattttctgaacaaattcattaagcctaacttgttttaaggaagctttgaaaaaccagtccctaaaagtatgaatcttgagcccagaatgaacttaaaagtatagaactaggaaaaaatgtattttcccaaacaaatatgggatgtgagcatgtgggctttgccttaagacctttctgcattcagatcacaattccaccactttgtctcgtgacctttctggatcagcttccacatctgtaaaatggggatggtaaaatctccgcctctaagattccccccaaatctgctgtaacaattgactacaatagtgttagtattatgcttcagggcacatagacctagcactaaaaatgatagtcattttatttctcattcttgttactaagattacccatttgtatctgatactttatgagcgttttcagttcactttttaaaaatatgagacttcggtttttaatttaagtgtagtgaatactaacaaaaaagatttttctacttgcctcaccttagactgaaactcagaggaaggatgcaaggaaacatttgtccatgtgtccttgacatgtccctccccagggtgagtcagtgaagacactcttggttgtctgaactggtttacttgttcaaaaagagaccagtggagctgagatttgtgggaaactagggtcattttgcacaaaggaaatttgtacttttatacattatactctttttttttttttcttttaagagacagggtctcggtttgttgcccaggctggagtacagtgatgtgatccttgctcactgggctcaagtgatcctcccacgtcagtctcctgagtaactgggactacaggcgtgtgccatcatgcccggctagtttttaaattttttgtggagacagagtcttgttttattgccaaggctggtcttgaacttctggcttcaagtgatcttctcaccttggcctcccacagtgctgagattataagcgtgagccactgctcccagctgtaccttcagtcttaggtgttctggcaggtggcacgtatatgaaatttcgtttgcctaagagtgtaagcaacaccctagtctctcctctgtgccagtggtccttgagttcatggatgatagtggtgaatgctgtctggttgtaccacttttgaggctgaatgggcccaggtacaagaatgaggtgggagccacttgtccagcttcatctctgtcttctctgcattaggccaaggaaggctgtgggactgtatggttagctattcactcaggcttgcctgtatcatcactccaccctgtagtgtagtggtttgtaagtaggcaatttgtagccactgagataatgtcatccccaaagaaaagcatctactgtggatttgtcctttgcgcccttttctctgtaccctttttgcagtctttgaaatcactttcattattatgtggggattggggttttctatctcctgactgtcttttgtgaactaaatcttattttatgcaatttgtactaaaaattataaaaatactgcttggggatggcagtcttatttgggattgtgtcacatgttgtttgttttgtgcttaattggttcgtgataactggacaatatataaatgatcttggtttcatcatgtaactcacaaaatgttttcttttccatttttttttctttagtgctttctccttttcctaccaaatatctaggctcacttttaccatcagatagagatttagttgggcttttagaactctctcttcaagcagatgctttgcgtgtgtgtgtgtacgtatgtgtgtgtgtgtgtatggagtttgtgggctgttagaagctatttgctcatcttgtcaaagccatagcagtcttttcattctcagttgctttgctttctcctcacctcttaggaaattggcagccaatgactttgattttttttttcctttatgagacagatatgctagtgtgtaactgtagacagaggaagagtttgcacatttagcaaatgatcaaataagtggcgtgtgtatgtgtgtgtgcatacatgctgtctctataactgagcaagtgttgtttttttctctgaagtctccatgcatttatacatttaattaggaggctcaagtatctctgatgacttttaaatatatagcctcaacagttttttaagaagaggggagagggtccaaggcattttttacacctatttagtggatgtgtggtttaatgttatggtattttggggaaacctgggttctgactccgtcgtttcagtgagccatggtttcccattgcttcaggagtagagaaatgggggaaggcatttcaatagttcttaaatctattatttagcagtagctcaaggctgtatgcatggtaatcaaagaaatgagattgggttccctgggtgtggtctgcattccttctgtactgtagcgctgttctagtctcctggtcaaatcacagcccagagctgcttcagccaagaggagacttaaattagggatgtgcaatttacagccattgtagcaggatccacttagtccctaggcagaagataacatgtgcgatcactgtagaaattatagcagctttccgattgaaatagccctgagagtttcttgtgactattaccttgagctgaggtgtaatcccttaccagtggtgtaatcctaactacaatacaacagttaattgtcttctgtgttcttatttgtggttcagaacacaaattgttatttttccatcagcttttcttgcttgttgtttgttttttacctaattcctttcctgttgtagtagttgttatatgcttggcttgacatagttaggctatttggtactgtgatattaagatatttttgaggaaaaggtcatcagctgtctttctgggctattctgggcattttgtactctattttggatgtaacttttcttgctcttgatttctgattagctgttcttcctccttgctttggcctctcaacttgcttggaagcttttcaacaaatctgcacttggatgacggctttgttcaacaaataaacattatctcaaccttggggaagagttaagaagacacaggatggaacactgttagatgcttctggttctaagcatggaattcctggaacagggaagctagcttccaatacattgaagtccggaagttgttttcctgctcaaggaggtcacatttctaccaagagaaatgtgaattctaaggcattttcaaaagttttggatgatttggtgagatttaaattgtcttatttttgataaatttttagaaattaaagaatgcattatttgcttagaagagtgggatttttggttcttcatggtctatattggtccttcctgaggtcgcacagaggcctttgaacaagattgggcctgctgtgtggttgggatagttgaaagccaagtatcaagcaggaaataagagtagcagaccttaaagtattagacttctcataagggaaaacagcaacacccaagaaaaatccatttacatttacccacagtccttctggcctgtggacctcttttctcctcttgttagccagcagaacagcaatctcttctttgcaagactgtgagtaattcaagggggacagaaaaggacagaaaacaccaagtacctctatccagagggtgacttttgtttcctcactttgtggccccactgaattcacagaaggtaaagctgaaagaactcagggtatatggctggttttttgcactctttacttgataaaatcagttgattcttctttttttgtggtagttgtgctctgaagtgattgtgaacactgaatgaccaaatacttttcctaggggaaatgcagagggagggtcctgcgagcctttgaccacagtgtttttgccaactgatcaatacacaaccttgttttatgtgtgtttctgtttagataccactttcacatatgttgttgaatcattaacactgacacacacccaacagctttgtaactcaggcctgaaggaagctgacctcacacactggtttcgtccttgaggcacggcctcattacctcaggaacaccaggcagcgcttccacactgtgcttggagccattttaaacagcacaagggttgatcgacaagtacaaacgtgtgaaaaatgtggcacagaatagaccatgaaaaggacactttatggcaggagggctgaactgatgcaggaaagtggagcatcgtcttgttcagcctgcgctgggaactccgccatggtgaccgagaattctcgctcctttgcatgtgtctgtgaatgagtgtgaaggtactaatgtgggggttgcaagcaaattttagcaggtgggccaattcacatgtgtcaactgtataatagaagcaaaataatcccaattattgtggccggaaactttcccagtcccactgtgtggttcatgtagaaaaccaataatttaaggtaaaaatgaactgtaagctggtatagccagaccaatgtttttaaataggctcttgtgagatgaagacaggcaaggaaaatgtgcccaagaaattatcatttgttgttgaacaaacgataattagccctgctgccaggctttgaacatttagagaatgggaacaacatcacgtatccccatgtccttggcatgaaaggtagtaatggccagcacctaggggcacctcagcaagtgaatgaatcctaaataaatgaatgaaagagcagggggaattcttagtgatgcctgatggcccactgtagggcatcttaggaatctcatgcatcattttagcctagatatatcatttcctgcccactgtgttccttaaattaacttgcataaatgtgtatcaatgagcagaaacagtagtgtctgactgtgaaaggtaatcatgtgacacagaggttatgtatcatgctcattttcgtgcacagcccctggcacgttaatgttcattaaatgaatttgaatgaatgaatgaatttaaacatctagaatatttagaaatgcaatggctttaaaaaaatctttttaaatttaaaacagaggtgactttgtaagtcactttgtactataagtctgtagtcagagaagtagaaagatgtggatattcttttgttaaccagctttgtctattgtataaaactgagcttttccactcaggaaacatctacgctgcgctgtgtctccctgcacccccctcatataaatatccagggatgagagttaattaaagtagaagctagttaggttttctgaaaggaaatgacattcactttcagatgttatccgtttaaattatttcctgcagattaactgttcattttacgaattatttatcatggagctactgtgtacaagaaactgggccaggggctttggagcatgcaaagataagcagaacatagggtcttttgtctagtgggagggaaagacataagtgcacatttttgtaagtctggataaaatgtacactaactacgggtaaaagtgaagtgctgtggtggcacaaggcagagtgaggttaattccaacctgctctgttctacggaggagcttcaatataacctgggtcttgaatgcccatttgggagtgggtgggcagcagggtagactggagaagtagcacattaggccagttccaagaagaggtagcaaaagcattggagcacgaaggtacaaggaacaagtaacataaaggttctggagtgtgaggggcagtgggggagtattgtgaaataagactagaaaattgcctcaggatccgattatagagagattcaatggtagtttgcttggactttattctgtagtcattaggaacaatagcagattttaaaatagaggaattgtgtgtcagcaactagcagcagctaaaatttgtaagcacttgttatgtgccaggtacgaattcttaccacagccctttgaggctaatactgttagtgttgcagtttgtagatgaggaaacagcacagagaagttaagtaacttccccaggatccacagcaaataagtggtggactgggaattgaagccaggaagtcaaacttaagaacctgggtttttaacctgggatggaagaataggattcggagagtctttgaactttttaaattatttgccaagtggtcagtatatatgaatatgtgcattagtttaagagaggatctatggctttaatcatgtaagagatgcatgcttaaaaatgttaataaagactatatagggcaggcatggcagctcaggcttgtaatcccagcccttgggaggccaaggtgggcagatcacttgaggccaggaattcacaaccaatctggccaacatggtgaaaccctgtctctgctaaaaatattagagttagcctgtgtggttgtgtacgcctatagtcccagctacttgggacactgaggcatgagaatcacttgaacccaggaggcagaggttgcagtgagcagagatcatgccactgcaccccagcctgggcgaaaaagtgagactctgtctcaagaaaaaaaaaagcctataagagcaccctctttcaccctcagaagtcccccagaatgcacaatgcattatatagtgactatgcctgttcttcttgttaggtaggaagaagcagaacaatctgtcatggctcaaaataaaagaaaatgtccaatttgaagaaattcttagtattgtaagtgtcaggctgttcttgatttgtgagaaacaaaaaatttaaaagatggtattttgaaggtagaaatcagatattcaggctttgaaacttgcaaaaatttcaaacggcagaggacctatctccgcattcggcaaaaattattctttttaatctcaacaaaagctagataaactcctgaaatcttacgtgttctgtaaaaatacctagatgctagtctgctttcaactgaaccaatttgcctttttacagttaggacttgaaggatgaatatttaccaatctatgagactgaaaattctttgcagccagctgtgaacccaaaggcaggtgcgagaatgaatgaaggagtccagattaaagaattgtccagtttacatcacttgagaagtcaaattaatatctaagttttatttagagtaaatgttttaatgttttaaatatatataatctcataagatattactgttggccaggcgcagtggctcacgtctgtaatcccagcactttgggaggccgaggcgggcggatcacggaggtcaggagatcgagaccatcctggctaacatggtgaaaccccgtctctactaaaaatacaaaaaaattagctgggcgtggtggcgggcgcctgtagtcccagctactcgggaggctgaggcaggagaatggcttgaacccgggaggcggagcttgcagtgagccaagatcgcaccactgcaccccagcctcggggacagagcaagactccatctcaaaaaaaaaaaaaaaaaaaaagatattactgtcatacaagtgtaacagatttaatactttaatagagatctatactacttatttactagagcttttctttatattttccccatctttgttttctctctgtcttttttttcctggactacttgaaagtaagttgcagatatcatgacacttctacccttaaatatttcagcctaaatttcctaagaacctagtccacattcaaaaccaaaatatcctttactatagtttttgttttgcttttggttttgatcaaagattccatcaaaaatcacaaatagcaattggttgtcatgtttctttcatctcttttatgaactctcttgtctccctgtcttttttgtgtttccttattttgtgtttcatgatgttaacatgttttaaaagtcaaagacagttgtgtggtaaaatatcgtatagtctagattcatctaactgttggtgtcctcataattagattcaaattaaacattgctagcaagtgtacattgcttctcttcagaaggtgcatgatattagctaggctgagtttaatcacttggctaagttggtgttgaccagacctttccattgtaaaggtgcctaatcctcttgataactaagaatgcacctgtggggtaatcttagagagcatgtgcatgtttttttccctgacagtgattcacccaatggttttagcatctattttatgattcatctattatgaatcaattattaagttgctggttgcaatatggtactaacttgatctctaaagtcattttactgaagaaaaattctcctttccatcccatgtcctgcttggggaaaatcttggcccaaaagacgcatgacagaaggatcgatgaaagtgaaacttgaaaacaactatccaaacacacattaactatgaagatgtttgaagggttttcttttcctttctgagtgggtatgcaggaaacctgtaccctagggtgagagctctttattttaaagatttgtacttaaaataatctttattgctgcaggtgaggaaaaactaaataaattgctatttattttcttttggactgagagaattcagtagcaatgagatgaattttctttcagtgccacaatctgaaaagctgtgatgtttaccataccatttgaaaatgtcttagaagtagttccttataaagcatattatattgaaatcaaatgggcattaaagccatggaattcctttgaaaggtggaataaagcggaaattgttttgtcttggtacttcttgatctagactaataatcctttgggggaatttatcctgaggctttttaccaattgtgctcatgactggctccctcagtgaatgttatctgatgaaggtcttatttcacttctgaaagcacagcgttgttctatttgtttgaggtattagtaggtagcaggaaaagatcgactccaggtaatgcaatataaaacccacccgtccatcttgaaattggaggttgtcctgcatgctatataagttctcccacttgcaatatataatgaggagacatatttttgaagcaattaactgttccttcaaaattgttctttattgttggtgtaaggactttagcactctctaggaaatcgtctataacttgcttcatttttcttttgttttgtaagaggattttagactctattcttgtggccagttagacttggatccgtgcatcctcttgagccgtgaattttctggtctcaaagtcccaggctcaagcgatccttgcgcctcggccttccaaagtgctgaggttataggcatgagccacggcacctggcccataatgtatttgacactataattaagagatactgagatatttcctattttaaaatacttcgtcctgctttctaatatatagcatgacacccaacctcagagggtatggaaagcttactttactgtaaagacttgcaaagcacactgcttatattttagggacaggttcatacctgccaagcaggtttatgaaacactgatgaataaacacaagtatgtcagaaatcttactaaagaacagtgcatcttattcagtgtagacagtcttctaaagtattttggttgagttcgtcctagagcttaattgcgagagtaagaattaaaataataaaactggttgcaagtcttttgagagtaagatatgtcatctttctttcaggcctatcatagtgtctagtctaaagcaacagtaaggctccttgcatatttgttgaattaaattttcaatttagtttctgaattccttggtcctaatagatttctcagttgataggttgccatctcacttgacgtctacttgatggctatgttctcttcttgtctgcctcccttttcactcctgttcttgaccctactgaccagtcttttttgacttaaagaatagcaactctttaagctgttgtatttcacttttttaaaattatatagacaggatacattaaaaacatttaaagaattacatagagtcagagagatagattactttctactaaatgctgtgttaggattttgttttttttgttttttttgagatggagtctcgccccattgcccgggctggagtgcagtggtgccatctcttctcactgcaccctctgcctcctgggtccaaatgatcctccggcctcagcctcccgagtagctgggattacaggcccctgccaccatacctggctaatttttgtatttttagtacagacagggttttaccatgttgcccaggctggtctcaaactcctgacctcaagtgatctacccacctcggcctcccaaagtgctgagattacaggcgtgagccactgcgcgcagcccactgtgttaggatttgcaatataaaggaactaagacctggtggttgcctttagatctcacagtctacaggtaaaatggatctataaagagggctgaaaagtacaaatcatggcaagaaggtggcagagcagggactaggggacagctaaaggagggtcatgatccctttgcctgagggatcaatattgcccagtagtaaccctagagcaggttctttaaggatgagtttcccaggcagtcaggaaatggggagggaaatccctatggttttgtgtattggccccagtgagaagcaagtgtgtccccttcgggaacttgatgagtatagattttaaaaaatatctgggagaagagaaaggcaaggcatggcagatgttactagatgtggtagacatgccaagtttgggtaggaggtatatgggttagatctagagggaagcagttagaagttggggaacaggaagccttttacaaccaacctccccttgctgaatggattattacttcattagaactcaatgtttacccactacagaatattatcactcatagtctttatagtcatatatttgcctgattttatctcttaaataaggcaattgagcctaaagatcaagacttttttttttttgacaagctagaaaggtatctgacactcctatttgctaaatatttgtagaaggaagaaagaagagaggaaggagagggataagggaattgaaattgaggaaaggaaggaatttgaaactgaagagtcatatgctttgccacataaactctgaaggtcacacaggatggtagtgccagcagaagaaggaggacgttgagtgaacctgtgattgaatgaggaggatggtagagatgctgggaaggtgagagtcaggacaagaaggctgagggcaccttcctcaaagaagttgacattcagtggaacgttcaatgacaattgcaaaggagtttcagagggcagaatggaatggattgggagaggacttggttaagatttactgaaaaccctgaacttttggtaaatactgctctgtgtgggaaatgtttcaatgagaattgactcttaattaactctcactcttggatatcccttgaacaagttgtctggagagttcctcaggagaatgtctacttgcaacaacagtaataatatttatcaagtgcttgtgttacctcataaactctcacactaaccctgtgaggtatgtattattatcttccacttcttttgaatgaagacagctagacttagagtggttaagaagtgttcacagtcgtcacattgctcctaagtgggccactactacagccaaggcaacacatgctagaacctgtcaggtacctggggaatatcagaactgctgtctgatctctgaaattgaaattaatttcctcagtgactcaatacctactgccactcactcaagccctgcaagttcaagccaaatcatcctgccaccgcaggaatgtgatgggtcacgctgctacctactgaaaatggggatttgggttaactagagtaaaatacagtaagaatgggtgagaggagagaaaaagaatacttcagtttaggaagcataatactacttaaaatttcctgagaaagaatttcttcccttggaagtgcatcttcccaggaggttgtgtcctcacagggggtgtcctcacacgggaaatagcccgcagagaggctcaggttggaattggatttggagctgtcgtcctttctgtcactgttagaggatgaatatgcaatggagttcaaaggcacaaatctgtcaacttgagaagcttcaaaaaagaacagcacatatgctttcaatgtgagtcaagatggtgtgctggaagaggaagacatgggtaacaagaacgtttattttgtttattgaggaaaaaataaactattggggattatcagtggaatcctatcttatggattattttcaactttccaaaaagttgaaaaatctgtctatataggatgtcctaattcaagggtttcttgaggttgaattctcttgcctctgtgaaagaatcgtttccttggtgctggctgacggggactcttggtggctttcacaggatgatacctcctcagcagaggggagaggatatgctgcctcagccagctgaaggcccacccaaagttcaggcagcactgggcctgtgtgtgggaaggagtgtcatccttctccggctgctctgacaggattgagatctctggagcacttgtcctttggctggcagttgcctggcttatcatctgccaagaaaataaagaatatgttaggtaggcgtaaccatgacagcagccaagtcaacatttactcatttatggaactcacatccttttagcaaaaatagcccaagtaggctgggtgcgatggctcacacctgtagtatcagcactttgggaggccgaggcatgtggatcacttgaggtcaggaggtcgagacaagcctggccaacatggtgaaacactgtctctactaaaaatacaaaagttagggtagcagacgcctataatcccagctactcaggaggttgaggcaggagaatcacttgagcacgggaagtagaggttgcagtgagccgagatcacaccactgcactccagcctgggcaacggagaaagaatgtctcaaaaaaaaaaaaaaaaaaaaagcccaagtgtcaatgcaaagcttcaatgtagatacagtttttagtccttctccttgcttgctaccctcttgtttacctcagcattcctcagtcttttccctaaaactccaccctgactcctttcttcgttgtctgtctcccactggtatcacttcgggccccttgggacctgcttcctagtggtcgtaagattctgtggttcaacccaggcctatcccttcctatcctatgaggcatctctgtgctcacctcagccagctcatgttccttaagccttagaggagtctgtggagactacataacatctttattttctggtggcttgcacttgggcaggtcttgacaagcatcatgttcttgatgactgacctgaaccatttctggaggggagctgccgtacagctggaaatctgagtagtttcaggaaacacagcatcatcatcttcattgtctttcagattttctagaaatgtctgaaactcttgcacaagattattcagtttgctgacagatagttttgtcctctcttttgggaacttgtttatccacaggttggctccatttagaagcctattagctattgagtctgtgttgtcagagccaacgtccatgtcccaggccaggaagatgttcagtttgcaaaactgtctggttcgtcctgaatttggtattgtctcttcatgtgtttccttatcctttcagtcccccatgccccttggatgggagggagaaagtggatggaaggacccttggaaggtgcgtcttcccaggaggttgtgtcctcacagggggtgtcctcacaggggaaatagcccacagagaggatcaggttggaattggatttggagctgtcgtcctctatgtcgctgttagaggatgaatatgccatggagttcaaaggcacaaatctctctcaacttgagaagcttcaaaaaaagaaaagaagaaaaaagaaaaagtaggtgggaccggggagaagagaatcatggtacttaagcaaaaacattatccatccccttttctatttttttttttttttttttttgagatggagtctcactctgtcatccaggctggagtgcagtggtgtgatctcggctcactgcaacctccacctcctgggttcaagtgattcttctgcctcagcctcccaaatagctgggattataggcacccgccacaatgcccagctaatttttgtatttttagtggagatggggtttcaccatgttgcccaggctggttttgaactcctcacctcaggtgatccacccaccttggcctcccaaaatgctgggattacaggaatgagccaccacgcccagccccattcccttttctattcagaactaccccatttagattgaagtcttatcctatttttataatctcccagtgaagggcagaagaggcagccctctgcctttcaaaacttacttcattgtgttataatcctctctactaagcatctccacctctcatcatttgtcctattacagttttaagatcttgtatcataaaagaaaaagatcattatataaaattggaaaaatgtagaaaagtatgaagacaaaaacaaacatgccatggtcctaccttctaaaggtaataactatcaaaacattttgatggacttccttatcttttctatttatataaacacacacatatatatctgtacatttatataatatatccacatatccatatatgtgaatgtggctatcacatcagttgaaacagattattttatggcatagcctacaacaaacatatatatggttactctgcaattgttaattcttattaatgaccattaggtggtagttattgttttactaaataaatctgtagtaaacctgcttttccataaatctttgactatgacccttatttttctatgtgtaggattaatggaccaaacatcacaaatatattacagtcttctgctggttgataccaaattactttccaggaaggttttgctgtttagatgcccatcctcccatcatctgatgacactttttagtccagctttttctgtgaagccccggaaagcaagtagggctggaagaatgcgtgcacacgcgcgcgcgcacaaacacacacacgcgcatacacacatgcgtgtgctcacacacacacatgcacgcaagactgtcacaccctgctctggtggctgcccacatggaagaagtgctgctaactcctgaggcaagaaggggagacgtgagaaatccttcacatcccgagtctcagtggctaaaagtccagctgtcagaagtctgtgttctgagactgttggttaccatggcaacagaaagacctgaattagagccaggaatgtggagagagaaaaggaaaaacggggatagaaagccacagaattatcccttttgcttccaaaatattctgtgccctaggccgggcgcagtggctcacgcttataatcccagcactttgggaggctgaggtgggcggatcacctgaggtccggagtttgagaccagcctgaccaacatggagaaaccccatctctactaaaaatacaaaattagccgggtgtggtggcccatgcctgtaatcccagctactcaggaggctgaggcaggagaatcacttgaacccaggaggcagaggttgcggtgagcggagatagcgccattgcactccagcctgggcaacaacagcgacactctgatcaacaacaacaacaacaacaacaacaacaacaaaatatatatatatatatatatatatatatatatatattttatgcccataccatcccggattgaagaggattcctcttgagggtagaaggacgaatgcatggaggttacttctctcttgtcaggtggctaagatggttcccgtccttaggagatttagagctctaaataaggggcatgggtataaatacacacacacacacacacacacacacacacacacacatatgcttacaaatggcaaaaagccaagaaacacttatctgacctaaaagaacctcaacgcattggaatctatcaatttctaaagatcttttccaaatatttgtctccatttctgcttaacaagattacagttaaagtttgccatgactcagtctcacttttttcactgtagaactggcttaaattcgtttgttctgttaaataagatgtttaaggaattctgatgacatgatagaagaaataggcagagttatagttagaaagaagcagattctactacccaatagatgcagcctggcaggtacccacagactgcccacaacttccctgagtgattgtggacctggattaatcctggaggctgtttaagtcagaagtaacatgttccccagcatttattttattttgttttattattattttttatttttagagacagggtctcactctgttgcccaggctggagtacaatgatgccatcataactcactgcagcctcaaactcctggcctcaagcaaacttcctcagcctcccaggtagctaagactacaggtgtatatcaccatgcctggctagttttccctagcacttatttaacacttattatatgccagatcttgtactaagcactttatatgtgtcattttttaatcctcacagcaactcaatcagttaagtatcatcatatgccccattcaatagaaagaggaaccaaggcatgaatggttgtataactctctcacattccctgatcataaacccagaacctagattcaaacatagccagattcaaacataggtagtctggcttcagagcccatatcctaacctctacacactcttgtctcaggaggctgaccacccacctcctccctggaagattcctgggggaattgatccaggccgaaataaacccatgttctggtttcttggaagaaaatccgttgaggggaaccgcatgttctaaaagtacttgcaaggggtacatatggtatacaggactggctaacaatggtgtccatatttggggcaggccaaaatgagatttatttatttattatttatttatttatttttgagacagagtctcgttctgtcgcccaggctggagtgcagtggcacgatctcggctcactgcaacctccgcctcccgggttcaagcaattatcctgcctcagcctcctgagtagctgggattacaggcgcccagctaatttttgtatttttagtagagacggggtttcaccatgttggtgaggctggtcccgaacccctgacctcgtgatccacccacctcggctccccaaagtgttgggattacaggcgtgagccaccgcgaccggccaccaaaatgagatttaaaataagcattcagctttctctttggcataatgggatctggagtcgtctctctagctgttcataaaaagttggtgactgccttccagaactctgggggcctaaaaaacaattcataagtagcttcttctccatgctgctggagtagaggcggaggagaaactatgttttgtcattactcatggaaatggagcactttgaactgaatataaacatttaagaaaaaaatgatttcccagcgtaaaccaccaaagtttagagtgatcccgaggatagaagagcttcaaagggaggcagcctcagagaaaactttaaattttatttatttatttatgtatttatttatttatttttgagatggagttttgctcttgctgccctggctggagtgcagtggcatgatctccagctcactgcaacctctgtctccagggttcaagggattctcatgcctcagcctcccaggtcgctgggattacaggcatgtgccaccacacccggctaatttttgttttttagtagagacggggtttcaccatgtcagccaggctggtgtcaaactcctgacctcaggcgatccacccacctcagcctcccaaagtgctaggattacaggcatgagccactatgcccagctagaagttttacttatttgtaccatttctctatgatatatttgtagagatactgtattagtccattctcatgctgctaataaagacatacccaagactgggtaatgaataaagaaaaaaaagtttaatggactcacagttccatgtggctgggaaggcctcaaaatcatggcagaaggcaaaggagcagcaaagtcacatcttacatggtggcaggcaagagagagagcatgtgcaggggaactcccctttataaaaccatcagatctcatgagacttattcactgtcatgagaacagcgtgggaaagacccaccccccatgattcaattacctccgactgggtccctcccacaacaccagagaattatgggagctataatttgagatttgggtgaggacatagccaaaccatatctgatatattctctataatctgtgtgtgtgtgtgtgtgtgtgtgtgtgtgtgtgtgtgtacacaactttgaaaatatacaactcaggtagtgaaagtacctgaaacacaatttcttgctctagaaaaatatatgatcatttaggtttttctttctgaagcatcatagaaatagcaatgacacgcatcatccttaggatgccatgctgaggaatgtagtcacttctaaatggtaactccactttcacctccaaaagaaggtcaggggatttgggggtcctcattaacaatacggctcatgttaatttttttcttagggccttaattagacttgcaggtctagcttcccttggattacaattttacatcgtctaagtagtataagctgccttttctcttgaagcaagatcaactgtaataaagcttcttgaagttttagaaatgatagtatgttgtggatttataatgttttaggcctgaagccaataataactaagaattggaacacttcctaagatccatttgacttgatgggatttggaacctaaatatacagagtaggaagtttctaatttggaagttaagctgttatgatgcttaattttatgtttcatcttggctaggccatgtggtgctcagatatttgttcaacattattctggaggtgtccttgagggtatttctgtatggactagtatttgaatcagtagacccaggaaagcagattgcccttcccagtgtgggtggacatcatcctatccattgaggcctgagtaaaacaaaacactgagtaaaggagattttgcacagtccttccctgctcctggaatcagactggcacttacactatcagccctcctgcttatcaagccttcagactcagactggagctatacccttgggttttctgggtctccagcttgcagttagcagatcttgggacttctcagcctacataaatgcgtgagccaattccttaaaatctctctcctttctctttctctccttccctcctgccttccttccttcctttttctttcatctttctccttccttcctttcatccattcatttcctattggttctgtatctctacagaacctagactaatatagctatttatttttcattaatttaaattatgaaatactttaagcatacaaaaaagagacatcctgaacctgtgatgggatgcactgagggcacagcatcgtttctgtggtattcttgccaacaatgtataatctcaatcatgagaaaatatctgacaaactccatttgtgggacatttgacagagtttctgacaagtttcaggtcaagaaaggcaaggaaagactgaggtgctgtcacagactacaagagactaaggagaaggaaccactaaatggaatatgtgattctagataggattgtagaataaaaaaaggacattagtgaaaaaacaggaaattccaataccatctttgttttagttaatcatgctgtatccaagttaatatcctggtgtgatcattgtactatggctgtgtaagaggttaacgttagtggtgtaagctgagaggtatatgcataccctgtactatgtttgcaacttctctgtaagtctaaaattaggtcaaaataaagagttgaaagaagagctgggcacggtggctcatgcctataatcctagcattttgggaggtcgaggcatgtggatcacctgaggtcaggagtttgagaccagcctggccaacggtgaaacaccatctctactaaaatacaagaaattagccgggtatggtggtacacgcctgtagtcccagctacttgggaggctaaggcaggggaatcacttgaacccgggaggcagaagttgcagtgagctgagatcgggccactgcactccagcctgggcaacaagagcgaaactccgtctcaaaaaaaaaaaaaaatagttagaagaatacattaacatacagaaaatgatatgacaaacgcctgtgtacttaaatctcagtttggtcaagtcttagcattttgccatatttcattgtatctttgaaaaaaaaaacatagataaaacttaagcccccttttatttctttcctgaacaccttctttccctgcttccctcctgagcattattctgaatttgatgttaatctcgtgcatgtttaaatgctcttttacatattagtatatcattttacctttgaggacaaaaacttatggaaatttgaattaatacttagtattacagagtagtatatacttagtacttaatactactgaactgtacagttaaaaatgattaaaattgtattctttttcttttattaaagttatttttaattgacatgtttgtttatggggtacgatgtcatatttggatacatatatattgtggaatggtcatagcaagctaattagcatagccattgcttgaaatatttatcatttttttgtggtgagaacttttaaaatcatttctttcagctatttttaagtatacagtacattattattaactgtcatcaccttgctatgcagtagagcaccagacttattcctcttgtctaactaaaactttgtacctgttgacaaacatcttccctttccctctttactccccaaaatggtaaattttatatgtattttaccagtaaaaacaattaaggggaaaaaaagaaccaatgtaaatgggcttcaagtgatgctcctcagaaagaaggaagttgccttatttcaactgctttttttgctttataagaattattgtgacaaggacttccttcttccaaaccaaattcttagctgaaatatttataacgattatttttaggggcggggagaggatgggtatgatttcctatgctctgtttgcatgttcattcccaaacagatacaaccttatcaaggctcatgcacttaattaaagtggggggcaggtggtgaaaatagagtgttttggtgtacacaaggttaaactgcatcataccgctgccaaaggctacacactctgcttgatgctttcccatggttgataatttaattttatgacagtctctgagttatgtgttttcattctaatattaagttgtgcaattcagaggacctagattcgcctccagagtccaggactccctgcagccatgctgcctcttttgagaactgacctcagctgagttgtttatgcatcatgagttgacatagtccacagtgctaatagaggggaactacaggttccctctcccacaactttaccatctagcacggccatgaacacaacttacagactgaattctgccacacatataaacatttcatggccagcaggcacaaaaacatcacacaaccttgttctgtaagctcccaaactgctgtgcaacaggatggccagtagccacatgtggctactaaaatttaaatggaattaaacaaaaattgattcttcagtcacattagccacatttcaagtggttagtgaccacctgaactagtggctaccttattagtcaggtgaacaaaatatttatgtcatcttagaaagtcctgttggacagagctgctctagacagtccctgtgctctgtcctttggttggatctggagaacattgagcaaaaagtttcattagaagcagatgggacaatattctagcgtcaggattgggctaactttcttgacagcatgaggtgactaaatttcctccaaagcatctagaaacaggactgaagagagtcttcagctgaggacaccatttccccctccctacccagctttattgaggcataattgacagataaaaattgtatatatttaaggtgtacagtgtgatgatttcatgtatgcatacattgtgaaatgattaccacaatcaagtttattaacacatattaacacatctatcacctcactgtgtgtgtgtgtgaaatctatattgtagcagatttcaagtatataaaagaatattaactgtagtcaccatgctgtacatcagatccccagaacttcaaggtctgagggcaccctttgaaagacgtagacaactgagctagatagactcttattttcaggttatgcaagagtggggaagtctacaatacttagagcccattatgaacactgaaaaatcatttgcagcattcattattctaagtaacaaccctctggtattcatcagagataaacatggttgacttggttttctgtttacatgagcttttgattagtcattcaaatgctaactaccccagggtataggttaaaaataattactacccttgtatcacaaaaatacccatgttgtaatgttttgaaaaattgcagacaatatgactgcctgtgtatagatagcctcatttagtttttgcaacaaccctttccagtagaaattgcaggtattaatctcatttttgtctctattgaattctccaatatgctgtggccaggctattgcatgatggaaccagttgctaaagaaattcaaattgttcgtatagctgccaaacatacagcctttcttattgtattttataatgtcaaggctcctacatactttgggccaagcctgatggtgcttcatgcaacaccaaatacaggcaacctacagtcctctcctcgctctctgttggaatattttctgtatttttcaaatcgttattaattcagcaactgtgtgcataccagttgagtgcctatcaggttccaggtgctgcatcctgccacttctagctgcagcaggttcatttttaacctggctttgctgcatctataaaatagagatgataatgttgtctttgcagagtttttgaaatgattatatatgtgggatgttctgtaaatggtttatttttattgcataattgaggagacaaactccttcctctcactttccttggcaatacccttctgggaaaaatgtttgtattttattctaaaatgtcagacatagactactttccaaccctgattccatatcaaaatcatgtgtgcacacaataattatacttggatttatgtgattatctgactatctcccccactggattggagcctccaccagggcaaggtggatcgaattcattctaggaagtgtcagcatctgccaacatggtgcctgaccaacaaacccctcctggattctggccatcatggttagggaaccaccagagttagcatcctttcgcaatgtttcaattgcatgagagccacactggagaccatttctagtgcatctctagttggggtggaaatgcccagaagggatccttttgggctaagcagaggtttggtgaaatgagtgtcatctaatctggatgttcagagccaacagttgttcttcttttggcaccattctaaattgggtagacaacccccttggtgggaagaattttgcacaaaatatgtttgtggggaaggaggagagacatagactccctgggtactgttacttacatcagaggaaacaagaaagtacagatcaaagagcagagttggcattttactacttatccttaaaggactagaagtcaagtgatcaaaatgtgaagacctttgttctagttctctaggggactataaagaaaagtggggatggggtggaagtaagaggtggaaatgctcaaggttgattctctaagtggaaccccaagggttcagaggcagactgactggcgtccagctccagactaacccagttggagaaaatggagataggaggtagcctacagtgtttttattatattatggaaaatcagaaagatgatatatagtatctgagtgagtgaagaatgaatgtaaatagcagtaaatgtgaatgcctgttataattaataattaactttaatttaattagagaattgaggatgagcagaaccgcaacaggtgagcctggattgcagggtggggtgagatgagggttggatgtctcttggcatctctttggctattctcatcagtcatcacagagttcccattagtagacctgcctgtgggccaaaacctcctgcctgtaaatgattttgctgatttagtgctttatatttctgtccatcctattcttagcataaataaagctttctctgcacttccctgaagctaaataaaattaagctatgggaggctccctgcctctcgcatggatctcccagagcatctgtgaatagacgctgttgtgtgtgcacacaatggtctccattcaattaggaaccacttgtgtacatctcctctaggaagagagctctttacctatattagtctgttttcacactgctgataaagacacacccgagactgggaaatttacaaaaggaataggcttaatgggacttaacagttccatgtggctggggaggcctcacaatcttgacagaaggcaaggaggaacaagtcacatcttacatggatggcgggaagcaaagagagagcttgtgcagggaaactcccatttttaaaaccatcagatctcatgagacccattcactatcacaagaacagcatgggaaagaccccctccatgattcagtcatctcccaccaggtccctcccacaacacatgggaattgtgggagctacaagatgagatttgggtggggacacagagtcaaaccatatgattacccagaaagcatttatggtggcctaccagcttgggaagtggttaacgaaaatgacattggttaatgaaaactatagtcaaggctttgaaaaatcttgtaatgtgaaaacaactttaaaaaattataaaaacaatacagtatgggaaaattagaagctataagacaaaagggggcaatattttttaaaacctaccaagagcaaaactttagaggtagaaattagatcagtggttgccaggagcccctgggggtagggaaatggtataggctgcagaagggtaaggggagcactgtgagggacagaaataatccacatcagcactgtccaataaaaatgtaatttgagccacaagtgggaaccattaacttttatttttctataggtaaatttttaaaaagaaagagacataggaataggtaaaattaattttttgatgttttatttaacttaatatataaaatataatttcactctaaaataaatataaaattattacatatttttgcactttacacttatgacacatttgattttgtgctggccacatttcaaggagccgtgtgtggcaggtctgtgggccacacaattcaacgcagttttggtggtggtttcatggctgtatacatttgtcaaagcctatcaactatatgtcttaaagagtgacttttattgtgtatacagtatatcaatttttaaaaaattcctgatagccattatgagccaatgtatgttccatccttatattaaaattattgtcttgaaatgaatgtcagaaatgcaatttgataattccattgtcaaattccaaaataaagttaagatcgtacattagaatcacctaaggctagtaattttcatagacttcatgggggtgtgggtgtatgtgtgtttccattacacagcttagtttagaaaggtctagtgaaaatttaattagacattgcaatttaataagaaaggattaataattaattaataagaaaaggatttgcatatgtttggcaagataaagatgaacccaaattgctttgacaaagacagtgctattttaagaaagcttgtcattttctcttttgttttatggctacttctcttgcagcagtattaaaaatcactgtctcttgacttccttctgtttctattgtataatgtgttttgcagtaactgttttgacagtggatctgtctgcaggcatttttggggtatgggggaggatgagttctcatgtacccacttggtaagagaaggttgtcggggagtaagtttaactttcatcactaaagctaggaaatttttttagctctacgactgtgtgttagtagttacaaataatattgtttgccatttgatagctattttgatgttttctttttttccaccagaaagtccatgtttaagttttgctgatgcttacataaactttaacaacttacaaatgaatacatccaggagaaataggccaaaggatatcttcgaaatggttttgaagcccagatgtctgggccgaaaataaacagataaaatttgttagggttgaaaaatcaattccgtaagtttgggctggggaagacccaactggtaagaaaattatcccacaatattcatagactgaatcttagagtacaaaatgtgatatagttgtttgagaacttcataacccgcagcatacatttaacaagtgggccacagattaggcacaaggtaaacccttatcaggttatttcaccttagcttagagtttagttcggtgctctgttagttcaagaagcagttactccatccgtacttgctatcaagatgaattttatatatagcaatgaaaatcagatttcaatgtgcattgaaaatgcaaatccctgtgccccatttgtaggaatttctggtttattaagcaaagaatggggcctagaatctgcactctcagcatgcattccatgtgattcttatgccagcagactccaccctgaaaaactctaatcttcaacaacctgttaaacttttactaggttttctgtacagattaggcactgtgataaattcaaacaaaaggcaatttctttgtcatgaacatgctaacgtaacttacaaggtggtatgctgggagtggtacagccagtgcaaatgggaaggagctcagagccaggggccaatgccaccaacaattgattcaggtgtacaaaagtgcatgtccacctcgtgggaaatagcatgagctccaaaagggagaatggcattactaggggaagcagctgcacttagatatggactgcaatgttgttgaagcacttaggaaattttaacaagaaaattgactatgacaattaagaagcagatgtgaaagaaatgcatttgatcattgtcagagggtcttaaacttgagtgcacattagaatcacctggaggacttgttaaaatacagatttctgggtcccatactcaaagttcctgattcagtaggtgtggggtggagcctgagaatttgcatttttctgacaagttctcaagttatgctggtctgggggccacactttgagacccactgctcttaatgaatttggtgtcttgatttaccaaaaatccatagatgatgatgacgggtgcaaattgttgcggcaagaatggggaagcgatgattatcagggtgtgaccttgaactcccactcataggctatgttcctccccgcttttttttccttctatgacttttttactctcagagcaactggtctaaccaaaaatactctgggggtggggacaggaatgtggctatggagaataatttgagaactataaatcagtttttttctttcctaattgaggtttttattggttgtgttgaggatcagtacacagacattccaatttgtacaaaattatgtactgaaactctaaaaagctattttcattctttttaaattcattgcagttctttttaaaagttattccaatgactctccagcttaacatttggaagcaaattttccttaagaggatatcaagtactagtatcttcaaatgttgataagctgttacatatgtcataccaattcacaatttaataacatatacactcaaatttcagtctttcacagcataatgcatttaggaaaacaggactaccacaaacaaagatgctacagacagcacactgttctgacagggggagccatgaccaaagagtagtattttttaggaaacaattctactaaaagccaacatgaaaatagaaataatcacaaatattcgagacattaaatgcaggactgtgactccatattgccatttactgtgctttctgttataggatatggaaactaatcccccatctttagaatgttaagcggactcccaagacagtcaaaacctgccataattcaatatcccacactattttctgattgtaccagaaaataaaataaacaaccagcgaatgatttcacctcttaagtaaaagcatttacccttaaaaaatgggtgagttaggattccctccttcttaaaaatatttctagaactactaaaaaacttgcatttacaaaatagtagataaaaatattcctctggattgtacaagaagggagacagggacaccgataaaacatagtgtatgatatcagtcagacttagtgtctttctctgtggcttcatccgaggctggactctccttgttttcagtgtctccattttctgcagataaatctttagtttcttgatcagccacttcagcctgtttttcttttcctcctttttctgctttcatttgtttttttgttttgttttgttttgtctgaagatttatcctttcctgctgcctttttgggctttgtttcgctttgaaggagcaggtttagctgaccaccttgcagatctcttcttcggggtctcccttcaccgacacttagctgagctgaccttcctcctggacatcttggcggcatggagggtgtgggctgggtgtctgcaggctgtggtgcaccgagagccttcccgaaactgggctgcctggccacagctgctgcatccgagaactacaaatcttatattcagcatgtagccaagtacttctaaaactctgatcagaactgcatgtctcagattttattttagaaaaccataggtatccactactttatagaagtctcaaatctaaaactgtactcatgacgtaaatccccaaacttgctcctcctccagtgttctttagaaatggcatcctcatctgctcatcttttcagtaccacaggctggcctcatcctggacgtcattccttctctcacacactttcattcctgcatacagtcactcagaaagtcccatcagtcccatctcctaacatatgttacatctgtctacttctgttgccttcactacctccaccttgtccagtctaccaactcccaactggctcttcccacatcttctcgggatcccttctggttattattgtataagacgcagggagattttttttagaaacacagatcacatcaagtcaaccctgtacttaagacccttcaatggcatcccactgtttttaggataatccttcagttctcaaaatggtcccatgggccctgcatgacatggcctcacccacattttcagcctcatttgcagccattttcccttttgttctctacactccagtcccactgactgtttcacttcctgaactaaaggtgtttaaacccactgctcttcactgagataatcctagatgaatatcccaggggtatccatggagaagagggtgaatgtgacacttgcagatgacattcttattgagattaaaactgacaaatggccccagtctattgctttttgaaaacaaggtcttgggggaaagaaccactacttgtccttagcgagcctgtgcaatttagaaaatggtgcccctccaggtgaatgcagcccccgagctgtgtggattggattttggtgtctgtgcacccagggtgaggtactctgtgaaggacatgacctgcacagccagaatggtgactttctctggagatgtcagttggtttgcttccaaattaaaacaggtctaaataggtttgtcttatttagaagctgaacgattatggacaacttctggaactcccttgtagcccagtagtgattttataataataattaatatgaaaagcttttaccatgaggctgtaaaagttgttctttgcatgactaggatgacattgtatgtttgcctttccaagccagcatggttgtgtctacactgctagctctgtagctgtttttcagagttgaagaccaagtgtgatttacaacccagaatgtctctagctgctggcatctaagtttggcactgagcacttaaagcgcccagactatggtgttttactgtgtggaggaaggcctcattggagaggcacaacattttttcatctgacatgtttgctcttgtggaaatggcttgaattatttgagtcctggcagcagaaaacatgggaggagacttaagtcttgctgagcatgaatcatcctatacaaattaaaactgatcacttttaaaagcagtttcattgctagtataaaactatccatcaatcattagattgctttgatgtgtatatcatatatctgtgtgtcgctgccaggatcctagcatgaacctctccctgaacaaacactgaataaatattgctatgattttgcttattacttatacttttgtctttgacttagacacagtttagtttctcgtttttaactccatgttgaatatgagttcagttatttttctttttttttttgtatctatggaagtgcctaaattttactaggggtgaggtggggaaaataggaaaagtatgaaaaacaaccacacgtgcacaattcctttgtaatttcaaactttaatggacactctctggaggtcattgccagatctctcagcaggaacagaatttgaatctgggagcaagtaatcactctgtaaatgtttgttatgatactggaattgccaaatatgctatatctaattgaatttcattactggggcatgaaagacagttggttgaatgttgtcactgaaaagaatatattgtggccagcagattgttgcctatatagcgctgtagctgggtttttcaggccagctgcactttgaaaagttctggatgctgaaagtattggaaaggttgggtccttctgagggccaggagggaaggatctgttccaggcttctccccttggcttgtacatggctgtcttcttttgcattcacatcatcttgaattttgggcacatatttctgtgtccaaatttcccctttttataaggattccagtcatactggaattagggcccatccgaataatcttgtttaaattgattataaagaccctatatccaaataaggtcacatgctgaggtcctggggcttaggatttcaacatataaattttgaaaggacataattaaacacatcacatcatccgtagttgaaccgcaacacaaattagcctcagaaatcaagctgtatttattttgtgttttgtttttatttgctttttagctatacttattttgtaattgtctataaactgaaccagtttccataaagtagttgaattttatttctttttcccagatccgacccaccagagggccatggtattggttctgcagtcaacactgtgctctctctctctctctctctctctctctctctcatttgtttcatgagtcattaggccaaaaaatgttaggtaaatgaaagcaaatatgacagcagtaccttgaacaaggggaccacgtctttccccctcaagtccatgacgtgtaacatgtctaatattctagttctgaggattttaaatgtaattcgttgatctgtagtgtgctttcactggacaccttgctttagttaaaccattcttgcatatccttcattttccacattagccttgtttagttgtgcagttttgacattcatagctctccagtgctttggactgaatgtttattgcaagaacttgcagctgactttctatcaggtcattctgatgttgtccagggatgccgtcagaggtacaggttcttgaagcaccttttatgctatcttccttttctactctgggcctttcccagtttctgggaggtcaaggtatctgccaagcctctctctctgcagcacactggcatcagtcatacttgtatgctccatctgtactttattggtgtttttttttttttttttttttttgagacagggtctcactctgtcacccaggctgaagtgcaatggtgcaatcacagctcactgcagcctcaacctcccagactcaagtgatcctccaagtagctgggatcacttgatcctcctgaatagctgggactacagatgtgtgccaccacacccagctaactgtttgtttgttttaatagagacaaggtctcactatgttgcctggctggtcttgaaactcctgggcttaagcgagcctcccgtctcagcctccgaaagtgctggaattacaggtgtgagccacagcgcccggctccacctgtacttcaaaactcaccccactccctgttcccgcagcacgtcatgtgctaatgtgactgctatgtaccctcttaggcttctgggccctgaaatacaatcctattttgttccccctatcctaagagatcaggtggaatggaagattttctcccttttgtattaaatgggtcaaattttgtctctcctcaagtatattccaaaatataagtaatctgttaataaaacgtcttatcccttcagaaaacagaatttagggtgggttagataatacacatcatcatcatcatcatcatcatcatcatcatcatcatcatcatcatcatccatacctctctaagcctgtagcagggtggaatagcatgagctattgattgtatctgagcagaggaatgcctggtaccccatctctccagaagaaattaggtggtttgagagcatctcttagatctgaataatttcagtgccaaagaccaaaaccccttcataagctgctattagactctccctgattgccatgcctggcttctgttggagacaatcctagaggaaaacagaaactcccaaggagctgggtagccaagagaggagcccagaccttccatcttccatctggtgacctgatggttctggcatttgacctctctgaaggtaagaaaccttggatattacacataaattccaatatctgaattgacagaagtactctctccagggtagatatgctatcagagcttagatgtaaggatgttttaaaaatttcattcagagatcaggcacagtggctcatgcctataatcccagcactttgggagaccaaggcagtggatcacctgaggtcaggaattcgagaccagcctggccaacatggcaaaaccccatctctactaaaaatacaaaaattagcagggcatggtggcatgcacctgtaatcccagctgcttgggaggctgaggcaggagaatcgctcgaacctgggaggcagaggttgccatgagcccagatctcgccactgcactccagcctgggcaacagagcaagactccatctcaaaaaaaaaaaaaaagaaaaaaaaattcactcagagacctgaagtgtcaggcccagcaatagttcagtagttctttggcccttgatgtcagtcctgtgagctagctctccagcacgagggactttcttgtgtttagtttcacctcctctcttcttggggtagatcacaatcaaatagctcccatttccatcgtttgggaagacaatgaccttgccttccccacacacgtccatacagcactgctcctcggactccacaccccaggtccagaatagtcagggtggctactctaggactaatctctcttcctatctcctggtaaaatggttttagcagacatttgtccctggcagctgttagtttcccctctcatcactatattaagacatccttggccaagcatggtggctcatgcctgtaatcccagcacttttggaggctgagacgggagaatcactggagcccacaagttcaagaccagcctgggcaacacagggagaccttgtctctaccaaaaataaaataaattagccaagtgtagtggtacatacctgtgattccagctacttgggaagctgaggcaggaagatcacttaagcccaggaggttgaggctgcagtgagccgtgcgtgattgggccaccgcactccagcctgagtgacagagcaagactctgtatttaaaaaaaagagaataaaagacctcccagcccacgacttctttaactttttgcttacacattgaggccttcagcaaattaagaaaaacttggtgagctcctgaatagtgatgctagcctcagcatgtacaaaggagtcctggagtatgttcatggttctgcttagcttttagaacagacctccttttactgccagactcctaagctactaatgggccagttgtcagggatgggtataggcagagagagccggtctgcagatttttctactcattctctgtcaggtgctattttcaaacaggcagaaaaagaaaggacagcctgcaatgcaatagagctttcctttgggaggaattttttcaataaaaaaaataagctatgacaggttttacgtcaacaaagaattgttatataaccggaatcaaagattcttgcatttatattgaaataaatgttagggtgatttattttccacaacttcaaaatgacaattgctattaattaattaatgaaacagaaaaattccatgctaactaaaagaagcaactggtggtatttgctggtattaatgccttctagttgtaagttggctatctgagaaacacttcttgatttggttcattaacccaatgaatgaatcatgaataggagatccagccacagaaaactatagttcctgcaggcagatcctaggaaggtttgacaccatgggggttctgagcttgggctgctcaccatatttattgccactctttagaccccgaaagcctcagcagagtgtatatctcttaagatcctattatccagctttaactccctttacaaaatccaggaaattatacaagttatttggaaaattcccgtgtcgcatgttttcagtaggatgttaagacgttaaaaaatggcactccaactttgtgttttgttgtataatagtagaagagaacaaacaaagggtaacatcaaaaagaccataatcatgcatgcaaaatgcatgtccacacccaacagaggggtgggtggaattcaagaccaatttgtgttggattccaagataaaaagggactaagtggatgtgcctgtgtttcctcaaggaggaatttatggtatttactagcacaaagcaatcacttaaaagttgagtcaaatattcctgtacttgcttataggcatagtctataataaggtaatgattcatctagttccaacttcacagtaataatcttgggttatagatgtggaaaaaggattacatttatctggtttaatctcattttacaaacaaggaaaatgaagcctggaaaatttgtttgagcaatatgctctgtaacatctcataactcccagtggtatcattttccacaaaagaggcagagtagagggaagaaaatggtgtccacagggcagggtcagggaccagccacactccaatccctgctggtgactgccctcagccatcctggtggcctcagctgagacccaagccctcccccaaaagaattgtcccaggataactcagatatcactagtcatctggcggataaaggcaaagtttgcatgaaagtggcaatttgggggagacatttaaatgtttccatgcctcattttcctcttctataaaaagggaataatagtatgtttgttctaaatcgcttgggtacttactaagcacttaataaatattagttgttattgttttcttttttccgttctcaattcttttccctctctgccttcctccctcctcttttccctcctttcctttttataccccatctgcattgttttcaagcataatacatagggcatgagagatatttttctttaaaaatctggctgtttttgtgctttcttcccaaaatttccagaactcagttttatcagtatattttgagaaccccactggtggacatttaggttgtttgcagatttttttttttttttggttctgtttgaatccctcctcttctactttgtagccctgtaatctcttcaagagatgatgatctttgatggcattttgggggtgatgttcaggtggcagccagattggaggggaccgtggagcagactgtgtgactactcattccaagggcatcattgtggagagtaagcactggatcgtaacacaggaagggtgagggaagtgtctgggagtgttttttgtttgtttggggctgggatttttagatccagaaggttttcaacatatttcttagtttagcagaacgaaacagaggaatggaagagattgaagatgtaaaagagtgaaggaataattgtctgaaagcttggcatgagatcaagaataaaagggcggagactcttcctgtgatggaaggccaggggccaagaacagacaagcaagtctacaaaggagctttagatagagggttccccaggattggctttgagattctcagtgtggggggatctggagtaatctgctgagattaagtgttggaggaataggaacaggttaggggagagttttataggaatttttagagacagccattatgagaaatgtgacagggagggaactaatgatggataaaaggattcttgagtaacattaagtgcccagtcaagattagacagcaggcatttgaagtggagccaactcaacttcctctggctgtgcttggtacagctaaatcaagaggcagcaagatgtttcatgtggaaaaataaatttttaacactctattattctttaacggagggcaggaattgaagcatccttatatgaagataattcaaagacatccaatagaggtggcataaataccaaaaatttgaaaagtatgttgttccgcagccttgtttttaggctcaaataaacaccccattaagtagaatgtataccccgatcacttagaatactcaagtttcgaggtgccacttaaaaataaggcagatgctgtacttagctagggaaaaggtatgtctcttggcaggtgggatcccttcacctggtccacaagatggacttaattggaagcaaatacagaattggagacggtcaatcaaatggaagctcctcagttcctagatcagtttctggtacatggtaggtaaatgagaaatactttgtgaataaagtacaattgtcccttggtatccatggaggattggttctaggatctcctgaggatcccaaaaatccatagcggctcaagttccttatatgaaatgatgtagtatttgcctataaccttcacacatcctcccgtatatgttaaatcatctctatattacttagaatacctactacaatgcaaatgctatataaatagttgctctactgtatttttaaatttctttttttatttgaatattttaaatctgtggttggttaaattcatagatatgaaattcatggatacagagggctgactatatatatgtatgtatatgagtaaatgtataaatttattcatgtcactttggagcactagtcctatgagacatagtaaaatatggaaaatcctgactatattgatcatttagtagtcctgcccacgtcattcaacatgtagctgtggtaaaagcaagttttcaagttcctgtcaagacaactcaacacatttactctcttctgcttctctgcctccctcattccctctctcctgaaagttacgggttgtcagaacttttattgaaatgaaaacaaaatctaagttgattctctaagacatgaaagagtcagagtctaacaagtccattaatattctattctttcctatgcagtactgcaaagcatgtttggtgatgataaaggaatagttttgttttgatggatacaaatagttgttatttatttcatgatcaccatggtaagtgtaaaccaaaaataaaattccaaccacctgaatggacccctcctctcggccaagggcattccaaagttaacccgaaaaactagtttaggccgtgatgggaagggggagcccaacatgactcattattccctcttcctttttggaattactgatagaataatcttttaaagtctgataagaaacattgacaatctattctctgaagcttcctacctggaggctttatctgcatgataaaaccttggtctccacaacccctcatcttaacccagacatccctttctattgatagtaagtctttagataataacaactttttcaaccaattgccaatcagaaattcattgaatctacctataatctggaactaaccaacctccctcccccaaattgtgctccctttctggactgaaccaatgtagatcttacatgtatcaattgatgcctcacgtctccctaaaatgtataaaagcaagttgtagcctgaccaccttgggcacatgttctcaggatctcctgagggctgtgtcacaggctgttggtcactcatgtttggctcagaataaatctcttcaaaatattttacagaatctgcctcttttcattgccatagacttgatagagaaattttaagagtgggtctttagtccttaaaaagctcgatctagtagagacaacattccaaggacctggttaagtgaggctgcttgccagagatacactttttccttagccaagtataacatctattagagataaccagtggttccatatggtacttggtaacagaggctgagagagaatgggtgtggggagagacaagtgctataggagtacttgatgatgcggtaatcttccttgagtattctgccatgacattcagtttttatatacgagatccaggcacagccgtcactgggtatccacggggagttggtcccacgacctcccacagatatcaaaatccagagatgctcaagtccctgatataaaatggcatcgaatttgcctataacgtaagaatatcctcctgtatactttaaatcatcactagattacttataacacccaatacaatataaatgctaggtaaatctttgttgtgttgtttagggaataatgacaagaaaaagtctgtaaatgtttagtcacagacacatttttttttcaaatattttctattcatagttctttgaatccactgatgatgcacccacagatatggagggctggctgtatttcatcaaatttcagtgtaaaggatgacagggtaatgactcacccagaagatatttttatagttcctcctgtttccttcctttgatggatgagggaaatgctgtcatactcagaagttgagagtgggcagttagttgcctcagtaaatggccactccatcctcctatggcttaggccatagtcttgagtttgtcctttctcccaaatgctatatccagttctgttggcatttacatcaaaaatatacacagggcaatagaaacgttgctgtctttgttaggggtatgttacataggtgtatgtatttgtcagaacacatcaaactgtgcagtaaagatctgtgcatttcactctctaaattataacttaattcatatgtgtaatgcatcctaatatgtatagtaatatacattttgtattcagaatatatagcaatatgcgtttatatatatacatatatatttactatatgtgtattcacacatacatacattttatatatatatttacatatatatacacgcacatatttactatgtgtgtattcacacatacatacatagctagtgtcccatcaccatctctactgctcacaccctgacccgagccaccaatagaacacctctcatctgaattgttgcagttgttttctgactgttcttgcttctacctctgtcacccctgcagtgtgttcttaggaaggatacttcttaaaacagaaatcagatcatgtcattccttggctcagaaccctccagtggccttccatctccatgctcaattgaagtcaaagcctggctgccatggaggccccagattccactaccccaccactcccaccacgccttctgtgcctctgggaccacattccctactaaccctctggctcaccagcttccggcccactaacctcaaacatcaactacatgaagctctcccttctaggggcctttgcatttactgttgtttctccctggaagctcttctcagatatttctgtgactttctcccttcactttcttcaaggttttaatcaatgtcactttatcagtggggccttccatgattatctgatcaaaacttttaagtgcctgccattccctttctgcacaaagagctggcacggtatataattaagaggatgcgctctgctgccagactgtctgacttcacatcattttctagctgtgtgacttggtgcctcagtttgatcactttctgtgcctcagtttgatcaccaataaagtggggataagtattgtgtccttagggttattgtaaggattaattgaattgatatatgaaaagcactaaaaacagtgcccggtacagagtaagctaatgttaatgttattcctcttgcttgcttcgttatttttcccataacacttatcaatcaccttctcacctgctatatatttaaactgtttattttttgtggtttcttgccgttacaatgtatgcgccatcagagcaacaactttttactttttttcctcttctattttctttctttttcttcactactgtaccttcatcacttagaatagtgcctgatatgcagtaggtacttaataaatattgtgtaatcaatgggtgaatgagagaagagtctgtgcactttcaggaggctgtaggataaggtaggttagggaaggggctggaaacattttctgcaaagagccagatagtaaatattttaggcttcgtgagttacaactactcaactttgctgttgtggcatgaaagccaccatagatgatacgtaaacgaatgaatgtgactgtgttccaaagaaactttataaaaacaggcagtgggctagatttgaccataggtcatagtttgccaactcctgggttggggaataatttttggctttactttcctccttctcattactcctcccttcagccagcaattagtgctattcactcagaactgaaatatgaataatttgaaaagcattacattaccccttagtatttggctcagtattcgttaattgtacaaattttccatatgtctcttaatattgtaataggaaataacaatgttaagaatatattttgaagtttcagggctctggttttcatttctcttctcccacagccgaaaactggtaattctggccaggagcacgtatgctataaaggaacaagcagtgttggcattcctcttactgtatggccaagagtgtaactgacacccagttggaatagaaaccaacagaaattacctacaagacaaactgttgagtttataagattatttataaaaacttattcctccacaaaactgtttccttgcccacagtttttaccactcttcccaatcgattttatgtgctcacaagttcttgcagctttttaatgcagtgagtttttgaccatgtgacaaactgaaactttaacacaaaatatatagcttttattgttgtaattaaagcagacctgaaattagactcattttgctgatatgatccattgtgattagacatataagcagtccaactacgtgactgcaactgatgtgaatttgacgcaaccagaaatggtttttgtgtcacctcttctgaacttagcagcccatccttattgtcggtgctaacagttttccacttgccgtttaattgtcttcatcattttatatgtgtggaaagagaacagacctggaccatcctccccatttgttggggttttcttgctccctgtgttgcacctttttacagctgtggtccagggctgcagtttccaatcagagtgtgatgtaacctactcccaagacacctggccagtttgcccccccagagcagtgctgctcaaaccatctcttgggaaagaccattttgtttttccatcatgaattgattcattttctaaaattcaatttaaaaagaaaattgagttgccagcagaattatcacataattggatatcacagcaaggccaagttgcgatgtaatttttaaaacatttattctcaatttctgtacttacagtagaccggtaacagtttgtgcaccagctccagtccacagaccatattctaagcaatgccacttcagtggttttcactccagtggttttcaaacgtttttaacccagtataaagtatgcattcgtaggctgtaaaacacatgaatgtgtagacacctgtgcagacacacacacgcacatactctgaaaccactggaatgtcagccccctaagggcagagcttcgcttttcttggtctttttcactgttctgcgtctaatacctggcgcataggaggccctcaatcaatatttgttgcaggtatgtgtgtgtgtatgtgtgtgtctgaataatcaaatcaaaattttcacacgataatgcttaacctttactcctgatgaaatagccttttgttgtctatttaataaaaagaaatactgattttagtctaataattctatttcagtacattctaattttaggagtcgtgacccatggtttataaaacattcctttagaaggtgctcatgtataggaatttattattcttttcttcttcacaactttgagtagctgttgctcactcctgtcttcctatgggtatacatatcccagaactgcttatatctaggaagcagtccatgtagcctgcatacattaggttggtaggcctgtgaaggaaaatagagatagatgagtctccaggttttaaagagttaaaaagaagggaagaatgaggttagagttagagtgggtagagcaataacaagttgaaacagacccgctgatactcctccataatactggggactaagtttgcaaactcttaggaataatgtcattccaaaatagtacaatgaatttgattcgcctacatctcaaagagcatgaaatttcagtttttaagattgtggatagcaaggctaataataatgatcgcatttatctaaatgtatcttaaaatttaaggtcatggctcggtgcagtgtctcacatctgtaaccccagcactttgggaagccaagggggaaaggattgcttgagctcaggagtgtgagaccagcctgagctatatagcgagacctggcctctactaaaaataaaaattttaaaaatcagctgagtatggtcgcacccacctgtggtcccagctagtggggaggctgaggtgggaggatcacttgagcccagaaggtcaaggctgcagtgagccgcgatcatgccactgcactccatcctgtgtgacagagccaagaccttgtctcaaaaaaaacaaaacaaacaaaaaaacaagtaaaggtcaagatgtagttttctggcttatgcagctaagaggaaggtgatattatcagccaaaacagggcatatgggagccaggatacttaagacatcagagtgtgtgtgtgtttgcggagccactgagtcatagctgcacacagcaagcatttggtgtccaccacactagaagatgcggagcagatagcagaaatacagtctgttttcaaggagcacacagcttcatccaggagacaatcactgtaaaatcagggctgtcatggaggtggcggtcaggctggccttggaggaaagaatgcatgacccaccttgaaaaacatgtgtcccaggacaaagaagagggtccaagcagtagggggatcagtgcatgtcatggcacagaggtgagagggcagaagtgtcttctaaggagggcatgtctttgcagtatggtgggaggccggcagtcctgtacatagtttatggtttggattagaaactaccaaatgagtgagaggcatatgtgggaacaatatggcttttagactcaaatctcacttattcagtgaccttgaacaaattcctaactcctccgtgtagtcataacaatagctagtaagagtagatatggagaattgcagctttctttcaacttgtcacaacttatcacaagatcttcaaatctactgacatttaatacacatcagtttttcaatagcagcagcatcctttattcgagaagtaaaagatcttggcttattgtatgaaacttttcatcaactctcttctggttattcctaagcattaatagcagagagccagaaggctcatttccttttacctcatcctattttcccttgctgcttcatttacttgattacttactagctttgcctctttgtattttgtggcgtttcattttagtgaacaagagaagtaacttttactaatgtattgtcattaatacgccctcttttgtactctgccttacaatcctctgtgagtggctgttccatttcctgaatagcgtgtgcatgtgtgtgtttgtatttgtgagggtggttaaagtaacaagtgttttattatttggtttataaatatttggtgagcccttagtatgcttgaggttatgatagagaaataaaatatctaagacaatatgtcatggttgaaggtgttgaaaattttgtggtttaaatacatggatgaaaaaactgaaacgttttattatggaaagcttcaaatatataaaaatatagataggatacccaactgggtgcagtggctcacacctctactcccagtacttttggaggctgaggtgagcaaattgcttgagcccaggagttcaagaccagcctgggcaacatggcgaaaccctgtctctacaaaaataagccaggtgtggtagtcccagctactagggaggctgagatggggggattgcttgagcccagagaggttgaggctgcagtgagccatgtttgcgccactgcactccagcctgggcgataaaatgagactgtttcaaaaaatatttgtatagatggatagaatagtatagtgtacccctacataccaccacccattttcaacaattatcaacttatggctaatcttgttttattaatatctttacccttattttattctattttattttaaagcaaattccaaatgttgtatcattttatccatgagtattttgtaacttgtctctaaaaaataaggactcaaaaaagataagtataatagcattattaataaccttagaatgacagtaagtccttaatatcaaatacacactgttcaaatttccagttatatcatccattctatacttattttacagttttttacagtttttttttttttttttggagacagagtcttgctctgtcgcccaggttggagtgcagtggcactccaatctcagcccactgcaatctcagcctcccaggttcaagtgattctcctgccttagcctcccgagtagctgggactacaggcacataccactatgcccagctaatttttgtatttttagtagagatagagtttccccatgttggccaggctggtctcgaactcctgacctcaagtgatctgcccgccttggcctcccaaagtgctgggattacagggtgagccactgcgcctggccttattttacagtttgaagcctcctcaggaggggctaaggtgggaggatcacttaagcccaggagtttgaggctagcctgggcaatatagccagaccccattttttaaaaaaagtattgtaacattagatatcgcccctgctgccaacatcccctaccttttctggtttcgccacctcccctgcccttgttttgccctttccaagtgattctgaattaattttctagggatgttagagcagattggtggtgagaagggctaatagattggggaggaaaaaaacatgtgatgacagatacagagcagagaaacagaaaacaaggagggttgtatttaagaatctctaaaatgttgcacgcataagtacctatagtggttgaggtttaaagggagaggttttttgaattaaaacctgaatggcttcttcggagctgttatttttggatgtaaagtaagaagctgaggcgtggggagaggaattctgcccttatttaccttgtcagccaattcccacctcatctgggcagggcttgttgtcccaaggaggaaagacaggcctcagtgtgtgtgagtctagtgattgagtgcgcctcagagccagtgggagggcttggaaaaacaccgattgctgggcctgcctctggtgtttctgattcagtagacctagggtggggtctagggatttgcatttctttttttttttgagatggagtctcactctatcgcccaggctggagtgcagtggtgcgatcttggctcactgcaacctctgcctcctgggttcaagcaattctcctgcctcagcatctccagtagctgggactacaggctcacaccaccacacccagctaattttttatttttagtagaggtgggatttcaccatgttggccaggctggtctccgactcctgacctcaagtggtctgcccacctcagcttcccaaagtgctgggattacaggcgtgagccaccatgtctggcaggatttgcatttcttactagctcacaggtgatgctgctgttccaaaccactgaactagtacctgtttctccctttagatctggtttgggttttgttttaaattaatttttatgagtacatagtaggtatgtgcctttatggggtacatgagatattttgatacaggcatacatcacataataatcacatcagggtaaatggggtatctatcacctcaagcatctgtcatttctttgtgttacagacattccaattcttttagttatttataaatgtacagtaaattattgttgacagttgtcaccctgttgtgctagcaaatatgatgtctctgtttttaagatagtttctctttgctgagattgtattgctgcacacattggcaatcattgcgtaattgattaaccttctgagacagcttcttggcagaaaaaaaataaaaaaactaaactgttgagaaaggtatgagtaatttgtgtgaaaacatattctattttcataatgaccacagaatactgtggcgttctaccagcatagtcgaatgtatgtgaacattctccctttctctgaagattccttctttcaagtgtcttagtctcagtgaattgtatctatcttgggtaagaagttcagggttctctttcaagcccaagcattttacctaaagaaagctgagaaagctaggacaaatgttattctcacaaaaatttaaaagaaacttgctaattttcttatggcctttcttttcttcacaggaagactgggcagtgagcctgacctaaaacatcagttagtcagcaaccgtgcaaaaaattatggtgtcctgccaatgctttagccaccacatccatgcccggaactttccttgatattttaccccattcaaatctgctctaaatgggtcctgaccaaacttgaaatataccctgaacatatttctgttggttacccaccccccgccccggtttagtctcttactataatatttgaatcttatccccaagagcttgcttatctaaaactttcctacatttatttttattaagccattggaataggaaaccagtagcccaagaactcctgcaaacggagctcatttctctgtttacatcacccaacaaataagaggcttctccagtttgaactatgactttgaaccccagcttcactcctttgttgtggtagtgattaatgtatttcctggtacctttttctttagcaagtcattcaaagaagcatatattagccacttagaatccagaaataaatttgctattttgtgagaattattggatggtgaatttttttgttctttaggattttttttctttacttttgagacaggttctttatcacccaggctagagtgcagtggcacaatcacagctcactgcagccttgggctcctgggctcaagtgatccacctcagcctcctgagcagctggaactacaggcacatgccaccacacccagcatattttgtacaattttttgtagagacagggtctcactatgtggcccaggcttgtctcaaactcctgggctctagcgaccctcctgccttggcctcccaaagtagtgggattacaggtgtgagtcactgtgcttggccttggatggtgaagttgtaattttctaaggggttttgtccacccaaagaactcaactataactagcagatttctgggtaagcaaagaatgggaagaaatggagctggatattctgagccttttattttggaccataggttcatataattggattattcatgatccttgattcatgacatattatcatcatagtcttagatgcagaggtccatgcatgtccaacttcattcattatttagttcttttttaaagtggaatttttatttctaatttctaacaaccaacttctctttcctaatttttcaaataccaaagttttatttggaaagtgatcctaggaaagacttagagaaataaagaagagaactgataaatcatgcattatcaaacaagttaccactctgagtagatcttaattgtctggataattctgggaaccaatgtagattacatgaatcagaatttgctctttctagggggaaagtgtgctggagtatttaaagctgataactttaaatattaaagggacattaattctctagcattttcagaccaccacatccaatggcagagggctccctgaaatcttggacagttaaaagttgggctggcatgcatggaattacagagggcaccaattacatctgcctcagttagaagctaaacggtattattaattcatctgtttcaaaggcattcccaattaaattagttctaaatgaattttatgctttcaacatttagccaacaatgagtggttccttcccagttaaaataaagaacttaaatgggattgacattgggattctttatgcctgacaagctttaaagaccattgcatagtttgatgagttttggcaaatgtataaacttgtgtaacctatatctcaatcaagatactgaccagaaattccactggtgtctcctttcagtcactcaccattttctgtaagtaattattgctctaccttctatcgtaggttacctgttcttgaatttcatataaaagtatcatacagtacatggtcctttctgtctggcttcttttgcccaacataatgttgcatgtattatttgttccatctctctactgtagaataatattccattgtattagaataatatttcattatattaattatgtgaggaagcccagggaatcttcctctcagaaatatttatgaggacttaagaaagtctttttagagaccaggggattttctaaagcttttttatttagccttttcatttttaaaaatacgttgacctagccctgaaaattaacatagctttgtcaacacagatgcctgataaattaggctgcctctaaaatagctcaaaccatgggcaaggcagaattttaataaatatggatggtctattcttagtacttcaccacttcaggttgtgtgtttcttactcttctgtgtagttctttaaaacccatttgaaatttatcgaaactgattctgtggccttgcatatatgccttatcctggtgaatataacttgtagacttgaatgtatattctgcatttgtgtgttttgttctataaattgaatttgatcaagatggttgataatattttcaaatcttgtgtgttactgagttttttttcctaccttacctgtcaattctaaagaaggttgtaaaagaacaaatgatagatgggacaaacagaaaagaaatagcaggacaatagacttaaatccaaccttatcagtagatttaaatccaaccaggtcaaccatatctatattatgttaaatataagtggattaaatttgtctaattctcccttaacaccatcagtttttgcttcatgtatttggaagctttgttattagttgcaaaaacatttgtgcttgttatgacttcctgatgaattaacacttatcattgtaaaatatctttctttctagtcatacttcctgatgtgtagtttttaaataaacccgctcctgctttcctgtgcttacatatgtatgttatctcatttttcatccttttactattatatttctttatatttaaagtctctattaacagcacataattaggacttaaaaaactaatctgatgatctctggctcttatcagcgtttactgcatttgtacttaatgtaattttaaaaatgttattttaaaaaattgttatatttcagtagctttaggggtacaagtggttttcagttacatgatgaattgtatagcggaagtctgggattttagtgcttctgtcacctgaatagtgtacattgtacctattttcatcctcacctccctctcactcttcctgcttctgagtctctgctgttatataccactttgtatgcctttgcatacccatggcttactccaacttacacaacacttaatacgattatttatatgcttcagtttaagtctaccactttggctattgatttttctttctcctatgtgtccattgttccttcattactgcctttggatttaataaaatcgtggctgagtctgcagggttgtaggagcccaggaattcaagaccagtcaactggcaacatagtgagaccttgtctcaaaaaacaaacaaaaagtaaaggttctatgaattcatattctccacaacacttggctatgtcaatttttttcactaattggttataaaacattatcacattcctttatactcctcatttattactgatactaagcagcttttcatatttttattggttgaaaacatttctgccaaatgattgttcatatcctcatgcctcctattttttcattgatttctaggaattctacacttggaataccactgaactggacgattttgatttgactacttttaacttattagagaagtctttggcctttgattctaatgccagtccctggctacctgtttaatttgcaaagccttccaaattggacccccttatcctactccatttttccccttagcacctaccaccttcgccatgttacatatgtgtttattacttgtatgtactgtctttccctgactagtacatgtaggctgctacatgatatagagattaaaagttaacgttttgaactttcatagcaatttaacattgtcatcatatttttattaaatgaagggattcgtctccaatgaattggaaatttttaaagaactagttcttcactactttgaaaagcatggtctagattgtctcataccttcatataatagcatttgaaaggctcattaaatagaacagagaagaactcggtaactattgtacctatcggacttgaactgtttatgctctacacaaaatatagttgctaacaaagacgaatatttttttctaatttagtgagatgatatgtttttctaacatgggcattactttgtgttattggtattcccatgtttatagctgagcctggtatgtgtctctttgttttatatagacacatatataagtggttattaaatatgtgtcctgcttctttggatggtgcactggctgagtgtgtgaataaattttttggaatgacctaggttcataacctaacttgttgattccttgtttcctgggtaaccatagacacataccttgagtattttcatgctgtagtatttccagataaatggtagtgatatttttcacctttggaagtgagtaaagttctggaaaatccttaggtgaaatgactttaaatcaaaataatattttacaacaattatatggcattatgttagaatgaatgcataattgggaactcatccaaggagttgataccggaactataaatatatttgtgaaaataaagtggtgagatttggctgcttggaaacagagggcaaaggtttctgggaaacagcatgccctttatttcccaggtatttgctctatcacagtatctataacatagtaagagctttattcgggtctattgggagaatctactgggtgcttagtctggtacctgaaatgcattaatgaatgctgaaaatcacattatcttgactttttcctgccaatgaccaaagtttttgcaagcattatctcaatatatcttttaacagataaaccaatgagtagattgtgatgtaatttcaggataaacccatcttcagataggatcaggtaaacagaaattatgtattatagtggaagttagacagacctaggttagaaactgaacttcgctatatttactttgctgtgtttccatgcaaaaatcaaacatcttttatcctcatttataaaatggagatgaatttacacattttatagagctgttgactaaggattatggataatttatgtaaatgtgtaggaaacactataggcactcaatatgtgatagctatggctccactacaaaatgtttagtatcagtaggggtgtatgtgtgtgtttgtgtgtgtgtgcacatacatttagtatatgtgttagtgaatccttttcttagacaaatcttaagcccttgtacagaaagaaaaaacaaaaacaaacaaaaataaatgaaattaagagagcagagattgggtggggctggtaaagggagaaaggagtcttgtctggccagtgcttgtcatggccctcagcaagcttccatggccatccctgttgccctttacagaggcctagagttctagagaacagcatggaaaccatgctagtggattttaaacacctcaagtgcaagaatggaatcttctttattaactgatacaggtatcgcatgtggtcttgtgctacagtaggtgattggccacagcttgctactccactactgaagttcttcttccatatttgactacacagcagagttatcatttgaaggtgaattagaaacccactagcaagcctatgtcatttaatggatgtaatgataaccttattttttttcagatctgggttggaatttgcccctgacaaataataaaatgatgagtgatgcaagtgacatgttggctgcagcgttggagcagatggatggtatcatagcaggtgatctgcatcctgtgaaagacagaatcacaacatttactctcctcacttggctttttcactacaactttcatattatcttttcactttattttcattttttagacctatgccttttgcttccctgtaatttcatctttgttcctcttctccattttctgccagcattattctcaaacattattttaaagtatcaaaaatttcagttccatcctaggtttctaatcaaggataaagaatctgcatctcaggtgattctggtgtaggtggtctgtggaccatactttgagggacacttctctacccagtgaacatgaatgttctgatctgttttcttgaattcaaaattcactttccaccaatgactcccgtatcttttttttttttttttttttgagatggagtctctctctgttgcccaggctggagtgcagtggtacaatctcagctcactgcaacctccgcctcctgggttcaagcagttctctgcctcagcctcccaagtagctgggattacaggcacccaccaccacgcctggctaatttttgtatttttagtagagacagggtttcaccatcttggccaggctggtcttaaactcctgacctcgtgatccactcatgtcggcctcccaaagtgctgggattacaggcgtgagccaccgtacccggccatatctttttttttttttttttttttttaagagaggaagtcttgctatgtttctcaagctgaagtgtagtggctatttacaggcatgattacctgtgaataacatgcatagtgcagccttgaaatgctgtgctcaagcaatcttcacacctcaagtacctgcgattacaggcacacgccactgcacttagctcgttcgcatgtgtttaccttcccaattctttgctaagcttccagttcctatctctaatttccaaccagatatctgtccagaaatgtcctatgggcacaccagtataatcatttaatgcattgagctcattatctttcctcagaatttactctgatagtcttcatctgggttcatttcataacccttcatccacagtttttctaagccagaaatcatttggtccaatattggtccggaatggaccaggtctaatatttgtattttctgatctgccactttcttatccatcatcttcatgaggccagcacacctcacaccaaagcccaccaggctctttttctttctataccccatgattggcctcctagttacgaactggaccatggatatttaccactaactacatggttttaatttttgcaccatgtaactctgacttggagagatttatgtgattgaattctcttttttctgtttcttttgattgttccttactgtgactagactggtttaccgccttcggctttggtatttttatctaacataaatcccattgctctctctgtgattttgtttaacttaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatggtagggtctgcctgttccaaattctgttataaatcctttgttgcttattccaaaatttagaacatagaatagctgattagaacaagaaaagtttagggcaacacatgtgctccgattttattacttaagatatcttaattttcttttgactctaaggataactttttaaaaagtgctattagtgtacattttgtaaataccaacaacaggtcacctgattctgcccataaaaacagactggcttttagattgtgcctgaatgacctactgtggcttaaatcaaatagtcctgtaagggaaagaatcttgcacatgatagatgatttctcagtcatattgggttattcaccataaaggatccaatagcaattctaaatggaaagcatgatgaaagactttcaaaaagcaacaggatttacagcagtatttgaccggaagtgccatctagtggtttatggcaatcatttcagttccagttcccgaattaaattgtggagttgggcctttaacccatttatgcgcagtgttccattattggaacgctaagcttgtgggagttatttatatcctgctcaaagtcatcgccaaggtctcatttaaaaaaaaaaaatcacaacctccagcataaatgggttaatggtgttactcactgaacaatgaggccgctttctaggcatccttctcaaaaattgaagatgtggcagagctaccctttgtctgggcacggttggaaatactgtggttttaatctgtgatgaatacataaaatctaaagaatgtcacaaaaacagattcagtggaggacagaggaaaggagatattttgtgcttaaaggatattcaattttcagtaagatgcactcatatgcttatgagttaactgtgttgatataaaagctaataagaattgtatgaaagaatcgtgatctactttatgatctgtggtagacatgaaaaccgcttgctttgggaaccttaagagtacatcctacagctaaaacattttcatatgatgtgacacaaatattagagctcccagccagtcctgtgctgaatactctgtgttcccacctggtttacctctgcgtttctgagagcgaatagtacaatctatcctttagtgggggtgcagctacacaaactggagttattttacttgttaaaacacataatgccttactattatactttctatttgctctacagatttctcctccagagacttaagggtccaggtttgctgatttctttggggattgcttcatgctctgtacttggtgtttcctgacatattccttagtctatttcaatgtcctatctcaccccttctttactccatgttcttctgaccatttagcatgcagtgaaaaaggaatttactattgttagaagaacgtatttctatcccacacccagaggccaccaatggcaatagtagccgaagcgtacctgtagttcagcttttgacatgtgtctaaaacatgtccattaacatgtgcttaatctgttctgtgaaagtattttcagaaatgataaaaagtaatgatggttacatctgaatataagttagatcatgacactcactccttttttcagaaactaccagtggcatcacatcttactcagagtaaaaaccacagtgcttactgtgggctgcaaggcctcgtaggatttgccccccatgactttctgacttcatctcttgtcacacatctccttattcgctccacgccaagcacagtggctttttcactgattcttaaacatgccaggtacactggcctcagagcctttgcactggcttttccaggcactggcttttcactctgcctggaaagctctttcgccagatatttgcatggctagctccctcacattctcctggtgtttactcaaaagtcatgctctcagtgaggccttgtatcaccaccctaactaaaattatacccatttattccttgtcttacatctccctgcttattttgttcttagcattcaccattttcttatgtgcaatgtgtttgtgatgtttatatcatttattttctgtctttccaattggaatgtaagcatcaggaatcagatttttgcccttattttaaaaaaattactgtatccctggtgcttagaagaatgcctggctcagtagttatatttgtaatgaatgatgctccatgaatgataaagtggattgcatgtttgaatgaatggaagttgttttaaatttattctttggatgggtaatggcttgttgatctgtgttttcagttgctttgtgtcttattatttgacattttaaccttgagaatccacaaaatgacaaatattttacagaactaatgaagattccgtttttatcctaaaagtaacaataacaaaataaactagatgtagatccagagagataaggaatttttgttgttgttgctaaatttatttttatccatctaacttatctatatgaattcctcaccttgcccccaaccttccaaattaagtgtgttttctcaagcacacagagaatgacaggatgaaagaagaaagacagcaaaaggcaaaaaacaaagcaagaagaagagaggagggctggctgtttggaaccacaaaagcataggtgtgaaattaagttgtcaccacacacctaccacgatagactttattttagaaccaaaaagcaacttgggccagcattgggaatccaacaagtagaagattatatacttataatttagtaatttgctgataatattaaatttttccaatttaatatttcagaagttgggatgtgttttatgatcttaaaatgggtatatgtatacattttagctcggatccttcctcccttcctctctcccttctttcctttttttattaataaggtacttagaatagtcaaattttagagacagaaagtagaagggtgactgccaggagctgaggggagtggggaatgggaagataatacttactgcacatagaatttcagttttgctagatgaaaagagttaattagatggatgatggtgatggctgcaaaacaatgtaaatgtacttactaccactgaactgtacactttaaaatggttaaaatgctaaattttacatatatattttaccacaataaaaaattaaaattgatagcatcctagaatttaaggaacacagaatcctagcaaattcccccttcatattgaacatgggaaaactgcccaaataaaagagattatgatgttttaaaaaaggaagcagtgaatgataaggcaggattgtatctaggcagtttcaaatgcaggctgcagtgactgcagacctgaattttaatgttggccctaagtctttgaagcttatatgaccttgtgaaaatgtctgaagctctgtgtcttggttttctggtctgtaaaatggggatgatggttactgccacttaggattgtaaggaccctgtgaactaacatatgctgagcacttattgatatgcctggtcaaaggcttgtcagaaaggtaatactgaagagcagagcatagagagtagagggaaaatgtttaagagcaaccctttgcaatgagggaaggagttgggtccagttgcaatgggagttaggttacaaaccacccatacatagttcacttcttgcaatgaaagagtacaaacattcctctgactgaagagaagcttctgggatattttagaaaaacttaaattcaaaaatttttggaaataattatgtatctgttaataataacagacatataattaaggttccattcatgtttaatgatggccaacttgagaggccctgtactttaagatggatactaaccttttcattagtgcaactgggcatttgcagttggaattatcattttacctgggccagggagatcccctggtttcttgtaggatgcaggttatttctttgctgctaattgctcctgcctgtttgtttcatatgatcagacactgaatgtgataaaataccaacactagtagcctgttacagtgaggggacattaaatctataagaatgaatttattagtgtagctctaggcttctggaaatgaacaaatttcttttaaaattcagaagtgcgtctcctgtggttaaaaaaaactgtagactatgacatatttgtttaattactgagggtgaattttctgtttcaattatgaaatataatgtgttaacacagatattaataatggagaattacttgctttatgaagctccagatttaagaaggaaaatggaaaaatacgtctaattgtttgagttaagcaagtagttacttactttaggtctaacttgatgagttgccctagaacattcttataatgtttttttaactgaggatcatgaccttgatccatgtcaacagaggatcaggtggtgaaatcccgaaggtgtctggctatttggcagttttaattatgaggccatctcaaagtcagcagaaattacaaaaatacaattttcaacaaagtgagtgaaatactaatggtgaatactaatggtagtaacgccaaagcaggcatcatcacccatgagataggtaaacaggtgaagtgaggtgttctggactggcttctgacctgttaaatcatcataatacccttctctcttatttttacattaaaagtgagataatattaatcccaaatgtatatttttaaaagttgctataaaaataaaaatactcataacttaaaagagttcagccacgggacatgctctctgcagggctgctggctgttcttcctgagtccctgactcccagccccacgaagcagtccccgtcctaccaccctccgatccctgctgctttctgaccagctttgcttttcatctgtgcctccaggaaatgttttctcaggccttggcaaacaaggtacatcttaagattgtatcccatatgtgatcacaattatctgagttatgcggtgcctcactgagacatcctagctaaaattaaggcagttttccccttagtcttcaagtaaactcccacagaaagtgttcacagacacagaaaaacaaattgatcaaatcggcagaattcttagtttacagaggtaaaagatgtgcttttcatggaatcctaggccactggtatttgttaggactgaagggaaagaggtttccctgttcctttgggaaagtgagttaagaaagaaaatgtgacaagaacaatagggactttttcttggtctcatgttatccttcccaaagtggaagagagattcctcctctagatcttcgtatcctgtcacacattgctggctttcaacaaatattgaataaatgagtgaatcacgatattgaatgaatgaagttgctgctatactgagataggagctggggcttcgcttttaggaacactgggaacttcttttttctctgtcctccccaaattcaggggacttaggtgtgtacctatgactagggtaatattatagtctaaacatgtacccgccccccacccccgggttgcccactgcgaagctcatgccctcattccaccacacccagtgagaggacaggggagcggagtactgccactgcctggttgcttggtttccagcatcactgatatcatgttctttgactctttggacagtagtggtgtaagatgccttattatggtattgaactcaaatgcaatatgactgtgctcttcatggctgaaagattcaagtcttatctcaatctctcctcatagttcagagtctagtggagagcaggcatgcaggaaatgtttgcatgcgtggcagaggtataattctgagtacaaaatgctgtcatagtaattatttcttttggtaactagagataatgtttacttaaaggagatttcatggactgagccttactcttcctttcttgatcctgaatgtttaaaaacagagttatgaaatcaagactgcgtgacaattttaataactagttttaaaaataagtataatgactggctggaatgtggtgtgtgcgtgtatttgtgtatatgcagtgttactaatccagctatgctttaacatttgttgaccttaaaaagggggctgttttcttttccccattttaatttagatacttaccattctgatttaggaatcttacactcaaaattagtttctgttttataaaataaataagcattattgtggcaaatcactgcttgtatgttgattttggatttagacaggacagcagagctcaggaaagaacaaagcaaaacaaaggggaaacaggaaagacaactgtagaccaatgcaaaccaatagaacccagaaaatcaaaggaaaacacagcatgatgttataagtaaaaacagtgggtgagactcctaccttccgtgaagtaataactattgaaatggaatggcaagtgcatggggtttcatcacgtgcatttctctactttaaatctatttgaaattttctgtaataaaaaacattttttaaacagacacaaaggaaagatgttaacatttattatgtctttatgcttgattgtaatacttcataattaaaaggaagttgatataaaaagaaggctttctagctggggaaggtgaccacacccacctctaaatacggggcttgtaactgagctcacacccgaccaatcaggtagtaaagagagctcactaaaataccaattaggctaaaagcaggaggtaaagaaataatcaaatcatctatcacctgagaacacagggggcgggacaatgatcgggatataaaccaggcattcgaactggcagtggcaaccccctttgggtcccctcccgttgtatgggagctctgttttcactatattaaatcttgcaactgcaaaaataaataaataaataaataaataaataaataaatagaaggctttccacttagatggtgaagggaaaagtagatggtgttctaatgttatgtgtagcacctgccatgtagagtcagggaattcgttttccgggtgaggttcctggctagctctaagattctgtaattctatgagggataaagcgttttagatgtgtttctccccattgtgccaggaaaacctggcagaggccataagttccttaattaaatcaaagtaccaatgttacagttgagttatatctcccccactgactctgcatacacactattggttggatactgtactgttgaagtccccaagttgactccaatttcgacttagctggattgaatgcggtcaataaggggttgcaccatgagctaaagtagaaaggtaaagtgatttaggcttctctaatatgctgtggaagtcagatcgactcaacaagagtttatacttaaatacattttaagttacgtgctcaggattttacaagcaccatggaagaatcaaaagaaacgtaagacagttttgcactgagaaacttaggctgagtgaccaactcacataaaattattagtcatctacctgaggcagaatatgatgaaacactaaagagcacagtttaagacaagacccagaaggtcagcccgtagatggggaaaggagaatggcaccatgtaaagaggaggtagacatgggttatgaaagacagattgatctgagagggaggagtgggaggtgagtggagtgttgggtacaaaaccttgggatagttgttgtaaaggaaaatggaagaaagctcattaaaaggaagaaatggaaaatgataagtagaagtggtgattacaggtcccagcaaaacaggaaatcaaggttccaaagtagaagtggaatgatgagctttcaggaaggagttaagaatcagttctcccaagcctgcaggacgaaagaaaggaaagaaataagaggtaatatatattatactattacgcactgaggaagaaggtgtctaagggagctcacacaagatggccttaactattgtccattacaaaggctctgagatcaggcggtcggttagctcagttggttagagcgtggtgctgacaaaggctctgagatcacctcctaaacatagtgggaagagagagtacaggaggaaaaaggagccagtctagatagaggtcaaccatggcgtgcataccagattatagaggacacataaataaagacccactgagaagcaagaagggcagatcaaaaccaaacctgcagtcatcttgtattcaactagtgtttattgaacacctatcgtcattcttccattcaacagacatttagttatcgcccactgtatgtcacatgccaaggcaaatctacttgcaaagaatgcagagtctattagaagagagagacatgtatgcagtcaagtctaaccttagtgcattcagagtaatgcctgctgtaatgaaggttcatgtagatactgtcgctggcatatagcaaacagtgaattcaaggaagacctcacagaccaagccctgatagaggtggaccttaaggaatggggaaagaagaagaaagggtgggaaaagacggtccgtgcagaaggaataaaagtagtgtgtgaaagagcatgccatatatggggaggttttgagtgacctggtaggtagaacgtgggagttgaaggaagaatagagacaatagggtatttacctaatggatcttactgccaacattcttaatgcaaaggaaacaaaattggcagaaatataaacacaggtggacagaacagtctttacctacttaagttaacacaaggatataacattgatcactcttaaattctgccttatgttcctatagtgacttttaatatactaaactacccttgagcattatgagtgcttgtaaatatcaatacagtactgagaaaaataaatatgctaattttgagccaattttcagtatctgtttctatttggggctaattttggagaactggttttggaacacctcacttccatatcatacaaagtagcttgggaggaaacattgctctcatcttgctataatttcctccaaccagaagaaagatcagtttgtttgtttgttttcttaagacagagtcttgctttgttgcccagcctggagtgcagtggcgcaaacatggctgactgtagcctccacctcctgggctcaagtgatccccctccctcagtctccagagtaactaggaccacaggcgcacaccaccaagcttggctaagtttttttttttttttttttttttttaagagatagggtcttgccatgttgcctatgctggcctcaaacttctgggctcacacaattctcagcctcccgaagtgctggaattacaggtatgcaccaccacccttggccagttttactttttgtcctcactaaacagcagtttttttctacttactgaaatgtatctgtttccaaactattgttacttgtatgggattttaaaaacagatggctgttaatgtccataatcaaaataaggaatttaaagctctacagggcctgtcttggcactttcttaagattgagaacatgcgttattcatcctggctcttttccaaaaaactgcccttgagaagttgtgcacaatttatttttatgttagtccccaggaatggaagttgtccaggccactccatcacactcttcataatacttgtaatttaatgctgggcacttcagttaacaatatgagcagaattatgccgtggtaattgtagaggtatgtggcaaagcagctgattttaaaattttaatccactctaaatatgcattgcacccttactaaattagcctctgattcttagtggccttttggaaaatgtattcagtatgctaaagtttttagaaaaaacattctgaaattttccttttcattcaagccctgttttttttcttcccccttcccagcacatgacttttattattccaagaattgatactagaaactgcatttattggaaagatagaacaatggtatcagttaattctggaaaaacagtagatgtcacatcagatgtgtcctgggcagtaaagttatacagtttgtattttttctggttctaaatctgaaggtattattttctttttcagttgaaccctgggtggccccatctaacactttcggatttcagctggcttttatttctattgtatttgaatgaagaatcaggaaattctattgggattacattatcttatggttatgttgagattatgagagacaccacttatgctactacgtacgtttcaaagtggtgcttttaggttttctgttctttgtgagcctctttgtgtgtctttttcatgacttgcatgtgaggcagctgaggaagaaacaatctatacatcgtttctcaatctatacttcctttggcatttataccacgcataaatatactgaaacatgatttttttttaaaaaagtgtggggggcaggagggaggggaagaaatagtaagcatcaatatacacagagcactgagccagatgctggggaggttaccaaacgaattataggctctgccctggaatagaaggtaacgttatacaaagaagcaaactcacaagttaataagatcaggacaaaaagtgttaaaatggagataagtgaggctagtctgcgctaccaggggaagtcactgtggcctgagtgtttaagcttttggaggaagagagacagacctcaacaactcggggtgccccctacatactcacaaagctttgcctgcccctgggtgtgtgtctgctctcagtgaagaataccagtatccactgttccttgtgggtcattattttctgcttgataagaaattgtttactttggcaaaacatgcctatatgcttaacatgcctgtcttacctcttttgtggtaaatgaaccaaattgcattctcgtattttctgtttgacagtgacagctgtgcagattcaattcaggccccttggactaagaacacttgtgattttcatttatctacgatatatcattcttagagaagatcagccttacccatattacttcctttttcagacaaatggacacctaccagggaacggagatgtgtatcaagaaaggctggcacgtttagaaaatgataaagaatccctcgttcttcaggcaagtgatttttaaatactgttctttccttgcagcatacttacaaagccttttaaattggggtggcaaattcagattgcttgcagcaatcagactgctaatagaaataagcctgataagccatctgtacacaatagggagtggtgaggattggggcagaatgatggtgtttacacccagtttaaaaggagctaccattaatcatcctcagctcttgcaggaccagtctgaatacgggcacaatgttgtctgatctgttcttttttttttttttttttggaggcggggtcttgttacattgcccaggctagtcttgaactcctaggctcaagcaaccctcctacctcagcctcccaagtagctgggattacaggtgtgcagcaccatgcttcactggatctgatttttaagtatattttaatatatagcagaaattcagatatatgaatatagcataacatctgaatatatgtaagtttatatttctgaatctgaaatcagaatatatatatttaatttttcaattttaaaaatgttaccctgtgtgagacaaaacaaaacagtgactagaaccctccttgtgggctaaatttgagtttgcttcttcataatgttttaaatgcttcacaaacatttttctttggtatattgagcaaaatgaattgaagtatatttactgagtgatgattattgaggaaaaactcaaagatctgctgtaagcactagagttgaaggactagcccaacagctcctcaggcacctttgggtatattgagttgccccccctgactttgaacacatctatgatctgtgtcatcttcaaagagctcatggaatttgaattccctgggttttgtttttgtttttgttttggacggagtctcgctctgttgccgagacgggagtgcagtggcacaatcttggctcactgcaacctccacctcccggatccaagcgattctcctgcctcagcctcctgagtaactgggattacaggcacatgcccccacagccagctaattttgtatttttagtagagatggggtttcaccgtgttggccaggctggtcttgaactcctgacttcaagtgatctgcccgcctcagcctcccaaagtgctgggattacaggcgtgagccaccgtgcatgctacctctcccccctacccctggccaggttctttttcttattctccttgaagtatcaaatttttgataatttctatttcaaacattaactttgtttcctctcttatactatctccacgctgccccctaaaaagataacttctgtacatgctgtctttcataaatggttgaagtagctttaaccaaaaagtattgtacattcctaatctacacgaattttctccaaattgtataggcctccttaaatcaaatagcaacatataaataggaatgtgagggaccactgtcttcttggtacttctcagatttttttttctttataaccgtatgaatggtaggatcattcctttttttgttccatttagagaaataacgtatgcagtgggacccaaattctttttcactcattgcattattttgctctaaatacaggtaagtgtgttaacagaccaggtggaggctcagggagagaagattcgagatttggagttttgtcttgaagagcacagagagaaggtgaatgccacagaagaaatgctgcagcaggtatgtgcagaggccagaaccaagatgggatttccctgctgaactatgtgagatgctgcatttctatgttgtgtttgctctgatgcagcagtaagtttcttgattcatttagaccagcacattaaaaaaaaaaaattgagagtagtagagtctcaaaacacatgcacacaatataaagtgtttatgtaattagaatctggaacaaaatgtcaataggattgtggcttattttaattttctttttttgcattcagatggtttcctctcacccatagcatgtgttttataattaagaaaaaatataatagtaaaaaatctaataatccagtttaaaaatgggtaaaatatttgaatagacatttctcaaaagaagacatacaaatggcaaacagacatatgaaaaggtgctcaacatcattgctcatcagagaaatgcaaatcaaaactgtaatgagatactatctcaccccagctaaaatggcttttatccaaaagacaggcaataagaaatgctggcaaagatgtgaagaaaagggaacccttgtacactgttggtgggaatgtaaattcatacaactgctatggagaacagtttggaggttcctcaaaaaactgaaaatagagctaccatatgatccagcaatgccactgctggatatatacccaaaggaaaggaaatcagtatatcgaagaaatatctgtgctcccgagtttgctgcagctctgttcacagccaccaagatttggaagcaacttaaatgtccatcaacaaatgactggataaagaaaatgtggtacttatacacaatggagtactattcaactataaaaaagcatgagattcagtcatttgcaacaacatgaatggaactgaaggtcattatgtgtgaaataagccaagcccagaaaaacaaacatctcacgttcttacttatttgtgggatctaaaaatgaaacaattgaacccatggagatagagagtagaggggtggttaccataggctgggtagggtagtggggatgaagggagaggtggaggatggcgaaggggtacaaaataatagtttccatgaataaggcctagtatttagtagcacgtcagggtgactatagccaataataatttaattatacatttggaaataagaatataactggatagtttgtaacacaaaggataaatgcttgagaagatggagaccccgttttccatgatgtgattattacacattgcatgcctgtatcaaaacatataccccataaatgtatattcctactatgtagccacacaagtagaaaagaaaatatctaacatataggagaggctctgtaaggtcatggatggagtatgcacttgagcaaaacctcgtaggtttccattcctgctgtgtttttattttttctttttccctgtatgacattaggccagttcctaacctctctgttactatgtttcctcatcttttgattaaggataataagaatttctacctgataagttttttgtgaggattgaaatagtatttgttacaaccggtgcctggcacatagcaaacatagtatcaccatcatcaatgttatcatcagactgaagtatatatatggtttatgcatgtgtatctacacaacatatgtctccctcagtaaactgacatgtgcttatttctgttcaaaggagggtaactaaagtgaatagttcttttttattttattttattttatttttgagatggaatctctgtctgttgcccaggctggagtgcaatggtgcgatctccgctccctgtaacctccgcctcctgggttcaagtaattctcctgcctcagcctctcaagtagctggggttacaggcacccgccactatgcccggcaaatttttgtatttttagtagagacagggtttcaccatactgtccaggctggttctcaaattcctgacctcaagcgatctgcctgcctcggcctcccaaagtgctgggattacaggcatgagccactgtgcccagcctcaagtgaataattttttaaaagtgtgtagattcagtaattatacttcactatatcctctacttgataggtgctgctttgtgcgatcataaatgaggtaaattcacgtgcctgtttataataaaagacttcttgaatgtatctgttaaattataataggagcttctaagtaggacatccttagaaactcagaagttggatctgatggctgaaatatctaacttgaagttgaaactgacagctgtagagaaggacagattggattatgaagataagttcagagacacagaggtgagtgatacagtctctcctccctctctctctctctctgtcactctgtctttgtctctgacacacatacattcctagggcaaagttgaaattccctggaggtgtgcaaggaaggcagttaattactacgtaccatcatcctacttcattttaagaataatctttcattgcattgactttttatcactagatgctaatggcaatttttatttttagacttttgatatgaagtattaatctttttattaacctttagaaatacttttgactttacgatatttggagcatccgtccatccatactgtttttcttaattttgtaaataatgggcttaaatacatggtttcactagtagttattatttaggcacactgattatttactatgtaattggattttgaaaatctgtatagaaaacatgctaacattctatactcacaaaatcacagacagagcttttttgaggtcttttaatttggcattctacttttggtctgttccacatgtaaatcattccaattaaataagactcactgtacttctacaaaaatcagggtacattctgtaacttgaagtatccattttagtggcttaacaagctttattgtttgttctattttgttaattcaggcctcctagtttgtttgctttgtgacatttggcaagttcttaacctctctgttggtttttgatggagacagagagcatatccatttgaaacatacatttgaaatgaagtataaagagttgcagaaatttcttttctctgagagccatctcccctcctttttgcttcctattttgtttccttggttggagtatggaagggtgtcatgctggattagaaaatgggtaccaaggagagaggagagaaaatggtttacttatttttcccttctgtttttatttcaatcatgtatttcacgctgactataagccagcatgataccaggcattacatacattatccaccataggaaagttctttatattggaaataacaagttttactccactgctattttcaaaattaaattttctgtcaaagattcaattacagtggaaagtcttggtatatgtcttgcttcctccatagcaaaaggaagtctttcatttggttcatgttttaatctttttttttttttttaagagataggatcttactgtgttgcccaggctagtatggaactcctggcctcaagcaattctcccattttggcctcccaaaagcactgaggttacaggcatgagtcaccatgcccagccatgttttaattttaaaactctttgtcagttgcctgtgtgagcatgtttctcatttgatagaagctggggctcttaaaacaggacttagaaagttacccaatttaaaattcttggttttgtattttctctaaaaatctctttgatattttcctctttcccctctttttgtcaggtcctaaccccatagtcgcagggtaaagtaatagtaaaactcagtcaacagatgggcaacatggcagtggagctagctctgctgcagggaagaattgatggtagatatggatagaggtggtcttctacattgcgtccacaaagtcaaggggaaatattcacctgttgttaacttaatttgtatatgagatgttaaccaaatgttggggctaaattgcagtagatgtgttacttattgttgtaagcgcctagggtaatatttatatcccttgagtttggctgctttttttaatcaaatctcttttccccactttttcattgtttcactcatgcactctcaatcacatacaaagtgatcttgtcatcaaacttcctgtacactcaatccctgataatctaataaaaattcagtgttatttctaaaacgtatgcacagacccggagattagagcatatgtggtaaactttgtgatgttacatatgaaaataattaaaataatcttcaacattaaactaacttgaatattctcatgttcttgttatcgtccccttaataaaaatatttttctgggtgtttcatgaatccataatatttaactttctcttagaattttagatttatatttggatattaatttccaagaaaatattggcatggggaagaagtataggcatttccaaaggactgagggtacaagtctttaaactttggaagattcaggacttgtccctggaattgctaatgggagatgattagcatcattcaacagtgcccccttgtggtaagagcatacatgtcagagactgagttcctgcaggagccctgaattctctgaaagggaaaagagaaagggaacaggaattttcttttttaaaaggactgaacttctgataagaaattgattgaaatagtttgtattctgttttttaaagttttacattagggagccatttccagattttccagcttgtgttgtcaggggaagatgtgatttatttcaggttggaaatttagaccatatttaaagtattgccatgaaatatagttgagtagttttttgttaaaacagataaattatcccagtttacaattccatttttttcagtggtttcttctttgcacgagcaaagaagaaaggaagctgtaaaatacaatagcagataagaattcaatggtatttcttagcaatgagaaagtaggaaaatatatatttagaaagatcatattgatgaatatcactaaggactcatattatgcaaggatgattagcttagataactgggaaaagctgatttttttctttagacttgaattctgacctgttagttgaggaatcacaaatatgttgctgaataatgtcaaacagttcatgacctaattcataagaagaaaatagatatcatctaagtgaaatattgtgccattattaaggtgtaattgtataactatgataggtaatattttgccccattttataagagaccacaatttaaaagcctaagggtttactgggaagtgttattttattgtagcatcccttctcttagcctttgtgaacttgaatcattacacttggaagcttaaaataatttctatttacaaagttttatttcatatagcattgttctacttgtaatttttggcattcgtggataattttgtcctgtagtctatgaatttgtgatgcaggaatacatgcatgtctttgtaaaaagagagaagctggccgggcacagtggctcacatctgtaatcccaacacttagggagtccgaggagggcgggtcacttgaggtcaggagttcaagaccagccaggtcaacatggtaaaacccccgtctctactaaaaatacaaaaattatctgggcatggtggtgggtgcctgtaatcccatctactggggaggctgatgcaagagaatcacttgaaccctggaggcgaaggtcgcggtgagctgagatggcggcactgcactccagcctgggtgacagagtgagactccatcttaaaaaaaaaaaaaaaaaaaaaaggagagggagagagaagcaaaaatatagtaaccattgtagggatctttgtggcttgtagtaaaataagtcatctcccatgcagggtatttgagtgtctcttttggaggagttaatattgcttaacactctaatttcctttcctactctctgggctcttggacaagttttgtgagcaaattggtcctttaaaaagtagcactaaaataaagtggcagtagaaaaggtgcagaattgtgttgtgtcatataaacactaggattggtttctctttcattttctaatgataaaattaggtgaactgcagggccctcatccactttccagttgaaaattgtcattaaacttacagtaaactcaatccctgataatctcctaataaaaattcaacactattgctaaaatgtatgcacatacccagagaatagagaatagttgagaaactttgtgatgttatatatgacgataattaaaatagtcctcaaaattaaaactgatttgactattctcatgttcctgttattcacttaataaaaataaaacatttccctggctgtttcaggaatcttaaggattcatggcttaaaggatttaattttcatttcattctcccatattgggttgacgagcaatccatatttttgtggacaaaggaagaaattacaaattttttaaaatagccatgtatcattgagaaggttcaaaaggtaaatggctttactaaagaatgtggtatatttaaaatatgaaatagcattctatgaaatagaatagaaatagcactctgtgaaatagcatagagtcatttttaggatagaaatatctgacaaataatagatattacactacctttcttaatcaaaattatactcaccttttattttcataagcccatcactttagggcagacgcattggggatttaaaggaatgttttaaatggaaagatgccttcgttcttaaggaggtacatttatttccatttgtctcatctgattcatacaactttaaccctaggagctggtgacttcttaagatttccaagctgctattttataggtataggtaactgtgttaccactttcctaatgtactttcttgtttcttcttggacaggggctgattcaggagatcaatgatttgaggttaaaagttagtgaaatggacagtgagagacttcagtatgaaaaaaagcttaaatcaaccaaagtaagtttttctcacaggttaacattttcaaacaaatggcatcactattcatctatgcccaataatataaataagatgttttctacttaatgtatgataaagaaggtattttaaaagtaaatgaagatttccccccaagctggaaaccttgaatttaagcaccactgatctgaatttaaaaacaaggcttaactcatccgacagaacataacctgccctttctctgagttgtatctaacctcctttataaactgatactgttttctcggttatttagcttgtctttttctatctgtagttttctttcactcctctgtctctctaccagtctttaatggccaaactttctagcatgaaaatcaaggtgggtcagatgcagtatgaaaagcagcggatggaacaaaaatgggagtcactgaaggtgtagtagacgttgggtgatggggtccatggcctgttgctttctggcttgtgttgttttgctgtgatgatgtttttagtggcatgtgcattcattctgtgtgtgtgtcacctgttgattacaaatcacctcaagctgattgaagggacaatgggatccctgatgttgttttcagaaatacatgaaataattggtgaaaaataataaacaggtaaaaagaaagaatttataaattaatctcttagactatctgagacccaagcctagtaaaataattgtaaacattcgcttgtgaaagaattctgtttcgtatccacagtagaggtcattttcctctttagggactttcttgatggtaaatgtacagcagttgatattatcatggctgtgaatagaaatgactgctgagaagcagcacggtgagaacaggttcacacttcctgccagtgctactgaagactttttgtacttgtccactctgctcctaccagaagtcaaaactatagggccaagtgcctcacttcattggagaactacatcttctcatagtactaaatgtaataaatatatctttagagattctgaaagcaaaatgtgatgttgaatataaagctgtacttcttagcattgcatagctgtattttctgtgttaagtacagccagcaaaatttgtttgctaaaactaattctttactgaaaggaaactgaaaatttaaacatgagtacatagaaggatggacttgaaatcttatacacagttgtatagttaaaaattaaaagagggctccactatctgttttcgaaatttattttttcccattgttgtaggagattctgtccttttgtcttagtgatgagggtgaattatttagttccctgatttggctaaaattgttcatgacttgctaccttacccatgaatgaaactctgtgcttgtcaaggaagcatgagtgccaacttgaaatgctgaataaatgtcaagctagtcttttccaatttgcattttattttgcttttatgacactaagtatctaatttgattatcttccttgattaacttggttatatttttaatttaatgtaaagatttaaaccttagggctatcccatccctaattactctttaaaagatctctttttaatttgattacaaagaaacttgaaataattataccataactattataaacaggacttctactaatagtcttgctttttgcttttcattgcccttgtctgatttctgatgcttgcatctaaattctagtagatttgtttcattcataaaacctgattattgatttaaagagctaatatgctctctgaatgttccttttcagtcatgatctgctatttttaaatgaatttgtaacttgtaggatgaactggcatctttaaaagaacaactagaagaaaaggaatctgaagtaaaaaggctacaagaaaaattggtttgcaagatgaaaggagaaggggttgaaattgttgatagaggtaagaagatatatttcacatttatcatctcattttgttaaagtcctccaaaatctgtaaaggaaaccaatgaaaatcaatgtgtagttttagcatcaaagaaagagcagcagaatccagccaggaccagaaccacaggggattctccaagactctttactgtgactgggaatccattaatttcctcttcagcagctggaaaaggggaattctgtactttatttggtgtttaagattgctagactgtaaattctcatcacaaggatggacttgtctcaattgcgatgcaagggaatttgtgccaaaggagttaaaaagaaccatccctgtgtcccgggatcgttgccctcagaactgaaattagataaagtaagggacttagaaactgttctgcccttttgagagaagagaaaaatggttctgtatctttggaaaaattagtaaaaaatttataccagggattgagccctccaccttttagaaaaataggctaattctgtttttggaaaaaatgcatgaatttgtccaaacttttttcataacagcagaggtttgttctgagtattatatggaccataatttctaacaaagcagattgtgcatgatagaaaatagcccgaatgaaatacatttttaaaattatatttggaaatataatgtgcataatatctgacaacactaggttaaatttaacctttctttgttattacgaatgatgactgtggccctatgagataccaaagcaatttctgagtcattcaaaacagtacaaattccagttagcgtagctttgttacatttttatccattttatgaacattagtaacattgtctgtccaatgagggacttgagttagattatctctaaagtccttcttggctctagaataccatggccttatacccctgcaggtatcacaattccctgtccgtcagaaaattcatcaagcctgaggaaaatggattctcaccaccaaccgcttcaccgccccaccccatcacctactgtttggcatatatataattgtgtattgataagggacattcagaaacaggtcatactgatcatgctttcagggttttaagaataaaatgggctggtttcagtggctcacacctgtaattccagtactttggaaggctgaggaaggaggatcgcttgaggccaggagttcaagaccagcctgggcaacacaatgagaccctgtctctacaaaaaatttctttttaagatttgaaatttttaaatttcaaatttcaccaggcatggtggctcactcctgtaatcccacctacttgggaggctgaggagggaggatcacttaaggcccaggagttcgaggctgtagtgagctatgactgtgtcactgcacttcagcctgggcaatggagcaagatcctgtctctgaaaaaaaaaaaaaaaaaaagaataaaatggcatcacaggacttgtgggctagaagatattagagtatgctccccaaagtctgatctgaggactcgaaccaacctgggaactgcgtgttaccagtgcccaccagctaactacggggattgagaacaagtctttagaaagctcatgtcagggtgatattgggatagcatctaactgcatcctcactggactcatcttactggacaggagatagaccctttcagtgttgttgaacttgagtggtgagttgcatgtgacacaagcagtgttctagtcacattcaggaggaccaggtatcaaaccgtgatggaaatataaaaacaaagtgacactaactaggttttcatcatttatggtataagaagtgcttgtagtccataaacctaattttaatgtgagaaaatcaaggtccagaaaaatgaagtgacagaggtagtaactcaaatttaggtcttctgttctctttctaacctcacatagagcattattgtactaccaatcctgcagtcacaaaatagtgctgaaaaagtttttatgaggttagatttccgttattttaggtaaaaagagactaaatagtagtgatttaaaaatattacttattgttgtaatgtatgctaacttccaatccaatgggttttcctgcacagatgaaaattttaaaaagaagctcaaagaaaaaagtaaggtttggtgcatttccatcagcctttacattcaccaaaaatactaccttggactgttctttgcatgtgttttaaaacatttctctcaccaaagatgtaaagttgcttcatcaataagccctccatttcttcagagtgtacacaatagagggtggataataaaacaataaggtaaaagattattttgaagattttgtctgattcaacctttccgctctacagtgtataaccgggcacacagcattgtggatgtaagaaaacattttccctgcagtctaggtgattcagggtcagaggagaaaataacttttatagtacgaaaactcacgattttaaaggtttaccagagttgaaagataattttgaaatttgcttttgcttttcaatgttttgaagtccactatttgtctgggatctattagaagctcctttgaacatattctgttgttacaacagagattgaatccagctgattcatggagcctgaatatttaatgcaacattaaggtaaatcctgccaggcatggtgggaggatcacttttgaggccaggggttcaagaccagcctgggcaacatagtgagatcctgtctctacaaaaaaaaatttaaaattagctgagcatggtggtgcatgcctgtagtcccagctactcaggaggctgaggtggaaggatcacttgagccccaggcatctaggagtttgaggctgcagtgagctatgatcttgccattgtagagtttgaggctgcagtgagctatgatcttgccattgtaccacggcctgggcaacactgacaccccatctcttaaaaaaaaaaaaaattaactccttaggggctctttcccccagatgttaaattctcaattcctatagaatatatcttaattgaaaatgttacaccaatgctgaatgatgcaccactgttttataacttatcttaagaagactggatgtggtggctcactcctgtaatcccaactcctcaagaggttgaggtgagaggatcactggagcccaggagttcagagctacagtaagctgtgattgtgccatgcactccatctgaatgacagaggaagatgctgtctctaaaaaaaagtattatcttcagtaattttttttttctcagaagcaggcaactttagctgattttttttttcctgtttgaattttttagtttgtgatttcattttggagtgacttttcatttatttatttatttgagacagggtcttgctatgttgcccaggctggtctcaaactcctgagctcaagcagtcctcccaccttggcctcccaaagtgctgggattacaggcatgagccaccacaccaggccctggagtgacttttcatctttaaaatatataagttttttattattcaagtaacatgcttttgtatttgaatatcaaattttaaggagaatcacattcagcttactttggcctttatgtcttgaaatctatcttaaggtagtattggaaatgaagtttatagatgaagcaaagtacttattatccttacgtatggaactacaaccagcttcttagcatgactactcatgtaaatactacaagccatcaggcacttaccgttcattcatgcctctatcttggttataactatcattttctctgcttttgtcattatatataccattcatggctttcacgcactgctttatagattcctgttttagaaacgttatgtttttattactatagcactgaaatttcatcttcagtgttctcatgaagattctcttgttgctttaagagaggatagctagttctcacacacccttgttttctttctagagtggcaactgttcaggtgaggtagaagatgtccatcttttcagatttttccaaaagagaatatgggtgttaaatgtgccctttttaaagaataaatgaaagaaatcattaacatctttaccttaaaatatttcagtctggagagtaaataacttcttatcactgtcacacatgtgaactgaactgacttctgatttgatgttattttcagacatcgaagtacaaaaaatgaaaaaagctgtggagtccttgatggcagcaaatgaagaaaaggtatccagatgaaatttaaatatacgtgtggatgttttttaacaccattttgaccattccatgcaatttcatgagctatgccattttaaaagaacatgcccagaacactgctaggagtgaggggcaggtgtgcacactcccaggtgggctgtatgcacaggaatagggaggagctgcactggctccactgagaactcctgcccccacgaattcagaaaatgttcaaactctctgatcagttccgcatattcacgtgacatgtaagagagaggatacattccatagtacctcctgtatgtgggcactgaaaattctgggctaacttttgggccctgaaggagctagcttgacagcctcagcttcatggtcatgttggttttgtcctccatttactcattatttcctttacactcctggcctgtttcacatctgtgattgtctctgctctcccgagagattaaataccagaaaacagcggcatgggctttacgttagctacactggctgcattccaaggtttccacaggtttcctccccccccagttggttcttgttatccacatgtgatgtttcgtcctgctaagggcagggatgcagttactgcacgaaagtaatgggtttcttcgtggcttacctgaccacgtatctagcaggcagccgcagctgtgttcagctgatgtcatcagaacttctctccccttatctgcctgaatgaatagaaccaggggacattttcccaaaaagaagagtcatttcaaggaagtaaaaaacaacaaaaagtcaaagaactttagcttgatctttttctcccatcgtaagtttctttctctcattcttgactcttctgtttttcttatctccttgtttatttttgcctcgcattctctttatttgctctttattgcctggaagtaaactgattgtcatgtctactcatataggttcctttttgctaatgtttcccactattgaataaaaaaaaagtaattagcaagctgcccactgtaacttttatttttttttaaatcactgaaattcattttgttttcatttctgtccctcaaaaagccacagcaaacaaaattcccagtgttgaatgagggcttatgagatgctcaaactgttagaggggcacccagcataacataacttcctcgtggggtcggggattcagaagacttcaaagaggacataatttgagcaaattctggggaagagcaagagttgttcatcaggaaaataaaggcttcttaggcaaagggtccatgaatcaaaacttgtctcgagaccaggtttgaaacagcgcagtgcatgctgggattgtgctggaacatgaagtgcaggtggagtcggggcgtggggctgaccacagagctaagtcagtgggcaggctacttcatacaccatggtcttgatttagggtcttagcttgtaaaccttaggcagtgacatgattacattgccattttagaaagctaactctggtagcagaatgggagagtgaagacagacaaacagttaagagtcagttaaaataggtgagaaatgaagagggcttgaagtaaggcaatagcagtgaagtgataaggtgggaagagcttttagagaaatttacgggttgacaagatttaagatctctggatttgaaaaacgagagaaaatttctggtttgggcaattgggtgaatggatgaatggatggttctcttaaggagttaaggaaatccaagcacagactcaagtactgaagggaaagaatgagcttaattgtagatatagtctattcaatatgcttatgggacattctaaaggagatttcttacagaaagttggaacataaatctaaattttaagattaatgtagaactatagattagtggggagtgagacccatcaattttaggagaaatgcagagttgtagattggtggggactaagccacagttgatgtgtcagttagcttttgctttgtgacaggccacatttattatttctcatacttctgtgagttggctaggtgattcttctgatctcggctggcttagctgatgtctacagtcagctggtggcttagatgagactgcatgcataatttaggatagtgtcactcacatgtccagtgattgacagcctagtttaggttggccccagctgggaggactagcctcttctccagatggtctcccatcctccagtagactaggctggacttcttcacgtagttcctcagggttccttagagccacaccacagggcagccacaaagggcaaatgttattcaagcctttgcttgaataacatttgctgatatctctttggccaaagccagccacatggccaggcccagaatgagaatgggaggcgctagggaggccattttcataacacagttgagcacatgggaaaagcaaagagggtcatggacagaacctggaagctctagcattttatagtccaagaagataatgggggttatggaagttcaacagctatctggtcaaaggattgagaaataaaaatcgaagaaaagaaagagtggatggataagtgaaaggagaaggaaagagtggggtcagtcaagtgccatatggaggtcaaattagaaaaaggttggggccgggcatggtggctcacgcctgtaatcccagcacttcaggaggccaaggtggacagattacttgagcccaggatttcaagaccagcctgggtgacatggtgaaaccccatctctacaaaaatacaaaaatgagctgggcatagtggtgcatgcgtgtactcccagcaactcaggaggctgaagtgggaggatgacttgagcccaggaggttgaggctgcagtgagccaagattgtaccactacactgcagcctgggtgacagagcgagaccctgtctcaaaaaaaaaaaaagagaaaaaggatgaaaagtgttcattgtttttaatagataggaggtcaccttggtagagtgttttaagaggggagaagccagatggtgattaatgatggctaataaagacagaagatgggggtctttcttttaaggtttgacttagagaggagagttattgaagctgacttttttctttttttgttttgtgtcttattaccttgttttgtttttgtttgtttaaagatggcagctaaaggataggatctctaaatttagaggtactttgcccatatgtttaatgtatgtaggaaacatagtctagttattaccagttctcctaaagcttagaagtattctttaaataaggtaaataattcacatctgcttattcttttttttaaatgctctctcggcagaatcatgcgtattctttatgtaattactattctttatgcaattctttatggaattactattactcttttaagaacataggattaaagattacaatttattttattcctaggatcggaaaatagaagatcttcgacagtgcctgaacaggtacaagaaaatgcaagacacggtggtactggcccaaggtaaaaaaggtagagtgtagctctaaaagtttttctactttggttgactctaagtggctataaacttacacatttggcctcaatttctttcctggatcatacccattgtcccaaattaggtagctaattcgttaattgaacaattaggcaactgtactctgccagaaagtgtccagcctgaggagtgagtgtactgtagagtcattggtcggggagtgcctctctaaggagttgatgagatagcattccagagagagaaaaacgacagtatatgcagagagcctagggggaaaagaatatggcatgcttaagaagaagaacaccagtgcaactgcaaggtggtgggcagtggggagaggggatgagatgagaccataatgatgagcaacctctggtagcgcaaggggtggagttaagctcttgctcaagtgcagagggactcactgaagggttttaaaagtcagcagtggtcaggcgtggtggcctacggctgtaatcccagcactttgggaggccaaggtgggtggatcacccaaggtcaggagttagagaccagcctgaccaacatggtgataccacgtctctactaaatacaaaaaaattagctgggcatgggggcaggcacctgtagtcccagctactcaggaggctgaggcaggagaatcgcctgaacccgggaagcggaggttgcagggagccgagattgcgccattgcactccagcctaggcggcagagtgagactcagtctcaaaaaaaaagtcagcagcatgacctttgtaacacgtgggccatggagggaagtgagcagtattgagagccgcagaaaccaattcagagatttgcagtattccaagtgaaaaaatctagtagttgctgattgggaatatgttatggttggattgacacagtggtgtaatgagatagaggaggagagtgaagaagggggaggaaatcaagaaagacgtttccaactaaagcaactgggtagatgatggttccattgactgatatggggaagcctagagaaggaacattgggctgggtaagggggattgagttcagctttgaacatggtgagttcagaaaaaccctgtaagacaggtacataaagagagttgtgcattttgttgtgtttattattattttatctgcagatgggccaattggccatcctcaaatgtggaggaaatttgaaagtgctcttgttttttagcaatgcataaatagagttatttgctcgcaacgtaagcactggatataaacaattcttttggaaggtccccatgaaacactcagattttgaagttttaattttgatgagttcacagagaaggaaaatcctgctttggatcaggatttttgaaaaaaaaaattttgtacacaaggtctggcataatcgattttataaatatctgagtgagcaaatgaacctctaataatcagtgttgactagcaattctcatcactcagcattttccatgccttcagaagaagagtctctatcctatggaatattgcaaatttgtaagtgattaatttttacatatgcctggcatttaaaatgttgtttgattttatagaatttcaactgtccaattcttacgtttaaaaccaaggcagaaaaaattaattcctgtaattagactatatcgtaaaacatttggaaaataaagaaaagagataaaaatcactcgtaattgcactggcatgatcactattggcatttttgtgtattgtttatttctagctttttttcctgtgcatacaaacgtgtaaatacaagaggtagtttttaacaatgtacagcagcacagattttcttaaacccttgaaaactatgttctgttccaataaagagttgtataaacagtgatttctcactaggagttatatttagttaatcctcatacaattctaataacactaaattctaatagaattagaataacattctagtgaaacctaaattaagaagctgtggtctgattaagatctttaaacaagtgtatgatttaccatgtcatattatttgtagattagcgtgttaagtatcatttttttctgtttttaaaaaagaatatctggcactgcgctgttcaccatttaatcccttttgatttctagagatgtaaaaaaaaattctcaagtttgcagctttggtgaatatgtggttggttttttccatcagacgttttttgctttaaaatgggataaaaggatcctcttgagagatcaaagatcatctgtctttttgttttttctgttctcctatgttttttcaagagcacagcagtgatgaaaactaagttgtttaaatgggactttgttgctattcacaattcgttttttgtaccaggtattcttcagtttgaatatttctacactaaaatttgtaagcccctgattttaaaacaaagttacaagagagttgttggaaaaagttaacttttaattttctttcaatctgatgagtcaatgtatcgagtatgactttgtctgttaatatcacaggtagccattgtggcccaagagcccttggccttagtttcaaatgctgtttcctaggtcctatgttgtttttcaagggctgccaggagaagctgactctgatttttgaggatcagaaaaaattttatattcgttataattgggattcttatcttcttgtaaaagtgaaatataaatcaaaagctgctgttgtcttctctttgttttatcttttcctaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagaggtattaatagactttcagtatttcctttatgttgaagagactgtgttactgaaaagttaaaacactgctcataacatgaaaaacatgggttcctttctcagttccatcaccaactcaagtgaggttatataaataaattgactttggccacttctgatggtgactctgaaagataattgaataaaattttcttctgacttctttagacttggaagaagcaactggagaggagtaaacagttatacactccttactttgcatcaaactggcaggaaaatctgtttgctgtctattgtacaccacaccgaaactttgtggcttcaatgacagcatttcttttgctgatgactctgcactttagcagggttcagcatgagcatctcgtctctgctctacttggcatcagctggagtggcgtgaaggcctgggcctgagtcatctgaaggctaactcactcatatgtctggtggttgaggctggcctttggctgggacctcagctgaggccccatttagaacaactacatgtgaccgcttggcttcctcacaatcctaagggtgagcattccaagaggcccgggcaactttgcatcgcctgttatgatttatctcagaaatcacatggcatctcttctgctgtagccacaggcctgcagcccacccagatacaaggagaggaaacatagaccctacctcttgatgaacaactgacaacattacattgttaggacacgtgggatgggaaatattggtgcaaccatatttggaaaatataatctaccctctggctacaccgctttacatccctctcccatgcaaaatacactcgccccctttccgaagacccctaagtcccattccagtgaggcgtcagcatcccaggatcttgtcacccagaccaggtcgagatgtgggtgaagctcctcaggtacagttccttgcgcatagcttcttgaggactctttcattgaattaaagagctgtggatttcaaggacagttatctgccctccacacacccatacgatggttggataggcataatgtaactgcagtagccactcccattaaaaagggggagctggaaggctcacaggtgtcaccagtccatagcaattccaaaatccagccaggcacatgttgccaatcctctgggctattggctcttccctctaagtcatgcttcctttgcctatatttgcagatgagtagttttctcagttttgtgcctgcagaagtgcccaaagatatccaaattcatctcttcattttccattatctctgttcctttgagtctaatttagtgtaatactttaaacatttagaatttcatacgaatcatgttataattcactgcattacagaagaacacatccacagctatcttcaccataagcctatctctagctaagtttccctgtaaggctgcagtgggacatcccattatttttagagcctttcatcatttttcagaggttcaatgagaccgcactactgtaatcttcctaaggtatttttttttctatttttatttgattctagtctagtccatcctgaggtcttagcaaagggttttacagccacatccttggctcacctgaagaccatgttttcctgatagcccttgtgcttgatctttgccctgaaaccatttcttaattttagtgtaatttttttttgtctagaaagaccgggaatgggaaatagtttcattgtttaaacaatcttggcttccttattttagcagttccttttttggtcatttctcttctcacattttactataggtagtgagaagaaaccaagtggcatttttacttttatatctgttgctgataattacacaacaagaagatgaaatttgaatgcaatgaaaatgaattcaagaagaaaacattgaaaatttctcacttaaatgtaggagagggctgaaatatttcattaatcaaggaattagttaaggaataagaaatactttggtggaaaatatcccctaattgttagatatatatttatatcgaaagcaaaaataatatttgacagtcaacgagtgtgctgcagttacagaactagtgttacatgtagggtatatccaaataatcccatatccttttagaaaaagtctttgctatgtgaattgtagttttaagtttgtaacaagaatggtttgatgagggttgagggagttcagcgacatttttaaagaaaagccaggagggagatctgagtttggagttaaagtcttaaagtttgaaaaagatcaagaaaattgatctgttagtatagttatattttccccatgattaggaatctcaagagacaaatgaacttcaggaaacagtgatgatggctaaataagttgcccaggattcatcataaagattcaaactgaaaagattgatagttaaataatctgctactttataataattcgacttcacattttataaccttttattgtgttaaaggatgagaccaccactgaataacataaacaaaaatcacaaagctgaatgtattgcttacttaagtaagtgagtgttcccggtccagtacattctcttctagctgatcatatgtagggtttttgagatggttggagctcaagggttggtggactttctgaggcaagtgagagtcgacatccactgtagatgtgtggttactaaggtgagactgttgctgactggttggcgtgtagaagggtgttcactggtgtgagtctttatcaggcagctttcagaggtgaagaactgtcactggttgactggcaggagttcattgtggcaaactttgttcatttttttttttactgaaatatttttcatttattcatttatgatgtggcctgcaatctaactgctctacagttgtaaaaaattattgaaaactgaagtattaaaattatttcacagactccttccttaggatgcacaaagcatttgtttgagaaaatgtattatgcattttatatgttgctgtaatattattattatcattaagcaaagtgttttaagtggtagccacaaagtccattgtaattggttttaattacacttttcatcaattatgttaattgaaattagtcaactagtacacacatagaataataattaactggcttgaccaatgttccatataagattagtagtagaaattaaagtaaaaatggagcttttcgctgggcacagtggctcatgcctgtaatcccactttgggaggctgaggcaggaggactgctcgagcacagagttccagattagcctgggcaacatagggaaaccgtgtttctacaaaaaaattttaaacattagccagctgtggtggcgcacgcctgtagtcccaactacttgatagggctaagttgggaggatcactttagcccagaagttcaaggctgcagtgagccatgatcgcagcactgtactttagtgtggatgacaaagtgagaccctgtctcaaaaaaaaaaaaaaaaaataataataataataataatagagtgttgaaagcaaaacgtgttacccaaatcttacaataaatcattgcaacctgcaggggtaggcattgtcattcttattttacagagggtgaaactgatggatgcctagcgaagttatttgctaagatcaccgatcacttaggcaagtgtgtcagaaccaacatttcatccagggcttaaggttgttaggatttattattactagctgggtacagtggcacacgtctataaccttagctactcaggaggctacggcaggagactgcttgagccgaggagttcaagaccattctgggcaacatagcaagacgccgtctcaaaaaaaagaaaaaaaaattactattaacttacttaatggtataccgtcttattcacaatattcagtgtcttattcagaaccaagttaaaaagtttccttcctccagaatgatttccttgattagtactccttctatatagatgtttatattctgaaatcattttatacagttctgaacactgattatgagattttgtcaatagaccgtttaattttcttatgtttatttaaattactctgtggcttgtgttttgttttgattgattgattgattttttgtaattacattacagttccatactaccatcttgcaagtttccatcccttcattattgccagcaactgtaagcatggaaacttctgaaaaatcaaagttgactcctaagccagagacttcatttgaagaaaagtatgtcatttattaacagtgcaatataaatgttcaaaaaagtagatcagccaaagacaaggatgtattgcatttatttacagacacaatttttacctagagaagcaagaaactgcaagatgtccactgggggatctgtaatcagttctgtattatggaaataaaaggtgtgaagcaggaaataataagagatcaggctggggaggtagggttgtcaggttagaaagagattttaaggaacttggccaagtgtggtggctcacgcctgtaatctcagcactttggaaggccaaggtgggcagatcacttgaggccaggagtttgagaccagcctggccaacatggcgaaatcccgtctttactgaaaatacaaaaattagctgagtatggtggcacacgcctgtaatcccagctactcagaggctgaggcacaggaatcacataagcccaggaagcggaggctgaagtgagccgagatcacatcactctactccagcctgggtgacagagcgagactctgtctcaaaaagaaaaaaaaaaaagtttagggaacttggatttttatatccgaggtcataggtaactgtcaaaggattgtaaactaaatagtcacagtcacgggctgtaagtgtgtttgaaggatgggtctgaaggggacaggaaaaggatacagtagtttgtctctaagaaaatagaatgttttgccaacatattcccagattgtctagtcttattttaggccaaataaaataggacatttaaaaaaatagaaatagcttcctttgcataattttttgtttttgacttatctgttcacttagaacatatatggtcttttattcgtgaagttaataaataccttttgttctttacattttagtgatggaaacataatccttggtgccactgttgatacccaactgtgtgataaacttttgtaagttacattttattgaatgtgaaaaatgtgattgaggctagagaaagagagttctgttatactaacaattactaatattaacagcaaatgaccgaggctgttaaattactgaataaatcaatgtagctataataattgggtgggggtgaaggtggggagctgtaagtttacaaagaaataatttctgatttgctattatctcatgccagggttttgcagatctcatgccggggttttgcaggtctctagccttgcttcatcagttttcatttgaagttcaatgcttttaattcatttttgcactgacatattttgagtccagtgggaaggcatcacagggaatgatgtgatgcttggaaagctgagatgggtttttttgcactttcagttttatgaactgacctaatatctgtgtttatccaagttaaagtctggattaaattaggaaagtctattttcagagcagtactcaaaaatgagatcttttctttctcactattatcttttactttatttggtagttgatacttctggcaatacacctaaatacagaagaaatgccttttgaaagtttgtaaatgtgcatatttatattattctgtttcgtagaggcaaatacattacttctctgtcactctctctaaactggtcacatatctctaccttcaagtttttagtaacaccagctctatataattgaatattaattatgtgaaagagaaagtctctggatgtttatagtgtctctttgccttcactaggatagcaaatgaattattatgggcagcattagggattcctctactatgctttaattagaactataaaatgaattgctttgccagactcagaaatgtgattcccttgtgaattgaaaagtgaaacttccattctttattttaattagaaggattagatataaatagtacgtgagtatttttaaagttcctagtacatgcagaggatgcagcactagtccatggaaaacactgctttattttcgaatattgacatcacaaggctagtcctaagtgcttttccagctcttctaacatgtgcagaacagttagaattattggcaggacagttaatcacccctgcttttaaaagaactaaatgttgtcatttagtgaagcacataagtgactgcctgattccagattttcttttattgccaggattcaacccacacgcaattttagtttctttccaagatgttttacttagaaacagtggcactggagccacttattattaattgttattactgttatttttagaacttcaagtctgcagaagtccagcagcctgggcaatctgaagaaagagacatctgatggggtgggttctgtgttttttgtttttttttgtctgttatcctgagaaaaaactatttagggatcttcatcttttccctttttgcaaataaaactcttatgaagagcttgtggtttttagtggaaaattattagatgttaggtttaacagtaaatattaagaagtatgaatatgaaggattgaaaatagtatgtaaaaccaaaaatggagactttaataaaacattttggaaaataaacaatactaagattttgtagcttagaagtagatataaaattattttaacttatggagttgtatgtgacaaattcagaattatacaaaggatttccctaacaaccttaaatattgttattgctttgaacaggaaaaggaaactattcagaagacttcagaggtaactttttgtccaaattacaatgcaaaaatatttctacttccattacatgtaaattgcttaaatgtctccagtagataaaaactttcagaacctctagaacattatgctaaatgaagccagacacaaagttcacatattatatgattccgtttatgtgaaacatccagaacagataaatctatagaaatagaatgcagatcggtggttaccagtggtaagaggtgggaaaaatggggagaagctgtttaagggtaaggggttttgctttcgaatgatggaaatgttttggaagcaggtagaggtggtggttgcacaacatcgtaacatactaaatgccactgaattgtgcactttaaaattgttaattttgttatgaatttcacttcagtaagttattaaaaaacaaaaccatagtctctcagtcatgctacttaatgttcctaatgaccataactgagcttccttagacctccccaaaagcccttcttagattaccattagattatacacccggtgcccatctaaagcaaacattttggtatgtttaaagatgtcgtcaacatgtgctcaattcttctttcccctgatttttttttttttttttttttgaaatggtatcactttgtcgtccaggctggagtgcagtggtgcaattataactcactgtagcctcgatttcctgggctcaggtgattttcccacttcagcctttcaagtagctgggattacaggcgtgcaccaccatactcggctgtttttttttttcgtttgtttttttttttattttttattttttaagtacagatgagatcttgtcatgttgcctaggctgatcttgaactcctgagctcaagtaatcctcccacctctgcctttcaaagtactgggattacaggcatgagccactgtgcctgttctgtcctctgattttctgtcattaaccttgtgaagattacagcctgataggctacctccagatccagtctcttgactgttggctcttagtgcctgagtcatatgtggatagaattgacaaagcagccagtggtgacagctataattaaaatccttgttgtcttttcagttcaataaatggttaaatgattttgacgtcattgttgagccatggatgataatatcactaaattgtgccatctgtaaacttttggtttctatgagctgtagatatatagagtaaaataaccacctaaaatacctatatcccctcacccttttctctgcttctgtaaaaaaagaagcagagggcaagaattatttctacttctgcaaaaaaaagaagcagagggaaagaatagagaaatgaaaacaagaagacaaaagtatctttgtataaaggacacccacttcaataaatggtgctgggaaaattagatatccatatgtagaagaatgaaattggacttcacctgtcaccaaatcaacaaaaatcaactcaagatggattaagaacttacatataagaccagaaactataaaactgctagatgaaaacataggggaaacacttcatgacattgatctaggcaaagcatctttgtataaatactaaaataatatactgtgttacagctggctctaattgcccattcaaagaaccaaaaagctcaaaataaagttgctcactgtgccttcattttcttattctttgaggagaatatttaaaataactggaatagaatctccttatactgctggtatagaagtttgaactaatgcctgctttgtagaataattaatattatattaggcttctattgacaaagttataatataagaatatgaactgtattatagctaaatccgtgacataattgttagaaaagtcagaaatctgctgctattattctggttatgtaatgtctccatgtcttttgaggaatgaggcaaacaaaatttaagaatttttgtatcctaaatatttaaagccctagacatatcgattctagattagtgatgaacatgttttccttgttgcttttgttgttgtttcttaagtagctttcagaattgattttttttcaacttctgataaggcatttgacattggtgatcaatgtattagttcagttattcttttgaataaactcatggatgtggcgtgagtgagtatttgctgttagcctggcatgtgctgaggatgctgcacctgagagctgtttcactattcttatttgcctctcaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttaggtacgtatgaccaaaatgcctttgccctaattcttccacaaggaggaaaagagcagtgtcttcccttcccttactctttcattcattgattcatttctctttctcagaaacgaaggtgaatgacttaggggaatttagcaaaaaatgcctccgtggatttaatttagtgttgtgaagatatatagactctcaccctgctctctcctgtggtataaacttagcggaaagacctaaaatcatgattccctttgacttcatcatggagtttcccatctgttgtgatagtggataaattaacattgacgttgagcctgtgtgtaacatcagaagcactgtgtgccgcatgcctctcctccacggtgtgtatttggcgaggaggagtctgatctgcatttcattttgtcatctctgtgttctctccattgggctgcgtgtgattgtgtgcgttgttgggatatctgaagatcgtaaacgaagtgccagtgcacccaccctaggtattgtacccctgcatgccagccttcaccagcactgtgctccaaaccaatctaatccctgctcttggcatctgtgatctctagaaagcgatctgacagcaatcagaaaatgtagttctctattccggagtgttctttccaccttctgctaaaaaggactctgtagaggctttgcttccaagcctaaatgctgttttaaccaatactagtaacactcactgtgtgaatagctttgagaggacctagacgtgtgcagcatccctcagagtgcagggcaggaatgtcctggcattgtacattgcagctctttcagccttgaagtgcatattaccacacactaactcccaggtccttgcagtccgttctccatgcttacatttcccccagcctccaaaaagaaatttttttggccatatagggaggtttatagaagacattgaatattatagttttaggcttacttctcttaggggaacattcttctgacgttttattactttgaagatggagataatatttagtgatgacagaagcaactttacttgatatctgaggcgttaccccccaaagtgattttagaagaggggcagctcagttttcctctttgtaaggcaggggacaaatggggaaaaaagttctcaaaataaaaaagagaaatatggtagttttaagatgaggataagctaggcagcattttcaggggcacctgtagccatcgtggttgaaggatttgaattgggaaagttcctttgggtttttccaaaaggtgctgttaccttgtatagatatccacctatctattcacatggaccagcaaacgggacttctctctctatcgatataaatgtctagaatgaacactggatgcataaaataaactgatctgttcagacaactattttcaaatagtttttttttgcatctttcttagaagaactgttttgttaatgctaagaggtaaatgctgcttattataacctataatcacagctctgctttgtagaaaaatcaactttctgcaactcatagatcttgctgaaacactgttcttgtgattttagtacaacttttactttcttttataaagtataaaatctcacactgaagacaacagtagcccttgtgtttgctagtatgggattgtccactaagggacagctaaaagaactgaaatagttaatgcttggagatctgagagtggcaactgtggatgtgattcttttaaggtaaaatcaacaggcacttactttatgtcaaaagaaaaattaggcatatccagttcattcttctctcagtgcctaggatttaatagattggaatacatttcaaaaataaagaattgcttgaactgggtaactgatttgatgtaaatgccaaaggagaaggagtaaaaggaaaatgacatagagtctgagctagagtaacagggacagtattaattaatattaaccaaatatcaaataagaacatttaagagacgaggccaggcgtggtggctcacgcctgtaatctcagcactttgggaggccgaggtgggtggatcacgaggtcaggagttcaagaccagcctggccaagatggtgaaaccctgtctctactaaaaatacaaaaattagccaggtgtggtggcgggtgcctgtaatcccagctacctgggacactgaggcagagaattgcttgaacccagtaggcggaggttgcagtaagccgagatcatgtcactgcactccagcctgggaaacagagtgagactctgtctcaaaaaaaaaaaaaaaaaaaaaaaaacatttaagagagaaaaagactctcggggaaattggatgagtttgtgaagtcccagatgtcccgacacactgaattgggaatatcacaggcatttagatacagagcctagagagagagattaggcccagagattctgatcctctagagggcatttagaatataatcttaaagtggcatgggggaagaaaaaaaagcaggggtgctacagcaaagacactatcagatgacagatgtaggagagtggtcatgtcaagaagcaaaaggagatgattttgaaggatgtagcaggtaatcaacagtaccacgtgctatggaaagattgggaataattccattatgaattgaaatcactcaaggaaagaatgtggcaatcctatcacattcttttaatctccaaagggcttgtaattttattaagtttacacacagtaaactatggagcagaacgtatatgtgtgttccatttctaatatttacaaggtgctctttgtaagtcactgattatagaccaacagaagaattcttaacagttctagaaccaagaagattaacatcatgtttattccatattttaaaattcattgtctgcattctgctcttggagtagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaagtaagtaaagcagtaaacaagtggaatgggccctgtcttacatgttgcttaaaagtggctggacatgggtatggactttgtaaggcctttgtattcctcttatggaaggaagtttggattgtgatgtgggatttattaactcattgggtcttagttaaagtttaaatttaaatgtctatgttaacaacacaaagaggattagttccagtaggtgcactagttaaaaatgttctgattaacaagtctaaggcctcctcaggtctaatactggccatgtgtgttgtcttctttagacttaggagaagtcaatcaactacattcaacccagatgacatgtctgagcctgaattcaaaagaggagggacaagggcaaccgcggggccccgattaggttggtctcgagacttgggacagtctaacaggtaagaagagccaactgatagacttttgcatctctaccaagcatcatagcctcatgagtcctgcagtattagtactgtcattgggttaaacaaagtcattgcttaatgctgtgcctaatgaaaggggccatcatctttagagccgtgcaatttgtcaatggttgatgaacaaacagaaggtgagggctgtgcgaactaggggagaggccagagctaaagtgtcagcagcatctgtgttagaatggctctcagacttaaattttacgtagatggtaattacaagtactctaaagcataactttggaaagatgggatagcatagtggttaagagtatgttctagaatcagaccacttggatttgctttctggccttaccactttctaccagctgggtgaccttgagcaacagcttccacaccctgtgcctcagtctcctcatcatcataattagtacctaccccaaaagctgaccatgaaggttaaataagttaatatgtgttaaatatttggcagataataactactcaagaaacattagcatgtaacagaatctatgaaagcacttaaagacaaaaatgctatcagaatccttgtatttatcaggactatataatattttatccattaagattctaagaactgctctgacactcttaaccaaagtttagggctggcttagaactactacattgactcactgtgcataagagggtggggttggcaaacataaagtacaagacattgataccaaatcttttaacagtataatagactgactagaaaccctttacatatagcccctcccatacaggtggaacactggacataggttacatcaaggaggaaactctctttggccttcttcaaataccaaacagtttcatttgccatatgttgtctttgaacacagtagagctccttgtactatttaaaaaaaaccattcatcttcccctccgcaccctgcccccaccccggaacaagaacactatttgtgtatctaagtaaaagaaaacaggaattttgctttgattgtttcctacactcagtgacaacatattgccctcttctcattggttaccatatggaaagaaaccataattctgctaaagttagttcaaattagacttaagtttctttcagtccaactgagtttcctgtttgggaatccaatcttcaaacaacattggttaaaactgatacagtgacttgtgtttgtccaatttggtctttttctgtagcacttgttcttgctctatcacgttaaatcttttgtggtttcatttgaaatgaagacagtggtcttagaagataactttcaaccagttgttcctccaatgtatactaaaaattaagcttttcatggtcaaatgtgtatcaccagggaatttccatgtctattgaatgtatagttgtttaaaactaatgataagccacaggattggctttggattatttttcatgcaattactcattttcctgtagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggtgactgcttctctgttttgttcacacaatggatactgagaagaaaacagtatgaatgtagggttgttttatagtccagaaagggccatgagtgaagccagtaaaaactctgtaaacaaaagtttgggttttcaattgcttcatgcttcttttttctggtggtcttgggaggacctggtcttgatgattccttatggaacacttaagccattgggcattttaatgaaaaagaattacataagcataattcagttcatatttctcgaaatcattgtttggctttatcattggcctgtttttctcagtgtaagatatgcaattaacttcactttgcaaaagaaaaaaaaaaagcaccctacaatttgtgtctaattatttaacatttcttccaaattatttaatattttgtacaaaataagagtcaaattctttttatgcatgctacagttcctagcttacaaagaaaatgagtcactagggaatgcctaacacacccctaagataattgtggtggtcttggcttttcagggaccttttgttcaacaacactttactagcccaagttgggattgtaattcagtattgaattgggtctttaatgctagcttcattttggagaaatttgcatcctttgccagtggcacccagcctatacagatagaattataaagtcaatgtttattgtttcaggaacttggaatcaagcattcacttcatcgaaagaaactccagctagcactccaagccctgggatctgaagaagaaaccaatcatgggaagctggatttcaactgggtcactagtaagaagtttttattctaacaaaatgaaataattatatacatagttgctttttctttttaatcacaagaacagatgttttgtggcatggtagcaacactggcctctctcttttaggatggttggatgacattggcctccctcaatataagacccagtttgatgaaggacgggttgatggtcgaatgctacattacatgactgttgtaagtgactcactcctggggtttgggggaggaaaactttttttctctgaaaaacacaggaattgagtaagccaaacacagtgttttcagtgattccaccagagtttgaagctgttgcttgaacttgaggagagtggcaggcatatttcccatgaggctgaagttgtagcatttggtgattgtgattgaacaggcttgggataatttgaaaccccaatgtaagctaagtgaagcctaatttaaactaagctctccagaaggttgattttatatgtaatacattcaacaaagtaaacactgaagtgtacactttgaatgggtacattttatggtatgcaaattatatctcataaagattttttttgtattatttcttttgagatggagtctcgctctgtcacccaggctggagtgcaatgacgtgatctcagctcactgtaacctctacctcccaggttcaagccattctcctgcctcagcctcccgagtagctgggattacaggctcacgccaccatacccagctaatttttttgtatttttagtagagacggagtttcgccatgttggccagctggtctcaaactcctgacctcaagcgacctgcctgcctcggcctcccaaagtgctggaattataggcatgagtcaacacgcccagcctaaagatattttttaaatagaatgtagaatttttaagcccaagctatctctaagttatgggtttctatgtgcaatgaccatttggaagaggccacccttttgacctgacatcttcaaggacttgtcttctcctttccactctggacaactgttacctgaaaccctatcacccgtctcacttcagcctagttctgctacagcaggagttactggggttaaaggaggagggaggaaggctagacttctactctggttccttcattattgtacatttctagccctccagccaatgtgtaggactattccctgctttacagcagtgagaaagatggattccaggagaactttgttttaggttccataccactattaatgttctacttaaaattctctttatttatttatttttatttttatttttattttattttattttattttgagacggagtctcgctctgtcgcccaggctggagtgcagtggtgcgatctcggctcactgcaacctccctctcctgggttcatgccattctcctgcctcagcctcccaagtagctgggactacaggcacctgccaccatgcctggctaattttttgtatttttaatagagacggggtttcaccatgttagccaggatggtctcgatctcctgacctcgttatccacccaccttggcctcccaaagtgctgggattacaggcgtgagccaccgagcctggccttgttctacttaaaattcttttatttatttatttattttggagacagagtctcactctgctgcccaggctggagcgcagtggcacaatcttggctcatggcaacctccacctcccaggttcaagtgattctcctgcctcagccacccgagtagctgggattacaggtgcacaccactgctcctggctaatttttgtgtttttggtggagatggagtttcgccatgttggccaggctggtctggaacttctgacctcaggagatccacctgcctcggcctcccaaagtgctgggattacaggcgtgagccactgtgcccggcctaaaattcttttatttaaacagctttttgtgaagtaggctatagacctaactaccctaagtataatctttttcaagtaagtagcaagttttaaacagccaacttaagtaggcatttctcaatgtcaaaaaaatttggagttcagttcatggatttttcttctctgtcattgaacccaagccccttaccttgatgagcacatcacataaacctgcgtgaaataatactaatatgtgtagtatgttgcacatttgctatgtgtcaaacatccttttaagcattttgctcatattaatactggattctcaataacccttttagttaatattactaatattattatagtgtgtataatatatattaaaaagtttttaaaactttttattttaagataattttagatttacagaggagttgccaaagctagaattctgtatacctttcactcagcttcctctaacgttaacatcttacgtaatcatgattacattcatcaaaattaagaaattaacgtagatgttaatacaatcaactaaactgaagactattcacatttcaccagtttttccagtaaggtcctccttctgttccaggatctaatctaggacactacattaaaacacacattttgtgacttacgacttctggggtcaaattttccagggtcatttactcttttatagccatttcacatacgctgcttgtgattttaagcttgaatttgttcacatatatactatataattatgtaatactgtatatacatagtattatacacacatatgtaatactgtagatacatagagtatgtatatatatatatacacacacatacacatatatgcatgtttgtatatatgtgtgtgtgtatccatatacacacacacacacactctgtgtatctatagtattataatactattattatccctacttttttacatgtataaaggaaggaatcgagaggttgggtaacttggtaaccaagtttccacagttagcaatagaaagtcatagagagtttgaactcaggctgtttcaagatccctgcttttaatagctcacgattatgactagaacacattcagtaaatatttgcctccctctctaagtgtgagtatgttccccctgagaatgtgaacaaattcaagcttaaaatcacaagaagcatctgtgaaatggctataaaagagtaaatgaccctggaaaatttgaccccagaaatcctaagtcacaaaatatgtgttttaatgtggattagatcctggaacagaagaaggaccttactggacaaactggtgaaatgtgaataaagtctgcaatttagtcaattgtacattaatttcttagtcttgatgaatgtaatcatgattatgtcagatgttaacattagaggaggctgagtgaaaggtatacagaattctattctatctttggcaactcctccacaaatttaaaattattttaaaataaaaagttttaaaaaaattgggaagaaaatcactcagaaagtctgttttgatataaaataaaactttctttttaaaatccttcgaagtataaagaatttcaaaaataattaacattttaatcacactgtaaacattgtgcattcagatatttttttaagctgacagactagttagatgaaaagagtccagactgaaatgtttggaatgggtgtctcaatcctagattaaaataagtactctttctaacatgtcttaagacactacttttaaggaattactccagaaaaacttcaggaaataatttttgcctggttagtagcctcaaggatttaaactgattaatatttttattaaatatttctgtagtagattacatttttttctttctttcatgagaagtgttttatcagaaaggtgtgtctaaaatggatgctttccttgtttattttctgggtgtgtttggaagtagactgttgcttatcttcatactgctcccaatatcaccttcttctgaaataatttgttttggtgtgtttggtatatttgaaaatattcccaagagccacagactggtgaaaattcttccttgaaggggttgattggtaatatatatatgtgatacttataacttcatttttcttctctccttgactctgaccaaaacctttgcactgattgattatagttgtgccaaaattgttcacaatgtctgctagataaaccataataatctagagctattcaatagcagacaggtccttactaaaaaataatttagaactagagaattattaaggtcagggaatagtataataagagcactgttctgattttccccaaaattatgatgtgccttagttcagaaaacccagccttgctaggagcggtgcctcacgcctgtaatcccagctttttgggcggctgaggccgggggactgcttgagcctaggagtttgagatagcctgggcagtatagtgagatcctatctctccaaaaaaaaaaaagatgaaaaaagaaagccaactcttgatcatgttcaccaatgagcatcattcgctcttcactatctgctgaaaggaaacagagagggcagtttatccaaagcctaagtactttatccaccgataaagttctcaaaactaaagaggaaacaaataaattccctgtttgtagtatgtgcagatcaagtcaaagcagatcaccttttgtagtgacccagcaagtgcttttctaactgtgtttttcagagccctggggttctacagatctcagagcatctggaagagagagaaacaggtggaagtcagcttcattggcaaaaaatactaatctggggtttgggggaagattttgttccaaatgggaaagtgggttctgacaagaccttggggcatattggtttgaggggctcttctccttttactccagttttctgagattccctaagaaagtcctcctgctacaggccagcacagtgagctcctccttttgttcttttttgcaggatgacttactgtctctgaaggttgtaagtgtgctacaccatctcagtatcaaaagggccatccaggtcctgaggatcaataactttgaaccaaactgtctacggaggcggccatctgatgaggtagtgttttaagattgaggtttataagcatgcacttcccaggcatgggactgtccatgtgtcgaaactaagagccatttttcttggagcctgcaggaaaagccttaaaatccagcctcatttacttcttaggctttttctgtattccttccttttctctccatgacggttccccttgtgtaactaaagccaagggttctttttcagttatgcttcttccttttcttgggtgtatttttttttcctgactctaatcaacagagataaatatcactataaagacttccttttctggccaagtatagtggccaatgcctataatcccagcactttgggaggccaaggcagaagaatcacttgagcccaggagatcaagaccagcctgggcaacataggaagaccctgtctctacaaaaataataataaattagccaggcatggtgggtgcacgctggtggtcccagctactcaggaggctgaggtaggaggatccgtctgagcctgggagatggaggctgcagtgagccctgattataccactgcaacgccagcgtgggtaagagaattagaccctgtcttaaaaaaaaaaaagacttcctttcctaaagcaatgctttattagtatataagaaagcttgaaactcaaactatgacagaaattctttaaaagagaatttttccctttctttttgcatttagtgggttgttgagtaactgtactccatggagcagactttttagacagaaaatgcaatttaatatttaggatcctggttgtgtgttcccatagaataccatcgccccatcagaagttcagaagtggactaaccatcgagtgatggagtggctgcgctccgtggacttggcagaatatgcgcccaatctcagaggcagtggtgtccatggtgggctcatggtaaagctctgatttaatttaaaattgacttactttgcttcctttagtctagtcagtaggatattatcaatttttgcttatcataatcctaaagtcatctgactcaaccctcctgccctatttctagtaaacctttactttcagagtatttgtattgatatcttataactctagattgaatttaaagccagttctcttttattgtcctctttcatgttgaataacatgtagctgctttctctcatatgatcatgtttgaaaacccctgcaaggatgcagattgtatttctgcatgttaatgttgcttaaggaggtggctcccacagacagcaccctagagaggcagagcactgatattgggatgcctgaagcctggatttcaggaccagctctatcactcactaacttgggagaaatggagaaaagatatgtaaattaaagatcaaagtccatattgtgtctacctcaccgggctgttgagaggatcattggagataacctaagagaaagctttgcaaattataaagcacaatacaaacatgtatgatttgtggtgacttttgacaagcttttttttttttctttaaacaggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaaggttggttcaggctcatacggtttaataattgcttggcgcaaaggcaacgttttgtcggttacctggttattctgttttctggggtttactaagttttgtgggtgggttccttaccagcagatgcaggaatcctcagcgcttagttgtcttgggagaaagatgttggccaatagacagttgacagatagagagctttattgaagggaaatagggagcaaagagcttattgtaagaataaaaaaaaaagaagaagaagtacaggggctgatcctgcagggaaaacagcagggtcgcagtaacaatgtttatttaaagggacagtacactccaaaaaccaaggcacagcgggctgctgaaagagaatgagcccaagagttctgcattgggtttttatgatgtccagttttttcttgaagctctcaccactgtgttaagtctctgccttttttatctcgttttcccgctcctgccttgagtccttgccttctccctgcctagttcccaacccaggcttgtgggaccctcccttaactatagttggtgcgcatgcgtgggccgggtgttggctgcacttccacctaaaggctgcattgctcattcccgccgccccaggaaggttgtataccagtcaaatctatacgtactgtacctgcgtttctcttaggaattctcctttaccttcttcccctctttatcagcatgcagctagctacattctggcaggtgatctgcagagtgagtgattactgggcgtcttaaggggcgttcctttctgcataggtatttcccctcctctctgctcaaatggagcatgcatgttttgggtggtttctggggtgcgagattttccagacctctcttttctcaggggcttcccctcatgtctagctatctgcccactctaacaagttgaaggaacagttgacccttgaagaacatgagtttgaattacacaggtccactcctactcggatttttttttttcaagcaaatgtggagggatgcaaaccccacatatagggaggcccaactttttaggtacacgggtactgctggacttgagtatgtacggattttggtatacatgggggtcttggaactaatgctctgtgtatactgagggacaactgagtatatatcttttaaaagtataataattaagagaatgcacccagatagctcagtcagtagagcatcagacttttaatctgagggtccaaggttcatgtccctttttgggtgttccctcttaggtgggcatggtggctcatgcctgtagtcccagtgcattgggaggccaaggcaggaggatcacctgagtccagtagttcaaggctgcaatgagctctgattgagctatgagcatgctactgcactccagcctggacaacagagcaagattctgcctctaaaaaaataataatgaacagcataatattggcttccataatccatgtattggcaatgcagacagcccataacttgggtccaaatattgattgcagttgttctgtttttataaatcaagtacagaagagaggtttctcttgtacagatttagcttctctggcttatgattgaccagcctcgtaaataggaaaatacactttaaaaatgattgaaggtgggccagaagagaatgggtatttcctagtttacctggatttatggatcataccaaattcagattactttttcttctttaaaattaatcctagattaactcttctaaatatgttatcccaaccaacttgatgggttactgggtcctccagaaatttgtgccaaagttctttttaatttttttttaccccctctatctgcctgagtatccagtgaccaacccagtgaccatcatggagtttctcttctaagtatcactgatgtttcctctccaaaaaattcttttagcagtcaccagtcctgttatggaagcagaataggcatacaagataattatagcctcacccaaagaaaaaatatagtgaagtctattctattttgctaatcttagattgaaaaaccttgcaaaattggattcagctgtgagaaatctcattgcattaagtcctgtctaatcaaaactatgaagccaggtgcagtggcttgtgcctgtagtttcagctactccagaggctgaggcaggaggatcccttgagcccaggagtttgaggccagcctgggcaacatagcaagattctgtctctaaaaataatagtaatgatgtaatcaaattattcttgccatattttgtttatcacggtgactattcagctatttggcgtgaataagaagaataaggttaatttcctgagattcataacaagggtcatttatcattgcatcatttatatgcctaggatgcccttttgtttttatccatatttaaacatccagctacttttctctctaccatggggtaaataattaaattatacatataggagggagggggcaacgcaaaaaaaaatcacatgttatcaggccttgattatatgaattttatcaaatcctttggatgtttttgtttgcttttcttttaaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcaggtaaatccaacactgtataactttttgcgagttcttccatcattcagacactaaatgggaactttgtatactgtgtctgatcaaggacattttcttcaaataactaaaaatacagataataatagtgaacacttagagatcacttatatcttccaggtaccatcctaagcacttaatgcatactatgtttatggtaaccttaagacatggagagcattgttattctcattttggagataaggaaactgaggcacagagagctaagtaacttgcccaaggtccccaacctgtctctttggctccaaagcctgtcatatttaccaatattttgccatctctgtattaaaacatgttaggaatggacaggttattctacctagccttttcagattaaagtcgtgggaccgcatatttcccctctaatcaacaatgctttgctactattagcaaaggcattagactagctgtgtcagtaaagtgtctcttctaatttttcacttccagttgcagtggtgaaaggagattatcaccagaagtgttctgttgctcttaccccattcagtgctatttgcattatttcttcttagacttttgttcctcctgctgcactttccctgaaattgtgaaaacacttatgtcatgttatggtttgttatttgcagatggaagattcagaagggacagtgagacagataggtgcattctctgaaggcatcaacaatctgacggtgagtttgtgaaatgaattgaaaatgttattctataaatgtcttttataacaaccccaaaggaccacatgtctcttggagaatgtgtagctctgagctcttggctctcagtgtgactccctgtctccttgttttccagcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctc

SEQ ID NO: 36474 - DNA, 41430 bp, Homo sapiens
gacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctgggtaagctgccctgtctccgtcccgtgctgttccgcctgtgtctgtctgtctccccgtctccccctctctattcccatctccagacaacgctggccaggaatggggtttggagagccagagtcaagtccaggctctttttggtatcactctgtgtaagtcatttaacctctcagggccttaattttctcatttctgtaataacagggttgagttaagaggtctccttgttctgaaaatatatatatattttttaaacgtgtatcgttttgctcacaaaacacactttaaaaaaaaaataacttgtgcatccagcccaaatgcactgcttcttaactggggcgattttgttcccaatcagtatctggcaatgtctggaggcattttggttgtcatactgtgtgtgtgggtgtgcctgctggcatccagtgggcagaggccagggacactgctcagcatggtacagtgcacaggacagccccatcatcaaagaattatctggtcccaaatgtcaatagtttgagcattgagagaccctagccttcacttaagtttttctggcgttcctgatctttttctgtagtgaatttctagtggccataaaaggtactgggagtgatgatcaactagagccaggaatattatttgggcagccgtttggtgctgtccaaaaccttgtcctttctgtctggcaagctagtatccatttataggtacctcaggaacccaaatgatttgtcataaaatacaaggaatgtgagcacactgaagacatttttaagaaggctcatttgctcagcagaattttcagtgtactagtggcatttatagaaagagaaggtgatcactgaaggcatgctcacataatattcctgagccctggtgggcgttatctagggcaaaggattccacctgtgtttggagttgcgcccatcctcactgtagccagagcttctcctatcagagtttagtattttgtttgaatagaggatcttgctgcttaaaacagttgaaaagaccctgatgggcaggccgtaattgacaagcgaatgatgggaacatgaatcggtcttagggaagcatctgtcaaagtggtcctcggttaaaacaagtgcctcctcctctcagtgtcacttgattgtgtgcttgaattcttcggaaaactgggtgtatgagacccacgatgaatttgcccacacgattgattggactcttccttcacctgctcttcagccagtgccagttccttttctgatcatgtgattgacgtgagaactgtagtctgtatatcaaatctttagaatgtttttgagtttcctgggacacaggaaacccagcacttagcatactacaaatctaatgtcttaatggcatcataaaaagaggctttaaacacagactccagttagctaagtggtttctgctagtgccggtactgttgcaggggccctgtgagatgccccagttccctgaaagaaatgaaaaggccagttaccggtaggtggtgtggaaaacatgggctagatcatcaggcaggacagaatgcctggctgtgggtgggagcaccccagcttggcgttgagttctggttctaccactgcgttgttttgtgaccaattatgagttgcttaacctttctttgctactatttccctgtttgcaaaatggttcattgacccctgtcttccacctcccaaggacaatttcaacagcctatttgtaaaaagatcacagtcctttaaaaaatataactgtaaagtcagaggtgatgcttgaaagagcaggaaccaggtagatgtggaaatgtcatgtcctttgttctaaagaaaaggcatttcatagctttttggatatgacgcaacataccataaatcctgacacatagttgggagtcggaaattgcaacaacgcccagttataaacccagctagtttgggtatgattgtaagaaaaaaaagctggccattctgtatttggggaattgattttcctaaacttatattatcttagtagtctagatttatcatattgtactatcatcctggcttttttaagacttaagaagatcaagtaaatttttttttctttctttagacactatatagatcatcaagggtgtctgtcttacaggtggatagtgatatgatctacagtgaggggacatttatttaaaacttaaacattcatgtgttttgggggtggtattttaacggcagcacctctgattgtcttttggagggctggtgtgtgtttgaagttctgtcctccttccagtggactctaacttctcctgatgcacgtgagacacattgtcctattgtcctgcagaaactaaagccaaacactgtcatttggggacaggttttcatttgtcagatctctttcgcccacatgagtgtttgtggacaatacagcctgctttccaaaactttgctaaattttgacagactttcctaggtgcttgcccaatgccagactttcttttctgttgaagattaagttgtgcttgctgccctctagtggtcagttgtttaatcctaaccttaaacggcttatttttcccctggtggttgggaagttgacggtttgtaattggctcatttttctaaattattctgaagaagataatttttcccgccagtatgtatgtccaccttcagtttgccagatcctgcctgctcagagacactgagaaccggaagctgcccgggcaattcagtctatgaaatgatctttcttgtgattaaggcaaacgaagaactgaatgtttaatagtgtactctgctgtacccagaaaaaaacaaaacaaaatcatgttataacactctaaaacttcaaacaacctccaacagcatttggtgtgtgtctagccgttttgttctaacccgatgttatataaaagaattttttcatgctttccaaaaatgtttatgtcaagaatatttaagtcagcatgccttattcaggtacttcagctaccttcttatataaatatttttgtttttcctttaagataaaaatgatgatggaggaaaaataaaacatcttacatcttcaagagagtgtagttattgtggaaagtttttccgttcaaattattacctcaatattcatctcagaacgcatacaggtaaagaacttttatttttttaaccatgcattagttaaattatgtagttatctaatttttttgttgttgttgttcagatactctgccagatccttggactagcttaaggataaatatgtagcatgttgattgcagtggttatttttattcttttagtgccattgtaacttgagccattgttcttatttgcagttcatttcttttctttcttttttgttttttgagacggagtcttgctctgtcacctcggctggagtgcagtggtgcaatttcggctcactgcagcctccacctccctggttcaagcaatactcctgcctcagcctccccagtagttgggattacaggtacctgccaccacacccggctaatttctgtatttttagtagagatggggtttcaccatgctggccaggctggtttcgaactcctgacctcaagtgatccgctcaccttggcctcccatagtgttggcctcccatagtgctgggattacaggcgtgagccaccgcgcccggacaaagttcatttgtttagtttatgactgctatgtcctgactcttatcttattaaaagctacagtattttaaaatgctgcatcttatgtctttatgattgagaatgaaatgagaatctatttagtagtcttgagattgtgaaaggagctatgacatcatgatgtaggaggctgcgtagatttgaaatttcatctcttccacttactatctgtgcacccttgggcaagttatttaacctttttgtgcttttagttttctttgctgtaaaagtagaataatacatatttccctagggctgttaggaagattaaataagttagaagtgttgctgttaatttttctattgaagataggcattcataatttcaaatattcattacagtaaggatgataaagaactgatgagaaatcctatgtgatagtagatcgagaaagcaaaaggaggaaagaagcctgttttcttaataaatagatatttgatctatttcagtgcttttcatacacttctataataaagtgccatttcttgccttaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggtattgcatgaggggcgtcgtgtttaaatggctgcctacagtgattaatagctaatccaggcattctcagtggagatggtaccactcccaagggtggggggtaggcagccagaagttcttgggggtcacagagagaagcattcttagatacggcagtggtttgtggtcctccaaggcttacttaactctgtgggtttaactcttaaccctgtgtattttattcttttgatttgtttagtcttactttatttttagagaaagggtcttgctccgtcatctagattggagtgcagcggtgtaatcatagcttactgtagtcttgaattcctgagttcaagagatccttctgcctcagcttcccaggtagctgagactatatgtgctgctaccatgcacagctgatttttaaattttttttgtagagatggagttgcccaggctggtcttgaactcctggcctgaggtgatcctcctgcgttgacctcccaagtatcttagactacagatgcactccaccacgcttggctaacttaaatttatttttttgtagagacagggatttgctttgttgcccgggctggtctgaaacccctggcctcaagtgatcctcctgcctcggcctcccagaatgccagcattacaggcgcgagccaccatacccagccttattcttgagtaatttttcttgtcaattttatttttctgttgtgagagtgatcatggaaacagtgggtgagaacactggtctgtctagtccattcttgtcttgctgttgaaattccagatgcagccagttgaggccccagcttgcctcacttcatcacagccctttttcttcctttgcacatgtatggtgtgctcagtagtcagtgccaatccacctggagttgcgggggttttttttttctttctttctttttttttttttttttgagacggagttttgctcttgttgcccagcctgagtgcagtggcacgatctcggctcactgaaacctccttctcctgggttcaagcaattctccagcctcagcctcctgagtagctggggtaataggcacgtgccaccacgcccggctaattcttgtatttttagtagagacagggtttcagcatgttggccaggctggtcttgaactcctgacctcaggtgatgcactggcctcggcctcccaaagtactgggattacaggtgtgagccaccgcgcccagcctaggggttcttcctcacgcattttaccattccctgctggcctgtaaacttcttaagagcagaaaccatgttttacatgtacagcatcaagtcacatgcttcccacacggggcagaatagggggcgcccagtaaggaccacacgtggacccttgacctggcaagagcagaaagcaaaagaacttccgattaaagagtcttgtgaaccgttttgctgttaaatgttgtcagccctccatatccttgggttctgcctcagtggattcaaccaactgcgggactaaaatatttgggggaaaaatggatggtcgcatctgtactgaacatctgcagttttcttttccttgtcgtaattccctagataatacagtataacaactatttacatagcatttacttcatattaggtattataaataacgaagagatgattttttttttttttgagatggagtcttgctctgttgcccaggctggagtgcaatggtgtgatctcagctcactgcaatctctgcctcccaggtccaagcagttctcctacctcagcctcccgagtagtttggatgcaggcacccaccgccacgccagcctaatttttgtatttttagtagagacggcatttcgccatgttggtcaggctggtctcgaactcctgaccttaggtgatcctcctgtcttggcctcacaaagcgctgggattacaagcatgagccaccatgcccagcagtgtagagatgatttaaagtatatgggaggtgctggatgtggtggctcacatctgtaatcccagtactttgggaggctgaagcgggcagctcgattgaggccaggagttggagaccagactggtcaacatggtgaaaccccgtctctactaaaaatacaaaaattggctgggtgtgttggtttgcacctgtaatccgaactgtttgggaggcttaggcatgagaatcgcttgaaccggggatgcgcagattgcagtgagtaagtctagattgcactgttgcactccagcctgggctaaagagtgagactctgtctcaaataaataaataaataataagtaagtaaagtatatgggaggatgtgaataggttacgctacaatactgcaaattaatagtactacaaggccagttgcggtggctcacgcctgtaatcccaggactttgggaaacagcctgaccaacaatggagaaacctcgtctctgctaaaaatacaaaattagctgggtgtggtagcgcatgcctgtaatcccagctactccagaggctgaggcaagagaatcacttgaaccttgggaggtggaggttgcggtgagctgagattgtgccattgcactccagcctgggcgacagagcgagactccatctcaaaaaaaaaaaaaaatagtactacagatactatgaatactgcagatacgacactgttttatattagggacctgagcatccatggattttggtatctgttggctggggtggtgggggcgggtggtcctggagccagtgccctctggatactgagggacaactgtattaatttaaaaccaaccttatttcccccataggtagattgttaacctcatagatgactggggttttccccatagaaatgtgtcctggtggtgtcacttcgtacaggtgtctggcacatacctgtatgtgtaaaaaagtagctcagtgtcccagggacatcttctccttggcaaactcggtcaaactgcagcatcttcctttatcacatagaagctctactggtttgtgctccccaaagaaacagattcagttttgcacatttcagtttgtgttagtttcaaactgaggattctgtgtggtgacaacactctgtcaagaattgcttgatgctgattggttcagtagagatagcaaattaaaaaacaattgctttcagacactccagtagattttataaaaattgtgatgaaatagtaatttttactgccttttggttaaaaatcttcatttccccccccatggtgcttaaaatggacatgaatcaaaactttgtctttacttaaagggggaaaaggctctgtgtgttgcaagtcagatcctcttttttttttcccctcctctgtgagacagggtcacactctgttgcccaggctggagtgcagtgggggcaatcacggctcactgcagcctcgacctccgggactcaagcaatccttccatccttccgtctcagcctcccgagtagctgggactaaaggtgcatgtcaccatacccagctaattttttatttttagtagagaagaggtctcaccatgttgcctatgctggcaaatccccttttaaatgattttaaaaaaagcaaaaaacaacacttttacatagtttggttcatgatgcatatacgtttcaagtattttgtgatgtcatttttttccggctttttaattctttctagtgacagcccagacaattttaatgttagtgacatcaaccaaattctgtgctaacaagtgtcataaaaacaattcagctgtaactgaaaacacttgcatgcgactgtgtgacttaggcgttgattacattatcagtgtcagaaattttgaaaattgacttctaaaaacctatacacatcttacctaattgtttgaccttaactctaaatatgttttttttttcaatcaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtgagcatatgtttcaattaaaaacactggattggctgagtgcggtggccatttgggaggtcagggcgggcggatcacctgagatcgagcatttgagaccagcttggccaacatggtgaaacccctgtctgtactaaaaatacacaaatttagctgggcgtggtggcgggtgcctgtagtcccagctacttaggaggctgaagcaggaaaatcacttgaacaacccaggaggcggaggttgcagtgagcagattgtgccactgcaggtctagcctgggtgacagagcgagactcagtctaaaaaaaagggggggcgggggcggggattgattttacttgatcggaaataaaccattaagttgtctaatataatgtaacaaaattgcttttaagttggattttgattttttaggtgttttaaaattagagtcctcaggatctttggatattactgaagataataggaaaacagtcatagtgactggaatttactgagcatttactttgtgctaggcattgaatgaagtgttttattatcaggatctcatttaattctgttgcagcagagggcttaggtaagggatgagcaaactagcttttcatgcatcatcatcaataaagttttattggaacatgatcatgcccatctgttacatattgtctgtggctacctccttgctgcagcagcaatgtcgggcagttgtgacagaccacgtggcctgcaaagctgaaactatttaccgtctggccctttacagaaaaagtttgtgacccagcattaggaggtactgtgcatgcttttcagatgagaccgaggcatggattatgcagtttgctcaaagccccgctctgcctgtgagaggcaggagcctggtttttgtcctaggtctgcaaagatccaggctctatgcccaacgttctagtttaagaacttgttcaaagacttggcaagtacttatctgccaagataagtacttatctgccaaggaggggaactgggacaggagcaagtatgtgagcatgtggttcacatgttaaaggtctcactgtagtgcaccgccgtcccgtaaggctcaagtagtagtatcagaattatgcatgttggttttgttagtttatatttagttaattagtttgggcagaaggtgtgatgtctgtgtacaggttatactatgactcattcaacaataagattaaatggaaagcttggggctcacgggcagatttagttgttcctcaggtaactcttgtcccgtaaaaccgtcactgtatattcgttgagcagcctcttcaccaagtgcctgctggctgctaggatacgaagatgaaaagatgctcgtggtccaggacagaatttctctgtcatattttcatcgggactcatatgggaactgagatgacgttctccctgggcagcgtgagccttgtgtggttctgcagtcttttctcctgcttaggataatagatgaagaacatgagggagtaaagctttgtcatcacaggaataagatccagtccactctatattaaaacataaaaataatttatgaattatgaggagcagattttagtaacaggttactcgaagcatccattacaactgatcagtagtagcaaacagccatgctcctgtatctggagctggtgtctctctgggagctctgagcttctctgcttgtgtttccttcatctggagaacatcctgcctgctctgtctttgctttccagcctcttctttctcatcctctggaccagctcacatattggttttgtttgtctgagacagggtctggagtgcagtggcacgatcttggctcactgcagcctcaaactcctgggctcaagcagtcctcccaccacagcctcctgagtagctgggattttcttgtgcatggcaactgccttttactgaattctgattcttggttaagtcatctcagttaaattactaaaagtagctccaaagttcgcagcattatctagttagtcattctcctaatactttcatagcaaaagttgaacttaaatagaacccagggccaggcgcagtggctcatgcctgtaatcgcagcactttgggaggccaaggcgggcagatcacttgaagtcaggagttcaagaccagcctggccaacatggtgaaacccttctctactaaaaatacaaaaaaattagccgggcgtggtggtgcatgcctgtagtcccagctacttggaaggctgaggcaggagaatcgcttgaacctgggaggtagaggttgcagtgagccaagatcgtgccgctgcactccagcctgggcgacagagtgagactgtctcaaaaacaacaacaacaaatagaacccattgcatttctaggtcagtttggttctatgtattacgcttttttaaagaaagaattttctaaactgtattcagttttgatcttaatcatttaaaaaatgttgttttccttaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctgtcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaatcttgagttttagtgtttattgtgtttctggtttctgattttgttttatttaactttttagttttctttcttttttttttttttgagatgtgctcctgctctgtcactcaggctggagtgcagtggtgcaatcacagctcactgcagccttgaacccctgggctcaactgatcctccagctctcggcctcccgagtatcgagccatcatgcctggcttataaacacaattttaaggccagcacgtggctcacgcctgtaatcccagccctttggaaggccaaggcgggtggatcacttgaaaccaagagtttgagaccagcctggccaacatggcgaaaccccgtctttactaaaaatacaaaaattagctgagtgtggtggtgcacacctgtggccccagctactcaagaggctaaggcatgagaaatcacttgaacccgggaggcaaaggttgcagtgagctgagattgcgccagtgcactccagcctgggcaacagagcgagactccatctcaaaaacaaaaacaagaaaaccccacactctttttcttttttctatttttttttttttttgagatagggtcttgctctgtcgcccaggctggactgcactggcgcaatctcgcctcgctgcaacctccgcctcctggattcaagagattctcctgccgcagcttcccaagtatctgggattacaggcgtgtgccaccatgcctcgctaattttggtatttttagtagagacagggtttcaccatgttggtcaggctggtcttgaactcctgacctcaagtgatccgcctgcctcggccccccaaagtgctgggattacagacgtgacctaccatgcccagcccaccaaccttcttccttaggattttagctgccattgatgttgcaaaagtcacttttaaagacttcttaaaattccacatctgttaattgaaattctattaagaagagcttccttatgattatttggttaccctgaaacacagtttcaaccaaaaaaaggagaaatgctcgttttgtttgttttttattcctcttgattaccagctttgaggatgagttggtgccagcattctccagaggtgacccaggaataagcttttacatttttggtatgagctcacaagtcttatacacttgatgtgttgagagcatgtggtcgtcattttgatgcctcaagtctcttgtttttggtcagtgggagttccaagttggcccagtgtttgcaggacaaaagtctgaaggcttcttaactttttgttaaaacatgttctggctgggcatggtggctcacgtctgtaatcccagcactttgggaggctgaggcgggcggatcacctgaggtcaggtgttccagaacagcctggccaacatggtaaaaccccatctctagtaaaatacaaaaattaactgtgaaaccccgtctctactaaaatacaaaaattaaccaggtgtggtggcaggtgcctgtaatcccagctactagggaggctgaggcaggacagttgcttgaactcgggaggcagaggttggagtgagccgagatcgcaccactgtactccggcctgagcgacagagcgagactcagtctctaaaaacaaaccccaaaacaaaaccggagatgatccaaatcccacctgtactgacccacacctgggaaccgtcatttatccaaggatcctgggttccttttatgggaagcggtaattagggcagtttgggcgcaaggggcatttagtcctacctgggtggttgtgctcctggcctttttaatgtagggaaaggaaataaatattatcaaaaaggaaacctcagtgaattatactgctatttccaactcacgttttagagttttctttgattttgtttttgattttctgaaaagctgggttcctggctttaacctactgtatataacagaaacaatgccaatgttattgctcttatcactgcccaatgaacctttcagatttctcttttgagttggagtctcgctcagtctcccaggctggagtgcagttgcgccatctcagcacactgcaagctctaccttccgggttcacaccattctcctgcctcagcctcctgagtaggtggaactacaggtgcctgccaccacatccggctaattttttttgtatttttagtagagatgggatttcactgtattagccaggatggtctagatctcctgacctcatgatccacctgccttggcctcccaaagtgctgggattacaggcgtgagccaccgcgcccagcctaaagtaaccatttttaaaaattattatttttttctaagaatgagtctcgctctgtagcccgggctggagtgcagtggcacgatcttggcttactgcaacctccacctcccgggttcaagcaattctctgcctcagccttccgagtagctgggactgcaggcgcatgccaccaagcccggctaatttttgtatttttagtagagatggggtttcaccatattggtcaggctggtcttgaattcctgagcttaggtgatccatctgtctcagcctcccaaagtgctaggattacaggtgtgagccactgcgcccagcctaaaaattaatttttgatttatcttttcattaattctttttgaaaatacaggcatatttgcaggtctatttatatctccctttcttatttaaaaaggagtttacagtccacactagcacaggctgattttagcactgtttcattgttttcctggagaatgaaacagcacacacacacacacacacacacacacacacacacacacacgaaaaaaacgctgaaaaaaaatttttttttaaaagaacacggttttctgctgaacatcaaatgactcgaagaaatctactttggagaggttgaagttggtggtcttttctctacctgcttttatttcttcagtatatctttattgagctttcactaagtgccaggcgcttagggctagtactggctgggtgccagggacatgtgtctcatgaaccaggtagcatttcctaccctcttggggctgtctttgtggggttgctggtggtggaagacattgaaaataggtcatcatggctgggcgcggtggctcatgcctgtaagtctagcactttgggagccccaggctggtggatcacttgaggtcagaagttccaaaccagcctggccaacatggcaaaaccccgtctctactaaaactacaagaatttgccgggttttgtggtgtgcgcctgtaatcccagctacttggaaggctgagacacaagaattgcttgaacctggtgggaggaggttgcagtgagccaagatcgtgccactgcactccagcctgggtgacacagcaagactgtgtctcggaaagaaaagggctggggaaggggaggggaagggaagggaagggaggggaagggaggggaggggaggggaggggaggggaggggaggggagaaaaggtcaacagaccagttatggccctgctgtagtggctggggaggaaatcagcaggagactgagaataattaggagaacccacgagagctgggtggtcaggacaggacctaacaggtcctagaggatgaaaggaggtggccatgtaattaatgctttataaagaatcttggccgggcacggtggttcacgcctgtaatcccagcactttgggaggccgaggcgggtggatcacgaggtcaggagattgagaccatcctggctaacgcggtgaaaccccgtctctactaaaaataccagaaaattagccgggcgtggtggctggtgcctgtagtcccagctactcgggaggctgaggcaggagaatggcatgaacctgggagacggagcttgcagtgagctgacatcgcaccactgcactccagcctgggcgacagagcgagactccgtctcaaaaaaaaaaaaaaaaaaaaaaaaaagaataggttacagctattgatatttaccttaatagatatggaaaactattaaataatttacaaattcaagaacaacaataatcccactacatgttaatataaagaaaatttggccgggcgcagtggctcacccctgtaattccagctctttgggaggccaaggtgggcagatcatctgaggtcgggagaccagcctggccaacatggtgaaaccccgtctctactaaaaatacaaaaattagcgaggtgtggtactcacctgtaatcccagctacttgggaggctgaggcaggagaatcgcttgaactcagaaggcagaggttgtagtgagctgaggtcgtgccattgcaagccagcctcagcgaaagagtgagactccttctcaaaaaaaaaaaaaaaagaaaagaaaatcttttagtcagggatggtggctcttgcctgtaatcccggcacttctgcaggccgcggagggtggatcgcttgagcccaggagtttgagaccagcctggggaacatggagagacctcatctctacaaaaaatacaaaaattagccggccatggtggtgcatgcctgtagtcccagcactttggaaggccgagatgggaggattgcttgaggccaggagctcgagaccagcctgggcaacagagtgagacctctgtctatacataaaataaaataaaataacaaaattagctgggcatggtgttgcaaacctgtagtcccagctactcaggaggttgaggtgggaggatcacttgagcccaggaggttgaggctgcagtgagctatgattgtaccactgcactctatccagtctgggcagcagaacaagaccaactcaatggaaaaataataataacttgtttttttttttgagacagagtctcactctgtctcccaggctggagtacagtggtgcgatcatggcttgacctgggtttaagggattctcccacctctgcctgtccagcagctggaactacaggtgcttgccaccatgcctggctaatctttttttttttttttttttgagacagaattcactctgtcacctaggtgcagagtgcagtggtgtgatcttggctgattgcaacctctgcctccctggttcacctcagcttcccgagtagctgggattacaggtacatgccaccacacccaactgatttttatatttttagtagagaaagggttttgccatgttggctaggctggtctcgaactcctgacctcaagtgatctgttgccttggcctcccaaagtgctgggattacaactgtgagccacttcacccggcctaatttctgtgcgtttttttttttttttttttttttgtagaggtagggtcttgctatgttgcccaggctgggtgagttttgcaaaatggttatgtgtgtgaatttagctgaagcaataacgaggatttggttgcattgggaaccaaaccagtctctagttatgaagaaggcaatgagcacaacacacttctgccaaattgtaggggagaagtgcgttcttgaagaccatcaataactgaatatctgaactattcaaggctatttttctcaatggaactaactgaccaatgatggggcattttacttagtgccataaagtgtcacctccaggtggcacgggtgttaacaaagtttgccagttccttgttctaccagctttgaaattcaactttgatagttgagcaacttttcaaagatggaacatttgtgttatttcaaatgctgtggggaacatttgtgttatttcaaatgcggcagaaaagatgaaactctattagtaacgcttttaataaactttaaattttttataattcaaaaaaatttaaagttccttgagctagcttgtatgttcattacctagtgtagtccttgtgcttagtgattgtaacagcagagcaaaatgacaccgctgttatatggatatttatttccagtgatgccaaaggcccagtttttttttctttctttcttccttccttcctccctccctccctttctttctttccttccttctttccttcccctcccttcttccttccttccttgtttttgacagtcttgctctgctctgtcacccaggctggagtgcagtggaatgacctcggctcactgcaacctctgcctcccagggttcaatcgattctcctgcctcagcctcctgagtagctggtattataggcatgcaccaccacgcctggctaatttttgtatttttagtagagacagggtttcatcgtcttggccaggctggtctccaactcctgactttaagtgatctgcccgcctcagcctcccaaagtgctgggattacaggtgtgagccaccactcctggccccaaaaacccaatttaattaaaagaagaagaaaaaaaggaactctcactgccattgtgttctccactttgccccaggtgctgggctctgagagctccaggggcagggcttgtattttctagggaggatgtaaggcaagaaagcccaggggaaagtaaatgaccctgggaaggaggagtcaagtcctaagagacaggatttggccctggagggaaaagggagaaagccagtcctgaaggaagggaaggagttgctcaagctccaggcggggtggggttgagcctggagccgcgctcccctctcctggttctctcaccccttcctcctgccttcttctctccccacttctcttccctctatccctcatttgcagatggatccatcaagaacttctgggccggatgcagtggctcatgtctgtaatcccagcactttgggaggccgaggcaggcggatcacctgaggtcaggagttcgagatcagcctgaccagcatggagaaaccccatctctactaaacatacaaaattagctgggtgtggtggcacatgcctgtaatcccagctactcgggaggctgaggcaggagagtcacttgaacccaggaggcggaggttgtggtgagctgagattgtgccattgcattccaggctgggcaacaagagagaaacttcgtctcaaaaaaacaaaacaaaacaaaaaaacttctggaaatggaccaggcttagtgtggtttgtgggacctaaagacgactagcaaggaaaatgatccaactcaccattcgccccaaatgggaatgaaactcaggatgacagagatcacaaggcttcttgaacttctattcagatgcaactttatttgttttgttttttgtttcgttttgttttgagacagagtctcactttgtcttccaggctggagtgcggtggcacaatctcagctcactgcaacctctgcctcccaagttcaattgattctcatgcctcagcctcccgagtagctgggactacaggtgtgtgccaccacacctggctaatttttgtatttttagtagagatggggtttcgccatgatggccaggctggtctcgaactcctggcctcaagtgagccgcccaccttgacctcccaaatgctgggattacaggcatgagcaactgtgcccagcccagatgcaactttaatgccacaaatacctccttgggtgtgccatgtgatatcaattattctggttacagattttcttaagtagagaaataatggtagtacatgaacaataataccaatagtttggtactttaaaatagcataaactggccacggtggctcttgcctgtaaacccagcactttgggaagccaaggtgggaggatcgcttgagcccaggaattcaagaacagcttgggcaacatagcgagacctcatctctaaaaaacaaacaaacaaacaaagtaaaatagcaaaggtgcaaaagcctgccaagaatggaatggatgagtaagctgtggcatctccttgcagtggtcagtatacagtgacaagaacggatgatctacaatcatagagcaacatggagaaacttcgcaaacataatgcagagcaaaagacgccagacacaaaagactgtgttccgtatgactccactcatgcaaatgacaaaaatgggtagcactagcctatgctgctggaagtcaggatggcgtgtgcgctgctgctggtggtgggcaaacagcaagcaggtacagacacgcttgggattctagacctttcgttccatggtctgggtgctggtttatgttgtgaaaataaattgaagtctacacttatgatttgggcactttttgtgtgtatatatatgtatatatacatatatatgtgtgtgtatatatatatacacacatatatgtatgtgtgtgtatatatatgtgtgtgtgtgtatatatatatatatatatatatatatatacacttcagtttttttgtttgttttacagagagggtctcactctgtcactgggatgctggggtgcagtggtgtgatcatagctcactgtagcctccaactcctgaggtcaagtgatcctcctgcctcagcctcctgagtagcttagactacaggaatgcaccaccatgcttgactaatttttaaaaatcttttaaaaacttttctttggtagagatgatctgttgaccaggctggtcttgaacttctagcctcaagcaatcctcctgcctcagcctcccacagtactgggattataggcatgagccaccaatcctggctgtattatacttcaattttaaaaaaggaaaaaatagcagagtaaagtatgaacaaattgaggttatgactcacaatacacctcctttttttgttttttgttttttttttttgagacagagtgttgctctgtcacccaggctggagtacagtggcgtgatctcagctcactgcaacctctgctgcctaccctgccgcccgggttcaagtgattctctggtctcagcctcccaagaagctgggactataggcatgcaccaccaggcccagctaatttttgtaatttttagtagaaatggggttttgccatgttgaccaggtggtctcgaactgacatctggtgatttgcccaccttggcctcccaaagtgtttagattacaagcgtgagccaccacacccagcccaatttttattttattttattttattttattttattttattttttatttttattttttgagatgaatcttgctccgtcgcccaggctggagtgcggtggtgctgtctcggctcactgcagcctccacctcccgggttcaagcaattctctgcctcagcctcccgagtggctgggattacaggcgcccaccaccatgcccagctaagttttttgtatttttagtagagacgtggtttcaccatcttggccaggctgttcttgaactcctgacctcatgacccacccgcctcggcctcccaaagtgctgggattgcaggcgtgagccactacacccggcctattttattttatttttgagacggaatgtttctcttgtcgcctaggctggagtgcaatggcgcgatctcagctcactgcaacctctaactcccgggttcaagagattctctcacctcagcctcccaagtagctgggactacaagcatgtgccaccatgctcagctaatttttgtaatttttagtagaaatgaggtttcaccatgttggccaggtggtcttgaactactgacttcaggtgatctgcccaccttggcctgccaaaatgctgagattataggcgtaagccaccatacccagcccaatttttagcttttgctctaggtgtgatgggaagctgtggggaggtttagcagagggtttaagtgactggacttagcacagctgtgttttccttcatggtgtctgacccgagggccattgcatcattgatgttaattccaaatgaggctgaatattcatgcggagacaccgacggggttgaccggagctgctcctcccacctcattgaacttgattgccatttctggaaggcttcatctgtcagtgcccccgacccccaggaggagggttgggagggcttcctagaagaagagctgtctaatctgaggcttgcacaaggatctgggagggtttgcaccggctgttgcctctgaacttccctcttgggaggaggttaaaggcaacaaggcacatttcggggatcatcaggagggggatgcccttgagtaaggagttttctgccaggaaagggtacgaagaggctgaggaggtggtggtgagctggttaagaaaatgtgggcattatcttgtggtcaataaaaagacactgaagaggccaggcatgatggctcatgcctgtaatctcagcactttgggaggctgaagtgggaggattgcttgagcccacaagtttgagagcagcctaagcaacatagtgagaccctgtgtctacaaaaaataccaaaaaagttagccaggggtgctggcacatgcctgtagtcccagagactctggaggccgaggcaggaggatcgcttgagcctgggaggccaaggctgcagtgagtcatgatggcaccaccacactccagcttggacagcagagtgagaccctgtttaaaaaaaaaaaaaaaagacaatgaagagtgcaaagtcgcagaatgacaagatctaccatttcattgaccggaagtgaacatgcaacattaaaaatcaatggccagacaaccttttggttgaacttttattgatttgtccttgatactatcagttagagttgaaggtgatcaggtgagtgcagcacacgttgaaaagtgaaaccctggctgggcgcgggggctcatacctggaatcccagcactttgggagaccgaggtgggcagataacctgaggtcaggagtttgagaccagcctgaccaacatggtgaaaacccgtctctactaaaaatacaaaaattagccgagtgtggtggtgggcgcctgtaatcccagccactctggaggctgaggcaggagaatttcttaaacccgggaggcagaggctacagtgagctgagatcatgccattgcactccagcctgggcaacaagagtgaacctctgtctcaaaaaaaaaaaaaagagtgaaaccctctagtgactcttactgatttttgctgatccttaatataaagcaagtagtcataagtcgtaaccagcccaatggcctcctttcatctacgatacaaaagacacctggagttgagaagctgaaagaccttgagaagtagcatttggtctgtttggactttagctgacacagtgaggtcttattttctgcaaatctgaattgtgcaaatctgaagttgtgaattagaggcttgttagagttccacagtatgtaccaaatttgcaataatgtgaattccacattagaaaggctctaaaaatcttatttcagggtggcctggtcccctccttgttgaaattagacttgcatcttgtgggttcaaacaatgatgggctttgagttttctttttttttttttgagactgagtttcattctgtcacccaggctggagtgcagtggcgtgatcttggctcactgcaacctccgcctcccgggttcaagagattctcctgtctcagcttcccgagcagctgagatcacaggcatgtgccaccacgcctggctaatttttgtatttttagtagagatggggtttcaccatgttggccaggctggtttcagactcctgacctcaagtgatgcccgacaaaatgagactccatctcaaaaaaaaaaaaaacaacaaaaaaaacttctattcatttttcagatctcagctggctgttctttcttagctgtggctgcccccacatgtagggcctcctctcctgcctgatcccgaagcactcccactttcctgttacttgcagggctgtgagcatcagtttatttgccctcagcccttggcacaccacaaactcctggaggtcaaggatgacttcggtttggttcatagttcataactctctgccaagcacatgacattctgcccagtacatcgtaggagctggagaaatagcgtagtaaataaaattatgtaaattaaacttaattaaaatattcatttttagaaaaacaaaaacaaggctgataggccattggtgaaattgacaaaaatgaactaaaatttgcctaataaataaaatagaacacgttattcaaaaacatttgaaggctgggtgtggtggctcacgcctgtaatcccagcactttgggaggctaaggcgggcagatcacgaggtcaagagatcgagaccatcgtggccaacatggtgaaaccctgtctctactaaaaatacaaaaattagctgggtatagtggcaggtgcctgtagtcccagctactcaggaggtggaggcaggagaatcacttgaaaccgggaggcggaggttgcagtgagacgagatcacgccactgtactccagcctggcgacaaagcaagactctgtcaaaaaaaaaaaaaaaaaaaaaaaagagcttttgaagaacatgaatagctaaacctaccctactgtataaagaatgttggaggctgggcgcagtggctcatgcctgtaatcccagcactttgggtgttcgaggcaggcggattgcctgaggtgaggagttcgagaccaggctgaccaacatgctaaaaccccgtctctactaaaaatacaaaaattagccaggcatggtggcgggtgcctgtaatcccagctactcaggaggctgaggcaggagaatcgcttcaacctcggaggtggaggttgcagtgagctgagactgggccattgcactccagcctgggcaacaagagcgaaactacgtctgaaaaaaataaaaaaagttggaattttgattggaaaaagtaacacttcataagggaacgttttagtttgtattgatttcaattttgccaactttctagcatgttcaggattcttccagcagcttctcagacagcatatcagcttcggttagctactattcagacaattgcatttcataatcagcaatcaaaattgtacttttctgttaaagctgttaaaatattcttgcttttaaaaaagctgttaaaaacacaattggaaaagtcagtgaaatgatcatttgatatttgattattcagtgaattagttttaggcaaatcggactggcaggctgcagaggtggcaacaggccagaggtcattagaggaccaggaagccacaggaaggtcacctcggctacattttatagctcacaaaatgtttttacacacacactacccactcccccccctccactgcccccatcaccccgagatggagtctgtcgcctaggctggagtgcagtggcacaatctcggctcactgcaacctctgcctcccgggttcaagcaattctcctgtctcagcttcccaagtagctgggattacaggcacccgccaccatgcctggctaatttttgtatttttagtagagacggggtttcaccatgttggccaggctggtattgaactcctgaccttgtgatcctcctgcctcagcctcccaaagtgctgggattataggcgtgagccactgcacacagcctatacacacacttttttaaaaaaacttttttattttgggatttttttttttttaagttttagtcttgctctgtcacccaggctggagtgcagtggtgtgatcttggctcactgcaacctccgcctcccaggttcaagccattctcatgcctcagcctcccaagtagatgggactacaggcgccaccacacctggctaagttttgcacttttagtagagacagggtttcaccatgttggctgggcttgtgtcgaatccctgaccttaagtgatcctcctgcccttggcctcccaaagtgctgggattacaggcttgagccacctcgcccagcctggaataattttatattcacagaacagttgtaaagagattgcagagagttcctgaattcgaacccaagttccaaccctgcacccagctggccctagtgctaccatcttacataagcacaatgcatctgtcaacactaagaaattaacactggtatgttactttatttagaattccctagttttcccattagtggtgggattttttttctgtcccaggatcctaccttgcattcagtcatcatgcctcttgtagtcttctctcgtctgtgaccatttcttagattttccttgtttttcattccgtggacagtgttgggaaggactcggtgttttgtagaatgtctgctgatctgggtttgtctgatgttttctcatgattgtctgggattacgggttttgtggagtataatgcagaggtaaagtgccttgtcatctcatcatatcatgggaggcgggggtagtattgtgggaggcaggggtatgtgagagccgcctggcaaatcttgcctctaccagggtgcttaatgttgtcacatgtttgattatcataacctgtaaaataactggaaaagttaagattctattttatcatttcaatgattttttttttttttaattttgagatggagtctcgctctgtcgcctaggctggagtgcagtggcgcaatctcagctcactacaacctctgcctcccgggttcaagcaattctcctgcctcagcctcctgagtagctgggattacaagtgtgcaccaccatgcctgggtaatttttgtatttttagtagagacggagtttcaccatgttggccaggctggtcttgaactcctggcctcaagtgatccgcctgcctgggcctctcaaagtgctgggattacaggagtgagccaccacgccagcctcaacagataatattttagtgagcagtcatatatgcaggcgttgcttaaattgaagtcattcagtattaatgaggaaggtcagatgagatcctgtacttaaggagctgggaaactgaggattcgagagtctaaacagctttacccaatgtggtccaggttgtaggtggcagagccaaaattcaaacgcgtgtctcacttcaaaggctctgtgtgtgtttgtgtgtgtgtgtgtgtgtgtgtgtgtgtgtgtttgcttttgctccattgattccaaataacaaaacaaaaccaaacaaaaactttgctacaaaaccctcactctgatcctgatgctatcttaattgtgataaatgtgttgtttaatcttcacaacaaactcatggaaaggaactatatgtaatcccagagctttgggaggccgaagcgggagaactgcttgagcccaggagtttgagaccagcctggaaaacgtagtgagacctcatctctacaaaaagtttaaaaattaaccaggtctggtggcatgtgcctgtagtctcagctactctggaggctgaggtgggaggattgcttgagcccaggagttcaaggttgcagtgagctgtgatcgcaccactgcattccagcctggccaacggcatgagatccctgtctcaaacaaaactaaacaaaaccaaaagaaaaggaactacatatccttcctttttcaggtgaggaaactgagcctttgagtggttaaggaacatgttcaaggttataaagctggcgcatgggctgggcgcagtggctcatgcctgtaatcctagcactttgggaggccgaggtgagcagatcacctgaggtttctactaaaaatacaaaattagccaggtgtggtggtgcatgcctgtaatcccagctgctcgggaggctgaggcaggagaattgcttgaacccgggagacggaggttgcagtgagccaagattgctgcattgcactccagcctgggcgataagagagaaactccatgacacacacacacacacacacacacacacacacacacacacaaaagctggcacatggctgagttgggactggaaacagactgctgggctcgagggcctgagttttcttcatcagaacatcacacacatttaaaaatgttttgaaaatgtatatgtttatttatattgaggtaaaatttacaaaacataaaatataccacattatgcaaagctggaggccaataaacaaaatatatgtaaaaagaagaaaaaaattcaaaaagaaaaactatattaaagtgtacaattcaatagctgttagtacactgacaacgttgtgcaaccaccacctctattatcaagtttcaaaatatttccattgtctcaaaaggaagcccagttaggccaccacccgccatccttccctcccctagcctctggcaaccactaatctagcttctgtctgtatggatttacctattctgggcattccatatgactggaattatgtggtttttgtgtctggtttcttgcccttagtgtaactttttttttttttttcgagacagggtcttgctctgtcacccaggctggagggcagtggcgcaatcgcagctcactgcagctccgacctcctgggctcaggtgatcctcctgcctgcctcagcctcctgagtagctggggccccaggtgttcagcacaatactcgggtaattttttttatttttattttttgaggagacaagaaggtcttactatgttgctcaggctggtcgggaactcctggggtcaagtgatcctcccacctaggcctcccaaagttgggattacagacgtgagccactgagcccagctgggacttagcataatgtttttgaggcttactcatggtggagcatggatcagtgtttcatgcctttttatagctgaataatattccgtgatgtggatagaccaacatatggtttggatctgtgtccccacccaaatatcatgttcacttgtaatcctccgtgttggaggtggggcctggtgggaggtgacaggatcatgggggtggatcctcatgaatggtttagcaccatcttcttgtgttgttctcatgatagtgagttctcatgagatatagttgtttaagagtgtgtagcacccccacccaactcttgctcctgctcccgccatttgagacgcttctctcccgctttgctttctaccatggttgtaggtttcctgaggcctccctggaagtagaagctgctatgcttcctgtacagcctgcagaaccgtgagtcaataaacctctcttctttataaattacccagtctcagtctcaggtatttctttctttctttttttttttctgagacggagtctcactctgtccccaggctggagttcagtggcaccatctcggctcactgcaacctccgcctcccaggttcacacgattcttctgcttcagcttcctaagtagctgggattacaggcgcccgccaccatgcctggctaatttttgtatttttagtagagacggggtttcactgtgttggtcaggctggtctcggactcctgacctcgtgatccgcccaccttggcctcccagagtgttgggattacaggcgtgagccaccgcgcctggccaggtatttctttatagtaatgtaagaacagcctaatgcaggccacattttgtttatccattcatcagtacggacattggatggtcttcatcttttggctattgtgagtaatgctgctgtgaacattgctggacaagtttttgtctgaatgtcctttttaagttctttgagtgtataactaggagtggaactgcttgctcacgtgggtcaccctgctccttttttcttttactttgcaatattaagaccccatattagtgtgatactctttcctagacttttagtctaaataatagtacttgctttgtttgtttgtttttttttaaagatggtcttgctctgttgcacaggctggagtgtagtgtcccaatcgtagctcactgaaacctcaaacttccagactcaagggatcctcctatctcagccctctgagtagctgggattataggcacgtgccaccatacccagctaatttttgaatttctttgtaggaacaaagtctcattatgttgctcaggctggtgtcaaactcctggcctcaagtaatcctcctcttcggcctcccaaggtgctggataacaagtgtgagccatcatgcctggctaagtcttcagtgaatacatctaaataaatatattttgggttttttgttttgttttgttttgttttttgtttcgtttctgagacagggtctcattctgttgcccagtgtggagtgcaatggtgcagcctcggctcactgcagcctccaccctctgggctcaagtgatccttccacctcagcatcccgagtagctgagactacaggcatgtaccaccatgcctggctaatttttgtattttttggtatagatagggtaatgccatgttgttcaggctggttttaaattcctgggctcaagtgatccttctgccttggctttctaaagtgctgggattccaggcatgagccaccatgtccggcctgaataaatatattttgaataaatgaatggatgatattagttgaggcaacccttaataacaaagactaccaagacatttattggtctagtgaatggctttgtatcttattaactgtaacatttgaatacgtttgaaactttgttatatatgtgacataaattctgggcatataattaaatttctacaagaactgagttatagtgaatgtttattgaattttaatttatgcctaggagaatatgctgtattttccttttaacttttctatcttatacctagtgtgtgaaggctactgttctattttattttattaattaattaattaattaattaatttatttgagacagagtctcactgtgtcgcccaggctggagtgcagtggcacgatctccgctcactgcaagctctgcctcctgggttcacgccatcctccttcctcagcctcccgagtagctgggactacaggtgcccgccaccacgcccagctaattttttgtatttttagtacagatggggtttcactgtgttagccaggatggtctcgatctcctgacctcgtgatctgccgcctcggcctcccaaagtgttgggattccaggcatgagccaccgtgcctggcctgttctatttattaggaaactgaggcctgagggggcgtcatcccagcagtgaagcctcgatttgcactcacaacctagagcagtctctactcagttgggttaccttctctctctacagcactcagaacccagacgcaggtagagacagcttttagttttattaaaggcagcccgttagagagaggacttcaaatggatcagaggaaaaggtttttctcccaggcactggtattgcagcttctgtccacacgagggaagtattagctaagaatagcaattggttgcaacttggaaacaaaggctgcaagagaaactaaaataaaccagctactggatttctaggccaaccttaggaaattaatcagcaactgtagaactccgggtaaacaaatgtaaaccagaccagccattggctcatactgtcacagtgaggattctgacctgttaagctggaaagcaagggctccctgcatacattcctgtctacaggacaattgcatctggagctgccccataagatcttaagttgattcccccggtacttatgttgtcacacacagatgatgacccaaaggaaagggcactgcttagcctccaaagaactgttttttttttttttttggtagggtaggcaattgcatgacatgcttacttgaaaagcagatgaagccaggcttggtggctaacgcatacaatcccaacactttggcaggccaaggcaggaggattgcttgaaacaaggagtttgagaccagtctgggcgacagagcaagaccctatctctacaaaaaatgaaaaattagccagatgcagtggcatgcatctgtggtcccagctacttgggaagctgaggtgggaggattgctggcgtctgggaggttgaggctgcagtgagctgtgatggggccactgcactctagcctgggtagcaaactgagaacgtgtctcaacaacaaaacaacacaacaacaacaacaacaacaacagcggcagatgaaagtaagcgtccaggaaaacctttaatttgggtggacagccagagctcccagagttttggaattcattaaccagtaatgttgaaaaaaactgatgccgttgtaaggataccaagttttgattttgccaggtaagaaagggtattcaaaaaatccaactggcatttactctcactatcatttcacaaaagagaaaccaagacagttggaaaaacataattgaagactgaaggactgtcctttaaattgaaaaaaaaaaaaaaccctcatgaaaaacaaatcagtgaaaacttcattgagacttgcataaagatcagtgttggaaggcattgttttaaaggtgttaattcttttggtttgagaaaaattcttaaggaaatcaagataacaaagaaagaataactcatctgaatttccccgaacacattgtacatttccacagaccgggaaatagttcgcagttacggagcatgtccaatgggccatgcatttttcatgcattgtctcatttaaatgttacaactacatttgagataggaacctttatcatccccattttatagatgaggacaccagaccttgcacctgtacacagctagtgaggacatagtgctaaggagtgcatccaaacagtagcaacaacgaatgagctttactcttctctggtttcttcagttgctttagaaaagagaaaggtttcttggcaaattaagaactacccctagttggtcatagaaaaagaaaatactcataatttcccagtttttttttttttttttgagacagaattttgctctgtcaccaggctggagtacagtggcacgatcttagctcactgcaacctccacctcctgggttcaagctattctgcctcagcctcccgagtatctgggactataggcacatgacaacatgcctggctaatttttgtaattttagtagagatggggtttcaccatattagtcaggctggtctcaaactcctgaccgcaagtgatccacccacctcagcctcccaaagtgctgggattacaggcgtgagccaccaggcccagcctaacctcacagttttgaagtattaacatttgagcactgttctttttatacattaacattttgttttgagattgaacatttttttttctttttttgagacagttttgctctgttgcccaggctggagtgcaggggcacgatctgggctcagtgcaacctctgcctcccgggttcaagcaattcttgcgcttcagcctcccaagtagctgggattacaggcgcctgccaccacgcctggctaacttttgtatttttagcagagacgaggtttcgccattttggccagacgggtcttgaactcctggcctcaggtgatccacatgcctcgacctcccaaagtgctgggattacaggagtgagccactgcgcctggccaagattaaactttatcatcaaaattgggtcctctttcatttacttaatggtataagagaaaacattcccccagttattaatattctttgtagtcataagttttgaacaatgtaatgccttccactgatgaatgaaacatacattttgacaccaataccctaagctgagtcttggtttctttggagtgttcgttatttatagaaacactatgttgatatttttgtgcatttacctttgttcacatttccgatttcctcatggttagatttttcagaagtggaattattgggtcaaaggctagaatattttagaatatccagaaagtgttacaaggagcgcacatgatgatttatcagagatagcaatacttgttttgttgattacaccataagccacgactaccaactgtttttaagatagtgtcccaggactaagtttgttcaaatccagttaaaagatcattctgatacagtttccactaaaaaatctgcacacattgctacagactgtatagcagtggtttttaaaaaaatatataattatatatataatattatatattatgttatatataacatatatgtcatatatatgttatatataatgttataaatataattgtatatattatatgtacatacatacacacacacacccacacacacacacatacatatatatttttgagacagagtcttgctctgttgccaggctggagtgcagtggcgtgatctcggctcactgcaacctccgcctcccaggttcaagtgattctcctgcctcagcctcccaagtagctgggactacaggtgtgtgccaccacgcctagctaatttttgtatttttagtagaggcggggtttcaccatgttggccaggatggtctcgatctcttgacctcgtgatccccccacctcagcctcccaaggtgctgggattacaggcgtgagccaccacaccctgacctacatataatttcgtgtacacattatatgttataacatagtatataaaaatattatatatatgttttaatttattggttaaggctagtcgagtgcagtagtaagaaggggaaagagtagaaccaggagttctatctgtaacggactgtgaacaatgaattgagataactcactacctttggagcagcctccagcagtggttcttgagtgggagtgattttgcctcccatgggacatatggcaatatctggagacatcctgggtagtcacaattgggatgggagggtagtcctagcattttgggtagagaccaggaatgctgctaaacatcctacaatgcacaggacagtgctggtaacaaagaagctttggaatatcaatagtgctgaggtagagaaaccctgttctagggtctagagttgcatttccaaaactgtgttctttggcacattaatgttgtagaataagttattaacaatgattcttatctcacagattcttaactctagtgaagaatccatgttttgtgtttttttgagacagggtcttgctctgttgcccaggcaggagcgcagtggcacgatcacagctcactgtattctcgacttcccaggctcaagcaaccctcctacctcagcctcccgagtagctggggctacgagcatgcaccaccatgccctgctaattttttctattgtttttcatagagatggggtttcactatattaccaggctggtcttgaactcctgggctcaagcgatattcccgcctcagcctcacaaagtgctgggattacaggcatgaataactgtgcccagcaaatgtgttaatccctacaaaatgctcagcatggtttctggcagaaggtcaccatgtagtaacattaattatatgattattattaataagatgtttataatgaataataagattcaccactggataataggtgcatctcttggggatttaccatgtaccttagcacaacagagactcagaattctctagaaaaaatactcattaaacttagtattgatgcaactttacttgactgagagtccgacatatatatataatatatatattattattattattattattttgagatgcagtttcgctcctgttgcccaggctggagtaccatggcacgatctcggctcactacaacctccacctctggggttaagcaattctcttcctcagcctcccaagtagctgggattataggcacccgccaccacgcctggctaattttttgtatttttagtagagttggggtttcaccatgttggccaggctggtctcgaactcctgactttaggtgatctgcccactttggcctcccaaagcgctgggattacaggcgtgaaccaccacgcctgtctcgtatctctatttttgaaagacatcaattaccatctccaggaagggttttgtctcaggaaacactggaaaacgttgctctcgaacaggtttccagaaattactgcctgtggaccaaatcttgcctgctctcagttttagtatggccagggagctaagaatagcttttacgtttttaaatagttaaaaaatagtaaaagaggccgagtgtggtggctcatgcctgtaatcccagcactttgggaggccaaggtgggtggatcacctgaggccaggagttcaagaccagcctggccaacatggtgaaatcccatctctactaaaaatacaaaaattagctgggtgtggtggcacgtgcctgtaatcccagctactcgggaggccgaggcagcagaatcacttgaacctggcaggtggaggctgcagcagtgagccgagattacgccacttcacttcatcttgggcaacagagcaaggctctgtctcaaaaaaaaaaaaaaaaaagtaaaagaagagtaatatttcatgacgtgtgaacattacctaaaattcaaatttcagagtccataaataaggttttctgctaacacagccactcttgttggtttgcgtgtggtctgtggctgctttcctgctgcaagggcagagtgagttaatggtggaatggactgtataatctgcaaagctgaaaacacggactctctggccttttacagaaaacatttgccgtcctctgatttaatgtctcttctttataatgcccgggacttcttcctctgaatatataattttaaaaaaccccattttgaatattacagcaatggagcatagtctcagctaaatagttatttccataaaatatgtccaaatttctgctttaagtcttttgtgaaatgaggcagaacataaattttaaaatgtcataatgaaaggccataggatttaatctcatgttcacagaaatatcatctgtaaattttcttatgagggaagataacgtatatttttctatttagttatttctggagtctaagtctagcctaggtctaattagaaacttttttttttttttgagacggagtattgctctgtcgcccaggctggagtgcagtggcacgatctcggctcactgcaacctctgcctcccgggttcaagcaattctcctgcctcagcctcctgagtagctgggattacaggcacgcaccaccatgcctggctaatttttgtgtctttagtagtgacggggtttcaccatgtcggccaggctggtctccaactcctgatctcaagtgatctgcccaagtgctgggattacatgcgtgagccactgcgcctggtccatttttaaaaattttatattttttttggaaaaacatctgaatgtagagaggtgggcttatttctcaggtcccagcattccaaggccaggatcattgtcattgccttccttccagttttttttgttttatttttgcctttttaaatgaacatatttttacatactctagatcattctgaatatagaattttgagttttttctctttgtttcccacctgtttttttctctttttttgtttttttcttttttcttgtttcccacctattttttttttttagacagaggtttgctcttgtccaggtttgagtgcagtggcgcggtctctgctcacctcccaggtctttgcttcgactcccagattcaagcaactctcctgcctcagcctcccaagtagctgggattacaggc

SEQ ID NO: 36475 - DNA, 11778 bp, Homo sapiens
gtgcgtgagaacgccggcggtgaccgcagccacagcggtgaccgagtgagaggaaggcggcggcggcggcggcggcggcgtgaagtcactgctgctctgggttcgggttggcgactgaaggcggtaccggcctcccggaacagcccgggggagggcttaggtgcagaagggcaggctggccgcggccggtttggtctggggaccacgggctggagcaggtgggcaagcgccgggacggtgtggggaagacacttggcagcttctcgacctctggtgtcccttcgtttcttcgaattcctattcatgcgccgcacccttctcggacccccagcccctcgctaaggctctggggatgggggtcaagtctaggctcaatggacctcccctcctccacccgggtcaccactcctcggaaatcctcgccccactcccgcctcaggcctgtacctcctggctgtgacgtggtttctcagcgactgcctcacctcagtcccaaaatcctcactgccttagatacatacgtgcccccagaggttggcctgggtttcacagtatttccctaagggggcaatatattaaagctgtccttcgaagttagtaccctgcctggtagatgcccatgggatgacaaagaggaggaacaagggttgaccagattaggactaacgagagaatagtctgagtccagagacattaatctgtctctttgttttggcaggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggtaatcggccctttgcctagaaaataaaaacaaaagataattcacggctgggtgcggtggttcacgcctgtgacagcactttgggaggccgaggtgggtggattgcttgagctcaggacttcgagaccagcctgggcaacatggcaaaaacctccctctacaaaaaaatacaaacattagccagacgtgctggtgggtgcccgtagtaccagcgactttggaggttgaggtgggtaggatcgcctgggaggccaaggttgcagtgagccaagattgtgccactgcactccagcctgggtgacagagtgagactgtgtcttaaaaaaagtctggaaagcctctaaaggaagaggcagtgtagtatgctgctgaggctggtaggcatgggagtcaggcaccctgggtctggtcgttattttgcgtcttattgaggtttgtgactctaaacaagttaactctgttagcctcagtctgtcatctgtaagatgaagatataataatgtttcacaggcctgtcatgatgattgaggtagtacatgagaacgtagtgagtactctaaaccagccccaacttcccaaagtttacttgtgcctacatcagtggttcttaactggaggggggcaatccccccttcccacaggggacatttgccaatatctggaggcatttttggttgtcacaactgagaggaaagtgaatagagggcaggagtgctcctaaacatcctacaatgtacagaacagccccccaacaaagaatcagctggccccaaatatcaagagggccaaggttgagaaaccttagtctagatctagctgtcttaataaataacttttgctcgtatagccatttcagtattttcgtatataaaagtaagccatcacttaacgggcttgctgtccattctttagataagaaaatgaaaatggaaaagctgtctttcatttttaattcattcatgtctactttagattttttatattaaagtgtggcttgaatcagtaagtcgtgaagggcagaagcaacatggtgtgcttactgagtactaatgtttgcgctgttattcatttcttcagtcagccagcctattctgagaggtcactgcccattctgtaccaagcattgctggattttgtttgtttctgcacgagagaataacatcatacaaaatggagctttgcctgatagagcttacattctcatcttcataagctatgtggtcttacgacttcataagctaagttttctccctattttatagtcaaggaaactaagacttggagtaactgatgctccaagtcacatagtaagtggcaaagccagcaaaagttctgtgaccttggacaaggacaggcagtgttcttctggggtttctttgtacaggaagaattgagacagatcagccaaagcaggtgtgctcctgttctgagtgtcctcagggagattctagaacccttactttggttttatttcatttgctgtatatcttggagagctgccagacttactacattaataaagaatgtgggtgtctataggagatcgaaggggctactggttatatgacgtgaaaagttgaaatgttattttctttgtaacacccagctgggatctatgacttggaaaggattggtgctttcagtggtagagaggaaaggcatagcaagtcttccttcacccctaaagtgggcagtggcacagggcaccaggaaatgagggcttgggaggagaagtgcagggaaggaagtgaaagcaaactcagctttttcatgtgtattgctgtagttgctgctgctgctgcctgaggccaagattccattacatgagcagctgtcttctgtgtctcagctctccaagtgcctgctcattctctgaaccagtttcccagtccctcactaattgggatcagcatcctgggtctttgggcatagcccttgctattgctcatctcattaggctcagaccttccctcgtaatgggcatcttgatcctgtatgggttgtggaatattttctttattgtctgtcttttcctgttaaactcttgccattgactgatgggaataggccataggccacgtggttttcctgtgccttgtttcagtcttgagacaaagcagagtggcattcagatttttttgcagtagcctctgtgatgtctcctctgttcattttctcctccccttccttgtacctgagataatgcatcagtaatgaaagcctggattgcaactgtgtcctgattggatctgggcttctctggaactagtgaatggaaagtcaaggagaccctgtgaaatgtggctggtcccctcttaggttcctctaacagctccccagctgctcatccagccaggttactcaaaccatggcacagataacacatgctcttgcaactgccaaggttttttggcttatttttgctgggggtgtgacacaattagagaatgtatactcatttttctttcaaaggaaatgtaaattttagaaccttctcatctttaggattttggaatgttagctagttcagttcttgatagatttaaacagaagaaacctggcttttcctatggtggtaatcattggtcagaaattcagctctttagtgctccaattgagagagttagatgtcctgccttcatggtgacaccatttttatacttgattatttcaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctggtaatccacactcatcttttctttctggagctttttatgcagggttgcttatacagactcccaagacaagttgcaaatggctaggatgaattcttctgtcctttgaaaacagagaagttagatattctatctacagtgaaaatctagaatgtgttagtaagtgtagtttcagggagtgcctgggaaaaaaaccagagtgattatgaggagccagcatagttgtactgggaataagccataccaaatgaatattttcttctgggacagttactaggtggtagatgggaaattctgtaagaaccatagctagagttagttaaggtatctttggtctggggaaactttgtagacacattacatgattggggaacttcttcaggtacaatagggtgccagcctgcccgagtcactagggtggttcactgtcgtgtgactgccagcaaatttaatgccattgagaagtgagggcaaggttgatgtgacatcactacattttgtgatagacaacatcagaaattgtggtctaaagtttggaatcgtgttttaacgggaggctcaggcatatacttcagagggccacaggattatcaagaatagaaattttagtgaaccagacagcctgtaaagaaactagaaatatttagcctggaaaagaaagggcgtgggggatacaatagcagcgtccacctcaggaatcaacaaactatggcccactgcctgtttttgaaaatgaagttttggacaatgcaccaagattatcttgcacataggccttcaaatatttacaccagaggtcattggcaaactgcttctataaagggccaggtagtaaatatgtttggttctgtgggccgtagggtctctgtcacactacccagttctgctgctgctgctttctctgtagcatgaaagcagcgacaggcagcattatccgaagcccctggcagaccactggcctagatgatctctaataggtgagtggttcagaacatgggccttttggaaccttacagacctagacacttaccccatgggatcatgatatgtagtgagaatgtgaataacagctaacttttcttgtggtcactttttaaaaattttttattcaaggctagccaactgaagcagtgggagaggagaaggaacaaagaaatctgtaactggttgtgatcaattagtcgtaaacactactgtactcagaccagcctcttttggtcacttttctagcgtttaagctaagcaccctacattctcccctttaatcctcataacaactctgtgcagccagtattcttagtgtccccatttcagagctaaagatactgagagtgaaggagtcattcatcccacatcaccagctaggaaatggcagagccaaaactgaatccttatccacctcagacccatgttcttaaacacactgtggtgataatgcaggtagaatactctgcagtgcctactacacatagcccttcctgctgtcggtattctgagggccttgttgtgatggagacttttaattaatgtttactaggaaatcctttatacttctaacacagaaagttcaaggccagtcattcccaaccttgggtgattttgcccctcaggcaaatatcctgctgaacatcctgcagtgcttagaccaccataactaaaaattgtccagctccaaatgtcaatagtgccacggatgagagaccctggctaaggctaagtgctagcataacagtattggtgacccacatgtctgggagaagggattcttcccaccttctgacctcgcagcgttgagatgcaaagactcatctgtaatatattttgcctaagggatgaagcataagcagaaacctaaaaaatctgagaatatttttttaaaaaagcattgctgtacatgtgtgctatgagagttttccccagagaatgaatagtcatttttgaaaagcttgtcgtaaagtttttagaaatgcctgaagatcgtggcgttagtttctacttcttattccttggtgacattacttctaaatttgttcaaaggagaaagaggccaaaaatttaaccacagtgtttaccatatttgagaacttaatcagtgaagaaacacaacctcagtaatgtgactcttcaaaacagtcaaattatgtgagaagtctgaaattttgatgtcactgatttaataagtaatctgtgctttttgtgtgatgtattgctttccaggaagtagttaattatattgccttttactttatatcctataaaagcaaatctgttcattttatttagatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtgagtgaacatattatttaagataaaaatttcttgtcagaatatccaagagttatatgctaaagagattttttaccttcaaaacaatatagtacatttttatgtattaatcagtttataatcacctgatttttcacacctgtcagaatgtaagtgcgagaccagtgtattaaatcagggttctcaagagaaacagaaccaataggatatgtgtaggggggcaggagacaaggaaggcaggaagatatttattgtagggaattgacttacacaattatataaagctgtggagtcccaagatctgtagtcagcaagctggagaccgaggagagccgatggcacacttctggtctgaaagccagcggtctcaagatgcaagaagaactgatgtttcagtttaagtccaaaggcaggaaaagtccaatgtcccagctcaagcagtcatgcagaaggccttccctcttactcatggaagggtcagcctttttgtcattcaggtctgcagctgatcagatgtgacccacccacacggagtggggagggcagtctgcttcacttagcctactgattagaatgttactcacattcaaaaaacaccctcacagacacacccagcataatgtttgaccaaatgtctgggcatcctgtggcatagtcaggttgacacataaaattaaccatcacagctagtaataggttttttaaaaaactgaaaacactgttagataaaatgtttagaaaaagttaggggatcattgatcagtggtactatctgaacaattgtcaccttaaaaatagatgattctgtaagtctggtttactgtgactcagtaaaatgagactaaggtgaaccttttatatttgttttcaatgcttctatagtagctttggatttatagtgctgctccatgatcatgggtaaatcttgaaaatgagccttagatctgttaaattcagagaaaatgagcattcttagttctttctcaaaggggaatgttgaataaatcatcttatgaaaatatgtggattaactttatggcattatcaggaacagttgtcaaattttaccaaatattctttcctaggtggaagtggaaggatgaggatatcagtcagaaggatatgtataatatcattagaattcacaatcagaataacgagcaggcttggaaggagattttgaagtgggaagcccttcatgctgcgtaagtatgtttgagatcttaaatgtttcaagcatctttgttatttcatatcagctttctagagttttaacattcaaatcatttgttctaataaaacattttatgtagcaggcatggctcagtgacaattgttgcatgacaggccacccttcttagttgaaaaatagcaaccattttattaggcttgtggattcagtgggtctgggtagccaaggacagggcaaggatggcttgtctctggtccttgatgtctggggcctcagctgcaaagacttagtggtcaggatggcttccgagccgtgggctagagtcttctgacggcctgctggtttactcctctggcgagtggtcatggcctctgaatatggctgttttcggcttcgtcatatggtggctaggttccaatagctagagttccaaaaagcatctctatctccattttctgacccagcctgggaagtcccaaagtgtcagaagcctgcccagattcaaggggaggggacagagaccctgcctctcagcagaaggagcattacagcccttcgaaagcagagcatgtgggaagggagatgctaaaatgccatctgccccaagggaggtgggaaagacatttttgttccctcaatagcatttattgaatccccattaggactaaacacaaagagatgtcttaactcagagctctttttctcaaggagaataggtaaatgcagctgtgtgtgttaaaggagacaggacttcagtctgttgagagtagtggttctcacactggagcgtgcatcaggatcatggggaaggtttgttaaaacccagcatgctgggtcccacccgcaggatgtctgactgagtctgtttcgggtggtgcctagactgggtgtatctagaacactgcatatgctgctggtttgagccagattatgtcataaacagtggttttaaattcattgcacaatgcgattaattaatttcttggctaaagtccacttaatgatttttttaaggtgttttgtttgtttttaatatttgcactctgaagttcattggttgcactccctggctgtcacaggctgggcctcaggcctggggtgggtgcatgtgagaggggaacaactgcaaccgtgttgccctcagtaatctctggactgagaggagccacaagtgtttgcagtgacctactttgaaagtgtgttctaattaagaccacctgctaattacttgtgtgattatggagcaaagcgaagagagaaaagggaatttcagtttgtcagtttcaattccttctccagttattttctggacggtcaaaattaagtagaccgtttaaaaactcatgctatgatctccagaagaaagttttgcctagattgagtttacctttttgcctgtgatcctcttgagaagagatgttaaggagaggagtagttcctaaaaggagaagaaaagtaactcataagtcctcaaatagaagtcctttatactttggaaatttttctccctcccacttacttagacacctatcttgttatccatgggagcagctaacaatataggtggcctgctgacttggccaccactccctctgtctcggtaacagctgtctgtctagcctgtaggtgggctgtgaactccacgaggacagtgctcagagggtcttgtatagcaggtcagtgccctgctataccctggtgcctacagagggctggcacctagagagtcctcagcaggggtctgcgggtagagggagtgcatttgccagctaggactctgccactcctcatcttatgtgtagttattaaggagctggtccaacattaattacaatccatttctagggattaatccatcattttcttttcttcataaaggctgttcattggtttgaaatgaaagaagagtataggattttcttgtttgtctgaaaaaccccagctgctctgtgccaaaaagaagcatgatgcacaatacttgaggctgtttttttttttaatttgcctttcctcctccaccaaatggaaaggccctgtttcctgactcctcaaagtgcagtgtagatatccagaaggaaggggaggcaatggaatgcaccagtccagaaggaaagaggaacatttttaacaaataggcacttgttgtttgaattattttagaacttacctttctctgtaaatgttatattatgtgaaatgtatacaggaaaaaaatggatattactaaaaaattagaacatcatctttgtcaaagaaaagaaaatattttaacagacttttcttatttggggaattctagagagtgtccttgtggtccatcattgatccggtttggagggaaagcaaaagagtattcaccaagggcacgaattcgttcctggatggggtgagtgtcagcgcagaagtgttgtttcaccatcctcaggtcagggtcaactttctcttcacaccaaaaccagtctaagaattgcagtgccatcttgcaaaacttaatgcatattcaactgtagatgtctttctctccctgaggtttgcccattaatgggcagatttattagggtgtagtagattgcttcctatatatcatagggttgaatggagttattgtcaatgttcttggatctgccctcttactcttcccgtgatctgtgtctttgggtttatgcacttagccatcctccctttcttttctagcatacttgagattttttgctcacacctgcatctctgcagtatctcagctgacctccctggcttaggtctcttccccattggccttattcctttgtagacagatgagctgtcatctgatacggacttatcacagttcttcagtgccatcttcccttagtgctgttcactgtgtaattcttcaagtctgacttccccagttaggtgtttgggagcaggtgtttgcatgtgcttcttgagttttctcatggcttaaaccgggactgaatgtattgcaagcattttaacactcagtggcatgtttttattccaggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccagattgaattgcactcatgatgtaatgggaacttcaagtgggtaatcacactttttccttcacttaacgaaggatactatgcactgttcacttttgacttgtgttgtaccttgcagtttatagcagatcattttgttttcttcctacttagcttaagtgggaagcagtctctcagtttttcctttacctgcagtattgtctgtatatttcatctcgaaaagcctgaacaacctctgaaaaagagcttttaaaaagtgatgaaagttgcttttttttcttactattttctcaggaatactccagagatgtaaagcctgagagtccatggtgatgctcaagagctttcatctggccaaatattttaactaaagctgttcattataaataagaggtgattataccttttttaaaaaaagttaccattatttctaaagcccctatggtatgattgtgacctttaacaaaatgcaaaggtatacactggaaaggtactcagcaaaattctctccaaattctgatttatatgaatttcttggactggatagagtactttcaactataccttcctttggaacataccttttaaaaaatgttccctttaaatcctgttattctaatatgtaactctgctcccaacaaacaggtctcctcattgtccttggcatttgacaagttatcccaacttcgaatctcatttcttcctttgctggcagcctccacccttccccacatcagtcggcctaatccaaaccttgaaagcctggcttaagtcccagtatcagtgatggtccccctctaaaacatgattttatatttggctgagtgttaaaattcacaagatgagcatttttttcccagatggagaacgcttcaactcagtctagattttttttgtttgttttaaggaagctctaagtttgccattgaaactttttgtaccagtaatccataaactggttgttctatttatagcagcatgttacaaatgactgctttttttttttaactgtctatactattaaatcctttaatttatcctgaatgctgtagtgttaaattagtggatgaaattggcagtctgtgggtgattaatttggtatggatttgtcagttttgtgtggagtttaagaaatagaacagccttaaactctacatttcaaaatacttgtatattttaaaataaagctgattagttcacaggt

SEQ ID NO: 36476 - DNA, 219791 bp, Homo sapiens
caccaagcgcagccgccgctgccgcactttccacttgtattgatcacctctcagccccgcgcagccggctcgcccgagcggaccgcggccagcgcgccagcccttggcagccccggagcagtcgggctccgggaggaaactccttgggagcgccctgtccggggtgccctctgcgctctgcagtgtctttctttctgcctgggaggaggaggaggaggaggaagaggaggaggaggaggaggaggaggaggaagaggaggaggaggaggaggacgtctggtcccggctgggaggtggagcagcggcagcagcagcagccgccgccgccgccgccgctgccgccgccgccggaaagggagaggcaggagagcccgagacttggaaaccccaaagtgtccgcgaccctgcacggcaggctcccttccagcttcatgggcaaagtgtggaaacagcagatgtaccctcagtacgccacctactattacccccagtatctgcaagccaaggtaaaggggcgccggggagaggtgacggccggaggagggggcccggggacgcgcgcagggtcaggcctggggaggggggcgcgcggcgaacccccgccaccgccgggcggagttgctggaaggttgctaactatagcgctggcctgggcagagccgggcggcgcgcggggcggcggcttccctgggagcggagtgcggggatcgggttacagaaagccgcggggggagagactagacaggaaagagccaccagccccttcctggcccggccagcggggagggtcgtggggtcgagcggcgcccctcgccgagccctggctggccggcggccgtcgcctggtgtgcgcgtctggatccgctggtggcccggcttttcgaccccttctccaagggcctcgccctgtaagctgtaactcttcgctcccctcgccgtggcgcggagcctcccgccccccagggacgcccctccacctcccgcgcacgcgatgactggggctggaggggcggcggggccgggatattttcctccccgcctccggccctgagcgcccgcccctcgcctctgatctttgtgcggtgtggcacttcacctggttactgatttctacttttacgctggtgttttgggtagaaaagtggccaaagttcactcgcgttcattgatgtcccttctaatctctagaggttttgcaaaggagggacaatgggcagatttcagtgcagagaaagaagtgacttcgtatttggttaaaaaagaaacaaaaacaaaactagcttatatgtttgccacagatcgatttccaatgttgctttttaaaaagtgacctcggcacactcttgggtaacaacagttgatgacatgtagccatacaaattgcgcctggctttctagggaccctgggtactttgttagtgggcctatcttatttttacaataagaatttgatgcctcccgaactcatttaaaaaaattatttgggccatgaagactggaaatttcactgctttggaagcagccgccagaatttgggagggtggaagttggacgcagcagccttcttcagccattaacatctatcacaactctgggtgcccttctagatcacaaaagaatcaggtatggatgcagtgtccgaactttctttgggaggttgtaatcatgctctgcttgctggtagttgggcatttccggcctggtacaaagaatctctgattcagccttttctttcttagaatgtgtgtggtccacgttttcatgtacttacgacatagccctgtatttgtctacgtaaaaaggacacttgtcagtttcgagaccagaaatgtcctagcaatcccgggcctcattttcacttcccccaattcccactttactttgggtcaccagaaagcagcaagatggtagcagcaaggataccccttattcatctctgtgtagttctcacagtatttgttttaggaacttgcaggagatgctagttttctgtgagctacatggtagctgttcaaagaaattttgtggcataatcaatgcactaccttttagatatcttatatatttaatgcacttgtttaaattatgcagcattgggtgcctaaaggacagcttattcaacacttaacaatatgaataataaatacacccactcaggtgaggaagaaaaaaagccatgtttctacaggcacatttaccttagtaatttttatataccattagtaagttagaaaccaagtccataccatttaatgtagctaatgcaatgccatttggcttttttgccctgtaaataattgaagagagagacaaacggcaagagcctgctctagtaattagggtcggatcccagaaagctttacggcccattttctgaaagtgtgcttcctgcataaagcatttaatattgatttgtgttgcggtaaatgacattctcaaaacattttgctaattctacaattaaatctgaaatcctattattcggaattcctttgtttctggagaaaggtatacatactcacttgacctatataacatggtattaaagtttggtaattaagtctaaattccctgttgtacaagtatcttgattatctcagaaggggacatcttctaaaaatggcacgtgactagatgcaaattttaggtaagcagagttcggaacaggcagcccttttttttttctctcccttatgtatctgttggtagcatggtagtaatgttgaatcatttaaaaaaaaaaagactttgatttgtagttagtttaaaaacaagtgttgcctaatctacctaaagagttaataaactctcttaggatctgctgtctgtcatgattcttgcctctgtgtgtgctttaaccttccgaaaatatgggatagaaaacatcactctgtttaaagtacagtgatgtgtttgctaggcagagtcattttgaaacttctgtttggaagctatatcaaaaactgaagaatggcatggtcatctaaaaagtgatagctaatttgtactcaagagatagatgtgattttctcaaatctaattcttttaatcagaaggaacagataataccaggtaaaatggaacttaacagtttgttttgttaccatacttttaaaagttatatatgccaaaccattcttcttgttttagtgatccagtctattttggtaaacttattttgtaattttccccataaaaacatactagttacttccacattttattaataaaaaaataccatccgttgggctatattggagcaaatgaccatattggtatgctttgtactttgacagaaagaaaaaaaatcattagaaaaagtaatatgtctccatgaaatgtaaaataaacttgagtgtactatggaagagcaggacatgagtggaaatgaatgagattgtataatattcataataccttggtgtagagttacataaatttcaagtaacctgatttcacatgctgttggttttttgttttttttttttatttctcagtgaggatggtcttatcacagcaggttctttttatcagctgacacattcattctgaaatgtagcttgatgtagctttataaacataaccacatattgtcctaaataattttctcaattttaaaatgacctatgctgtattatattaaatttaatatccatcttttagctacacagaaaaaagatgttgataatctaacatattttaacttaaagatttgtatgtacacattttcaaccagtggctgcattaatttcacttattgtaaaagcaacccttgaattatggtctgtttatttcaaagatactacaacatacattattgccagtgcatgtatgtaaatagttatggggattgaaatattctgtttcttttgaagaaagggaagtacaaaattttctttccatgattagttagctacatattttgtaccaactgaaagcaatttgggacagttgtaatctttattcacatagttctaagaatatatttctataaaattaatggaaagcttgatttttttaagtttttgtgtatgaagaagtattgttttccatgctgaagaaatgtctatacgaaagatacgtttctttctaaaacaaaacaattttgtttttacgccatttttacatacgcttatgacacagaatatatctgaacctagcttcagaatctgaaaataataaatgatataatttattctattaataaaggctagtagaacaaagcagtttttctgcattgaacttttgcatgcattttttattgaattccttaactcttacttacttctagccaaatgaatattgtatcaatctgtttctccagaaattagtagtcctgatttgatacataaaactgttgcatctaatgaagtggaagtacacaggcataatattcagacatggggcgctttgtgtcataagaagtaaccacatttatgatgtaaataaagtttgcttaaaatatgtcagtttggtaatgcagtattttacactgatgaatcaaccttatttccttaagtgagtggggtattatgtatgactatctggaagtggtattgaaaggctgaaggacatgtaactattaaaatgaagatgcattacaatgcaacagtgtagcacccttctcttccaacagctatttcttttgaatttcccatacaactttttgttttttcccctatgttgggagccaaatcttaagttccttgaagggaaaaggaaaagataggtgagctaggaaagtattcagtcatttagtatcagtataactacatacaccttacatcttaggcaatcttggctttgagtttaaattcaaatgtggggaatttccatgtaatatacattcaagaaaagaatttttactaatatattgctctgactttgtatttttaatagtttattgaaaccatttcggcatctagcttttaaattgagacagtaaagttttatcctatttattggaatattatagaaataatagaatattatagaaataggagtatgtcaagttactctcaagtggaagtgttttatgcaatctaaaatagcttattttaaagaaatgtagtaatgacctgtcagttgttcaaatgcagcaccataacatttggtataaaaccaaaccaaatattcaaaagttgaacatcggcttggggattttatgtgggatgaatttaaatgttctgtttcctctgctgttttatttatttatttttgagatggagtcttgctctgttgcccaggctggagtgtggtggcacgatctcggctcactacaacctctgcctcccaggttcaagcaattctcctgccacagcctcccaagtagctaggactacaggcgcgtgccacaattcctccctaatttttgtattttcagtagagacggggtttcactacgttggccaggctggtcttgaactccggacctcgtgatccgccgcctcagcctcctttcaaagtgctgggattacaggcatgagccactgcgcccagcctctgctgttttattttaatgaataaataatgaaacctgatggaactcagctgtgcctcatgagaggcagcaatgggacgatggaggtctaccataggtagtttggttaggtgatacagagcaaaatgtaattttagaacaaatggtgtgtgttgaacacacacacacaaatttgagtacatatgcaaatttgataatagaaacaaagcatttcttagtctggtagatatgaggtcaatagaagagtgtagagaggatggtaacagctaagccaaccacaaactgaacatatatctcccataatctaattcctcaatgcatctagtctccttaacaaaattatgtgaatattttaatttttcaaacaagccctggaaaataagcatgtcaaaatgatgagagaaaaacaaaaaggagagagaaaaaatcaacatctgaacctcctaggggagaaaagtgtataaaattaagcattgttattctctccccatgttgtctcttaactaattcttaaatggatgcattttagaagattgagaatatgttggacattgaatatgaaaacctagattctaaaagtgaggttggatgctgatatgaacagttagcttgcatgtagatctggcactgtaaacatgctaaatcaatgttggtgggtgatttcctacattcactataatatctgtgttttggattaggtaaagatttaagctggtagttgttgtaaaattgctgaggctcatgatgaaggactaaaacactagccaatcaattgtatttactgagtgaccccagtacatcattctttgcacttgacattgggaaagtttaaagagttgaatatctggtacctgctctccagcacctcacaagctaccagggaggacagaatagacacaaggcaagaaataagcacagaatatttacaaagtagtgcacccacgaaagcagcacaccagctgatgtcctgggttttagtgactgagaaggcactaagatatatgtaggattaaacactttgccatgtcttttgcaagaaagtgaaaagtgctaataaaagctacaataaatctgggaattttagaaagacataaggctttaaatgaataaatgaatttttttacttaccagcattgttttgcattttttctgctgtataaattcttttaagagtacttagaattttaaacgaataatttttttgtactttatgttaacttctccttaaagtttcatattcaattaatttatttcaccctattatttttctagttttatgcttacaaatgtgctgttaagccaacctattagaggtgtggcaggttggaaatgtactccttaaatgatggcatagtggttatacagaaatataactttgattgttttgagccatttggaatgatgtttatttctcctaactgattagctttgcttccggcaaaggggaggaaataagtttggggtttgtaatgctgctaattagatcattgcttgcctgcaatctacacatttataatgtgtctaatgtgggctggcatttcttcagaaaataagatgttaaaaaattattcctgatctttagtggatatctctttatctggtcatcagccagctttaattctttcaaaataagatattcacctctgcaactggatccaagtgcttcaggagtcctgttgtcctctacttggcctcaatatgggccctggaatccattcctcaggctgcccattgaacaacatgcgctatgcagttgggctgctgggtcccagataaacagtgatttcagggaaaggttttgtgcaacaaaatgagatcatttcatagatgtcataaatattttcactggtcctgaaggaaaaatgcatcatcttcccagacccatttcacacaatactagaggtgtttcttctacaagttgaaaaactgaatacttagaatggcagaattggatggatacatcatagaatgccatgctccgaacttgagtttcttggactgggggtggggggtggaggacagggaatcaaattgcgaaaacagaattttatattatgagcttacatttatattatcctcaaataatactatactatttcccctgttaaatactttttaaacatgatgattttgagttgcaattgggagtatatttgaattggagaacccctaaaccctcccttaccagtagaattacaatgaaatactttcacagtttatataataaggtctcagataaaatatttagtcattaggaaaagtaaattatattgatatttgtaatatcgtcaactttacctttgtcttctcaacaacaatttcgtttcatcatccaacaggtttttgacaaatgcagacatttataaaaagaaaaatttgccagaaaaatgtattttcaagtcactagctgaaatactcccacgactctctttgcctcctacaaagtacagctctgattaatttcattgtttctaaaatgacattcttttaaaaaggtgcctaatctcagcctctttttaggtttcattccatatgatcatttgtatacttctatttaaaaaacaataaacacagaaagaattacctatcagagaactggctactagatgatgtttttctcatgctctatgtgatttgttcaaaaattgggtataccttaacttataagtgagttgcatttccaacaattttattccaaacagttcgcttgtcatttggttatttaaaacttgaaattcatttcataaataaatagttatccttaatgatatggtccccagcgaacctgtaagagtctgtaaaagtaacccactttataattcacgtatagttctctactaacactgccattgaaccaaatcaccacatcagatgtttcttggagagaggggtgagttttcagagttagatttccaggaactcgtctttgctttctttgggtgagtgggaagacagggttcttctacaatctttcaacaaggctttgcccttttatggcaggggaggggtttcaagaagatgggaggtgcagcttgtgaagtcacagggatcagggagtttgtgctggagcttcctctgggggtcccctgagagccctcttcacttctagacccactcacctgttttcttgtgctggcctcagagataaactcgttcccttttccccctaattaaaataaaatcttttccttttaagagccgagggttcctagtactgcttctcatgctgagcttaccactactagattactacagcctcacagcttttctttactctccttcagccctgaatcaagcaaacatctcttgaggctggcaaccagaaggaaacaaaaagacaaagtaaaaattctgtctatctcttccaattctctttttaccttttcctggttcgttgatgcttcgtaaatttttttttttttttgagacggagtcttgctctgtcgcccaggctggggtgcagtggcacaatctcagcttactgcaagctccgcctcccgggttcacgccattctcctgcctcagcctcctgagtagctgggactacaggcgcccgccaccatgcccggctaattttttgtattttcagtagaggcggggtttcaccatgttagccaggatggtctcgatctcctgacctcgtgatccgcccgccccgggcctcccaaagtgctgggattacaggcgtgagccaccgcgcccggccaatgcttcgtaactttttagggaatccccagaccctagacctccttgagaatccgatgatggcgtacatttttttgttgttgttgttgttgtgacggagtctcgctcgctctgtcgcccaggctggagtgcagtggcgcgatctcggctcactgcaagctccgcctcccgggttcacgccattctcctgcctcagcatcccgagtagctgggactacaggcgcccgccaccacgtccggctaattttttggatttttagtagaggcggggtttcaccgtgttagccaggatggtctcgatctgctgacctcgtaatctgcccgcctcggcctcccaaagtgctgggattacaggcatgagccaccgcgccggcctatggcgtacatttttattagcctcaaatgtttacctagaatcagcctgtggagcacaggttaagaatcttacccagggtggggagcagtggctatgcctataattccaacactttgggaggccgatgggggaggattgcttgaagccaagagttccagaccagcctgggcaacatagtgagacaccgtctcttaaaaaaaaaaaaaaaaaagaattttatcctggaaggaagacaaatactgaacaaatctatgcttaagaggatgaatcagacagaccagagatcccttcatgttttttttctgggttgtagctcaacagactctgtgatgaagagctgcacaaaagccagtgtcctgcagagtgggcttgggtggcatgaggtccatacccctatccagcaagggtctgaacagtttcaaagtgtgtttactttctctcttcttcactcctgttctccaatttgcttcttgtactcttagagttaagccactctggactgacttctgtccactaacaggtgtgtgtgatagtggtagatgcaccagtgtgaccatcgtataagctactcccactccatctgccggaatcagggaccaagtgggtctgacaaaatttggctaaaaaatctttactacctcttaatgctgtagattatgattaagtatttgctaacaattgcccctgatttgggttttctcttctgattctttatccaattttatatggaaattttaaataaaattttatttggtaacgtataagtgtgctatggaaccatagacatgatgtaatactttgaacaaaagtacttaattagcataataggaagtatttttatgataaatgtatactcctaatgagattgaaacttaaatgtgataaagtcaaatagcaagcagtttacatttttttcttaacccatactaaaattgaaaattacttataaccattttttctactttttgaatactaattattctttacctaaaaaataatcacaaaaaagttgtgttttttcaattggcaaaaacctaaaaaaagatgtgtttcttatttggtaattgtttatcagactttaagtttagcagaagaaatctttaaccttgattttgtttgcttttttttttttttaagagagattattttttaacctacaaataggatttaaaatgacagtgggtgatatctggtgttcttttctacctctctctgtctctgtcacaaaattcaaatacatgtttcagcagtacaggatgttcttcagtacacatcctttgagccttcaaaatttgatttgactgtgtggtctgacgatagcatgttgagataagtacattgtgatagtaatctgtgcctgagccctaatgagcatctgctttctagggcgccacaacagcacctttctttgtttcctcttcctttgcttctttgatttgaatcttgttaaatcctgcaaatgggtcatttttgtttgtttttcagtatgcaaatcctcctagctcccttttttggggaaaaagaagccagatattttaaatataagtgaatgcactgggaattttaaaggagtcttcaggaagtgcacagccatagttcttctattagcaaatcagacatattattctaaaaatcatctagttaagttgatacaaatggaaatacctggtcagtttaattaaattcagtaaatacttactgtccaggcatggtattaggccctggaaggtgtgatatgtaattaaaacatagtgtgcatcatcacaaagtgcagtggaataattttatttgtttatttaaaacttatatagtgcacaaattttaaatctgtaggttgatatactcatgtaataaccactcaggtgatgatataacatttccagaaccagacagcatcctcacttgtacccactaaaggtaactactagtgtgacttctatctttgttggttggttgtatccattcttgtacatcataaagatgaaaccatattgtatgtatccttttctgtctggcctccttagctccttattattttggtttgagtcattgatgttgttatgtgtgcagttggttctttttttaatgctatgtgtattggattacaggatatattgtatcaaaatttatgtatccattatattattaatgagcatttggattatttcaatttaagactattttgaatacaattactgtaattgtcttgttcatatcatgtgttcaacatatgcacttactcctaagagaggaatttgtaggtcataggatatgtgtatgttcagcttgggtagacactaccagttttctcctgccagcaaggcatgagaaatctaattgctctatgtcctcactaaaacttgatattgtcagtcttttagttttagcccttctggtgagtggatatctcattgtggttttaatttgcattttcctgatgattagtgatgttgagcacttttaaaaatatattcattggccaattagatatcctcttttgagaagtcttttgcaaattttttgatcattttttaaaaataacaactttattgggatataatttacataccatgcaattcaactttttgttcactttttaaattgggttgtcttttttattggtttgtaggttttaaaatatattttggatacaatccttcatcacacatatgtatgaaaatatcttcccttaattttcagttttcctttttactctctgattgatagttttaataaatataagttcttaattttaatgaagtaaaatttaccaatcttttatgataattgcttttcgtgtctgtttaagaaatctgcttactttaagattgtgaatttttttcttttttttttttacatttcctactagaagctgtgttttatctttcacatttaggcctgcaatcaatttccaattaatgtttgtgtttggtgtggatagcatcaagatttgttattgttgtttgttccacctcgcccacccccggtgccccagtatggctgttaatgatccagcccaatttattgaaaagacatttccttctttgaatttcattgttgcctttgttgtaaactaggtgaacatgtttgtgtggttcttcttctggactcctgcttttttttttttttttttttaaggcagtctcactctgttgcctaggctggagtgcagtggcgtgatctaggctcactgcaacctctgcctcccaggttcaggcaattctcatgcctcagcctcttgagtagctgagattatgggtgtttgctaccatgcctgggtaatttttttgtatttttagtagagatggggtttcggtatgttggccaggctggtcttgaactcctggccccaggtgatccgtcacctcggcctcccagtggattcttgctctgtttcatatgtatccttgtgtcaatactaattactgtagcaatatagtaagtgcgtattctccaaagtggtcttaactattctaggttctttgcatttccttataaattttagcatcggcttgtcaatttccataaaaataaatctgctaggatttttactggaatcatactaaatctatacatcaattgggggagaattgatatattaacactaatgaatcttccaaactttaaggatggtatatctcttatttatttatgaatttacccctttaagtaattaataataaaacacaaaagttattgttttaagtacttgtttcttaaatacatccaatgatttcttcaagatctgtattatggtagttggcataggttctatgaagaaaataattcttttgaagagagagagtatgtttgttatcacagatcaaaattaattttgaaaaggagcttgccactgaaacctactctttaagaacagatgacgttctttttaatttttcttgcatgcatgtcaaaatataactgtatttcccctttatactctttattctctttgtttatttgatggctttgtttatttgatgttgttgtgacaccccatcaccctgccttatatgtttataaacataataataaattgaaaattagttttttttggaggattttctgacatcccttatgattttttaatatgcccctgatattgtgaaagcaaagattgggaattgctgcttagataccaacttctaagcaataaaacatgctgctcaatgggcttcagttccttcaaatcttttcttaaatgtttcaaaaatcttatatatatatgtatttttttcatgctttatattgaaagttttaagctttgattattgccatattcagctagccaaaaacaactacatagaaccttcaaagcgtattaattctggctaggttagcctaggttgagtaggaggttgaatagatgacttctgaagttccttcaactctaaattttatgattctgggaatttataacatccaagaatcacagaatgttagaatgggaaggaactttaagatcatctagtctaagccactcattttacagatgagaaaggctacccagagtgtagagacagaagcagagctctagggaggcagagagaggggaagtggcagaagggccagagctggggagggtctgggcataacctcacaggactggtcaatccatggcctgcagaggaaaaagggagaagagagaccacacaggagcttcagcatcactccaggaaactgatcacaggttggatgggatgcgaatggggccagtggcaccagctggtgtctgaacaggaatcagtaatggtcactctgtctgaggtcacctggcagtcagggccggccagacttttgtgctttctacagctagcatagctgcttctcatggtttggcagaacagcagcatccagagctgattctgccttgctctcatgtgtctaacctgttgtagatgagctgggtagcccagagctgcgccctgctcaccctccatggcccctggcctattcatggccttgttgtgtttctgaagtctttctttgccacattcctaaagatttttgttgttatggctgtggggccaaaaccctcttcactttttcagcatgcctggaattttcccagatcggctggatggactctacttcattcttggtaaagtttctctatcctgccatcactacctgttgtaattagtttggtcaacaacaacaacaacccagtgaggctctgattaaacaccacctctctctgttgaagccaaccctttcgttcaccacgctgatgggaaccaccttcctaatgccaagcactccacaccggtctctgtttttttccctgcgctatctgaatacacttggcaggtgggcagccttcaggaatcatcatacaattaggcttcaggagctctgttttagtcaattatgtggataaccttggaaaaacaaaatgcacagtaggtggcatcaacaagcccgttgtgcctttgggcacagcttttccctcgtgctgtttggatcatatactcattaagtccaccagctgaaaatgtcacaactggctgtgtgccatgcattaggaaaatcaaatacaggagaaattgggatatattgagcaaataagagagaatgatttttccacaatttacaaaagatttaccagtaaaaatgccaccttagttcatttacatatttcaaagatgattacaggtcactaactctttgatagaaagtataatttaaactaaagctatcaggaaccatggcatactaaagattaattagatattaggagaaatggtttgtgcaatttcctaagtcttttgaaaaggatgagtttgttttattacatttgattttcacccaacttcttaggattgtatgattgagtaaaagcaaggtacaattgtagctagctttgtttgtttgtttttgtttatttctcactgttttaagcgtccttcaccgtggttggttcaaaacttttcttcccataagtgtgtgtgaccataactggtgaattctcgaagtgttgggatacacagaaggaaaggaccgtggacaatttaaaatcgtgctatctgtaaggaaacctaagttgtatgtgtaccattattatttgacaagtgtcatagtcaaggaggtctccagtgaggaagtgtgttttaagaatggggagagacatgcctttgtagacagcatgcagtgcctttttggtagagcaattggcccgctaggactagaagattggttggaactgagagaatcatcttaaacaacatgctgagccaaaacattttttgatgttaataatattcatgtgtaaatagattgtttcaaatctctccgaaaacatagcggtagctttgtacttggacttcctttacttgtttaattttcaatggtgaaagatgggcatgatgaacaccttaaaagtcatgtggattatttttctgagttaaaaatgtatacattcaatcggaaagatataaagtctaaaaggaaagtgagggtcaaataagcagatgaggaattattatccctggaaatacagggaattttcttgttgatacaagtttacttcctaaaataaaagtttctggttttagtacctttcatcaaactttcttaatgtattaggaagcttttagcacagtttacccacgttctctaagaatctgcaggcaaattaaaaaaaaaaagccaggcatggtggcatacatttgtggtcacagctacttggaggctaacgcaggaggatccattgagcccaggagtttaaggctagtgagctaggattgtggcactgcactgcagcctgggtgacagagtgagactctgtcccttagggaagaaaaatgcaggcaaactgaagcaagtatataaaatttttttaattaatttttttttgttgttgttgttgaaacagagtctcgctctgtagcccaggctggaatgcagtggtgcaaacacagctcattgcatcctcaacctcctgggctcaagtgattctcctgtatcggcctccgaagtagctgagaccacaggcatgcgccaccacgccctgctagatacatgcaattctgtgttggttgtttgtcactcttaggccgcctgtaaagtttcattctttcgttgcttaaaaaatggagactgcttactaatttgatttttgcttcttcttatattttaacttgcattaagtgacatttcatttagactatgctgtataacatttaatgctaggggaaaaagactgagaaagtcacaaaatatcaggaaagaaaaggcatagcatgaggttgcatgtgtatttagaaatagttttatatcgtactttataaacagtaatttgtgtacatgcaggcttcctttacaagaacataagatccttaaagacaagaagtgtgttttgggccgggcgcggtggctcacgcctgtaatcccagcactttgggaggccgaggcgggcggatcacgaggtcaggagatcgagaccatcccggctaaaacggtgaaaccccgtctctactgaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaagaagtgtgttttgttcagttttgtgcctattacaatgttttgcacatagtaggtacttggtaagtgtttattgaattgaatccatattttttgtttaccaacatgataaagaggaatatgaggcacagacagaattctttagtgatgaaatgcttctgcttcaaatacatacgtgattaggataaaaatgagcttttagcctaaattacctaagtaatattctcaatctcaagctttactatgagacttgctcatagtgtccccaaaggcaatcactaccaagttagtttgtcgttgtcacataaacacttcataaaatgcaaaaaaccaagtattcaatgactatcttaagttaaatatcatgaatataatgtgtatagaaaagggaggcggtggacaggtgtggtggctcatgcctgtaatcccggcactttgggaggccgaggtgggtggatcacttgagtccaggagtttgagaccagcctgtgcaacatggcaaaaccccatctctacaaaaaaatacaaaaattaactggatgtggtggcttgttcctgtagttccagctacatgacaggctgaggcgggaggattgacagagctcggggggcgaaggttgcagtgagccaagatcacacaactgcattccagcctgggtgatggagtgagaacccttctcaaaaaaaaaaaaaaatggggggcccattctactctattagtataatttaaaaaataacatatggatggggcattattaattgaaaagcaattaaattttaaaaagcaaaataaatggctacatatctaaaaacaatatttctcaggatttgctcagggtttctaaggacctaaaactgtgtctgacaagaatatgtgattatattagttaggattctgataggcaatgcatgacatacatacgcaaacttggtatttaaggaatgtttacaaatgtgttggcaggtcttagggaaacctaaaagagacaacgacattttctgaggccagcaaaatacgagtgcttttactactcaaagtctgaaagagcaaagggtgggagcagttaccagaacctggaggggaagcccagtgctgggggctccctgagagaggtgatgaccttcagccaaggactaagcccatgtggaccagttatgtctcactttcctcctacccttagatctgccagtgcctccaattggaaccaataggaagcccgagagaggaggataccagtgatgcagggcctgtggtcggcccccaggtcacaggatagaggggaaaaggtggagaggcgaatgaagtgtgggaatcagtaaattttgttgaataaaggaatggctgcttactacttttcttaatggatagtttcatttctttcagttaacatggctacccattgcctttttaaaaatctgctgtgattactcaaatgaattagataagcagtagtgagtgcctaccatagcatttttacaggtctattgcaaaacaataatggaaactttctaagaaaattagttattagtgggattttttaggctgtcttcagaaatctgcattatcttaagtccataacctgaaaaaaacaatcacttgaatctcataattattcaacaagaatgtgaaagattatcacaccataaatacgatatattacttgcgacgcaactgaaaatactttgcaggacattgagttaatggatatttgttttctggttattcttacactactcaagcctactttttgcctaccttttccacattatgctttatttaatctgtctttaataggtcataagaattatatcagagattttgcattttaaaaggaacaagctctaagtttgattatgacaaatgtttgaaatgactcttcctgtacatacgtactcaagaagttttgttttgtttattgtggtaaataatgttaaatttgtcattttaaccattttttgtgtacaattcagtggcgttgaatacgttcacattattaggcaaccatcacgactgaagaatgttttttaatccttcctattgagaggtggtgtttctggtttcacggagatgtttttctctttcaaaaagaacaaccgcaaaatcccatgatcttgcagtcatatcagtaaagaaaatctgcccaaatcctatcaagtgatgttttaaagtggtattaaattagcaaagctattgtacgcttgttcatcaacacacacaaaaaagaacttgttggaaataacttttagaatgaacatgtccctttaaacaggaagatgctgttattttgtttctttttattttacctctgaaggaattttgtcagaagtccagctaacactctagactcgtggttgtaatgtatgggatatgccacactttgtgactcaccttttttttaatatatttttcaaatttgaataataatatccagactcaaacttatgttcctttgttcatttaattgagttcttgagatggtaataacacagcagagaagtttttaacctttatgtatgataaaacacataattaactcataatgttttatgaaaatataaagataaaactagctttcctctacaacatgagttcttcttacctgttgtcatagtaaccaggtaaacactactaaaaccaaatgggcatcaaaaaagtttttcatataaaaggtattgaaaatatttataggacctttaaaaaatagattatctgagtagaggaagaaaagactcaagtaatagaggagaagtagtcaaactttatttgcatatggaaagagagttgagggggtggaaatctgcgttgctgagaaaaagagttttcagagcagactgttctggtattttataccaattatgtgcagctattgctttgaataaattttgctgccctgctgagatttcctttttacaaatcctagagcaattataagatggaagtctggaatgtataaacaatgtcctttgaacagtaaatgagcctcattcttataaaactcaagggtaggaatgtactaccttttatcctatgtttctctgcctttccttcctccttaatcatagcacagaaattagggtctgcttcaagagtatataaaaacatgaattttgcctaaaaatacttttaaatgacaaattccatgaaattaacaaaatctctctgttgctacataatacctgtgtacttaatacatgttcaatacagcagttgattgaatattcctattctattctatttctagccttaacacaagaatctgtaatagattacttttttctatagacctggaaacaaaacactgcaccaagtcagtgtgcatggggaaaaagtgacaaccttagagcgcaacattaggctgagtttccaaatgccagcttgttttacgtgacagagcaatctgcactaatcaaggcaaacaatgtatacaatcctaaagagaagtcaactgtcacttagcgttaactgtaaaagcctgagctccattattctgccaaacttacagaccttatacaatgtttacaataaggtttggagagttgcctagcattggaatatatacaattaaacaacatagttgagtggcccttttatgtcagcactgctaaaagagcaccattatgtgtactcatgatagtcattcttggaactcttaacataaacaggaatagagaacattcatttgtaattctatctgagtacgtgtgggattttattttattttattcacataaacccccatggaaactaaagatagcaataataaaaggatcactgaatgagaattatttctgtgactgtcaaagaatgcaatacttatattgtttgcaactgagcttaagcactcaccttatttggacttttatttaagcttgtataaaaaagggagattgtatttaattacaaagtgaattttatttgtttgaaaataacactagaaattaatacaaaatgcatttcctgatttcctctttcagacattttcaaaaaatagcacatgcaaagaggcaacaatattatcgattaaaatgaaacaaaacacaagctaacttttaagttcacatcatattttgttaaagttagttaggctaattttatagttatagctcggccagaatgttttatccttcggtgttgttagcaacagtaaaagggaatgacacacaactgaagcaattttttttgaggaaaatagaaatatttaagagattgatttatagttctatcactcagaaatacaaatatatatatttttaatgtaggtattgggtttttattgaagttttctttctctgcctgtttcccagaaatgtttggctttgtaattctgagaaatagtttacatcaacaccagaataaaatatagttatgtcaactgacacaaaaatgcctgactcaaaacgaggaggaagatttgggctcaatttaggtcactgaagccagtgacgccagctgtttttgcttctgttttctagtctgttgtctgaaatttggaaatttgttaagcatgtttctagagagaggatttaactgcttcatacaagtttacctgttatttagcaaaacataaataactgtcagcccgataaatagatttacagcaggatacttgaatgattgagtgctagtgtacctcaaaatatcaaaacagttcctaaaatgtaatttttcaatgagaaatgaaatgtttgcctccctctaaccctggcctgaaacttgtagtttagagcccttaatacaaacaactttttgtcctttactttctcttagagtataaatcctcttcacttcttctaatacctagtggacttctacttataatcagaatgtatgaaaggttatatatatatatatatatatatatacaccaaaggatttcccaaacatgattttgtctctacttttggaaatgagggagggagtttcttggagtacaagttgtgagttgcgagagatcaaccagttgctccagatattctttaaacaacccagcattgtgattcacacatatttgtaatatgcttctctctccccaaaaatatgtatttcaaacattttcctctattcctaatttttccataagttgatgaataaatttagttatgactttataaacttaaaatatctcctttaaattaatatttttctagattagagactcctagttttaatatgtatacttacatagaaatgtctgtattccttgaatcattttagtaattctgcatttcattgttttcaaagggcaatcattacaacctcctagagtgaccaatttacacgcacttgaattttgtacatagaagcattatgttttcagttttatttccaataaatagtttttatttccctgcccagcatttattgcccttttgagttttggttcatattgggctcctgcctttcagaaactgtccaaaataactcccaaatggttccagttagaactggtggtttagtgggctaagtcttgcttatggatattgaagatcatctgtcacttttctgtcccacttttcccacagcttatccccatcagctcagtatgtcagtgcaatgaaagggtagggtgctatatgcagatttggagattttattgtggacagatgctttctaatactgtataaaaatgttgaaataaaaagacatgggtccgagagagaccattcttggaactgaaggcaagaattacaccatgttggtttcctgttacattttcttacattataacattcattgcacagatattcttaactaggcatatgggggattcataggttggtcataccccccccactctgagagcgagtacagtacagtctgatacaggaaatagaatatagtaaacagacattaacaatctaagatgagggccacggatggtatcaggagagagatctgcagaaaaactagagaaatagacctaatttctgtccaggaaagataaaaaatgttctatggatgaggcaacatccatcttgcatagctgtaggaatttcctggcaggtatagactatgatagaatttactataataaggaacattgttattaacaataacgatagtaatgatagtgattacaggtaacatttttaaatatttaccatgtgatgggcactgttctagaaaatttatatgtatgcaaatcactattgttaaaatataaaacatagataagtatgaacatattttatgttagagtaagtaataggaaaaaggaagaggacaacaaattgatgtggttgataaatagaataaatttaatttataaatgttatactttttcatataatcaggaaaatacctgtgtactgtgagaagtaaataatgttgttgttttctactgacaatcgaaaaactctataatacagataattaacatacgctaggaagtaaaaataaattgggtttatagaataatattggggagtgtgatgtggagctgttccaagcagaacaccagcttgcatttgtttttcttttacatctacacccacacaacagcctcatgggtttaaaaatatatctgtgcagttttactgtcttggctctggagtaccatactcaatgaaatcctagttaccagcataaggcttcagatgttgccagtacaggccagacattttttattaagaatcttctttatcattcctcctttcagaaatttctagcccctccctgattttcactgttgtgtctattcattacgaggtcaacttttcgtctcctttattttatttcagctttttgaaatctgttaacctctttccaacttacattccagaatgagtctgccctgtaattctatgttatctcatgacagctctttgggtacttccccagaatcatttctgcgttgatacgcttgtttgagagttagttacagaataccaataaagtcctgagaggaaacagaaggtctgggtagaaatgctgagggtagtgactccctgaagaaaagggtctgtggagaggtgggtaccaagatgggaaactagaaagcgttggatagtgattcttgcagagtgttagccaactgagaagaaattagaacccactaaagaaacaacacatttagagaatggttggaagctctcaaggccctgcagccccgagttgcagacaccttgtgtgggcggactccagggaagcctggagtcagggctgggtggcaacaagaaccaaagagatgagaaacagccccaggcgggaagctctgggtcctgtcctgcctctctgacaaagaggacaggacgctggtttgagttaaggttgaaaacgagggtaaactcagaaaagagattgcaagtgcaatgaaagaatgatttaatgtgtaaagatgagccagaccatgtggaatttgaaagggcacctatgatatgtctaatttgtatgtagtttatttcctaagattctctttgtgttttcttgtaaacagttaccaggacccaaatcagggatgagggtattccaagaaaagtacaaaggcatgaatccaagtggctctgtctttggaggggaaacctgtattcttttagatgatggtaacagaacatttcccaagaaatggcattagagactgtgttgaagggtcctctggggctgggttttggcatatgtatatataataattctaacacaggtagccctatccatgggtaaaggcaaaactaatgctaacaaataatattttctgtgagccatgatttagctaacccctgatacttcctttcatgcaagagtttgaatctctcttgaccaaaatatatgttcacttttcaaagttgaattaatggatacaaattactttaatgatgtcttacattgtagattttttaaaagccttcaagatgaagttacctcaaactttcctgccccaaatagaagttaataatatctacttaatctatacattttaaccaaatgatcaaatttacctgtcccacatactgtacataatactattagtttgagtgaaagctaatcaaagtaatcagaaaatagattgtatgttttttgttgaaattgaaggaatgaaaataagtttacttatattaaggctgacttttcatagataaacttccaatgctaggcagtaaaaacgcctactcaagattggagcagggtgcatttacctgtctaaccattttgtaactgtgccataaccatgttggcaaacagtccaaaactaaatcagatagaaacatgaatccatgttctcagagatattgttaatgagccacttgtgagcaggggtcgtgccttcaatttctttgaaacctttgttactcatgtagtggatacccactaataaatatttgttgagtgacccagacccatatatataatatcaccttattcttttaggaaaatggctactacatttctttaattctaatgcacacctttcctccccattctttaacatccctgaagttggggtgtgtcttacatttgatggcatgtttcagtgggtcatcagcctggattagagtcaagctcttcagaggagatttgtgtttgcttgtgatagccattcagggacactaccaatctgagactgcttgatattaaattacctgcttgaggttttcttgtaccacactggttgtgtggatgcagtaccagttggcagtttgcattctcagagatttttttttttcttcagctggtcccaagcttgagatatacatgtctacttgctgtttctttcagcatggcaagtttatttcttgttagcccttccctagaaaatgtgaccctttggtgtctcagttttctgtagcagtcttctgtcagactcttcattttggaacatttaaaaaatttattagtggtacatagactaatggtgtatcctactgttgatggcattttagacctgatgaaaacttgtttatgttgctatatatccagctgatccatgacatttgaaagcccagacaggttttgccttgttgactgccagtgggaccaaaaagcttattttgtatggaagatggttgtggtgctctcatacattgaaaattatgagtaagtctagatgaccatgtcttcacagtgttatttctgctaaacctctctgacgtttgggaaacaaacttggctgtagtttctttcgtcactgttccttgctgtgcataaggttcacttagagatggcactcaggcgataagactaggaatccaagtggtgtttaatcagaaatcctggttcttctccttggctctcactaaatgaactttcttctcctttgtggctaggctttcaccttgtacacttactggtcagctgcgttcattttgcattcctcacagcagttggtccgtgcccacctttttttttttttctttttacccccatatgatctgcaggaacgcccatctttttgttatcatgtgcagactagaatgtcctcctgacttatagtcttcactgggtaacattctatgcatttctctccttccatagtgttgctcactttcctaatgctctctccctggataattcgcatcttgtttgggaaaagagacaaggagaagacaattagttaacatttatttatttattgcctactattgtcaggcactttaagaaattattttatcaacaactgtagcaaataattattatcatcccattttacataagaggaggctggggttcacagaggtgaagcaactgcccaaggtcatatggcaggtaaggagttgagccaggatttgaaacctccgtcacacttcaaagtcactgttttcactccacctcactgcttcccttgaagcagagcttcacttagctttttgtttttgtttttctttatctccttttaggttcacttaagttacttatccacaataaagatcaaaactgtaaagaagtcaactaaaagcagatacagcaaacgatggcatcataggtgtgggttctggaacttgagatttgggctttaattttgttctgtttttgtttttgtgtgtgttgtgtacatgttggctttctgttactgtgttaacatttgagaaatgagtatttcagataaaaacaaaagctgaggacttcactgttccaattctcaaatttaaaaatcttaaaattagcctgacatctgcttggtgtctcattttcacatggatgtctaatttagagggttttttcctctttaactagagtttggcaaagcatcaattgaaagcaaacaatattttatatttatattttgttatattcagaggaatctctagaatatatcagtaccgtataatttattgaatacatttaatgccataaaagaatgattttaggagctttggtttttataggcatgattggcagaatatagaatctctagaatatatcagtaccatataatttattgaatacatttaatgtcataaaacaatgattttaggagctttggtttttataggtatgattggcagacataatgtaactcacttgagatggtaataaattgcaataaaagtacaataaaacacttaaaacactttgtgtgtatattccatatgatagtcatacatagatacattttaaaataataaacacttttctgataagtgttagaattatcatgacagggaggctgtgtggaagttagatgacattcttaactactatgtaaagattgaaattctagaaatgtgagagtgtgtgtgtgtgtgtgtgtgtgtatgtgtgtgtgtgtgtgtgtggtgtggggagggtgtagctctgccaaagcccctttgtacctggagttttgttgcctgtttcttgatcagacccaagcataggcttagatgatctgaatcagtttcgtaatctgatgagctctgctctgagctttggtaactgttgagaacactcaggagaaggccctagagagaagagaagattctgccccacagtcctccggcttggttcctgtgccaggcctgctttaatgattcaatgctggggttccttactcctgagattggttgtaacctggttagtgtctgaccttttcttacctgagtaagatctagagtacttctctgagagtaagagatacttaggtagcctgaaagcctgagggctgacatgtgatgaccaaaaaagcggtgcttcttttatcaaacaaaaaatctgaataaaaaatgtaggattgagttgggcaggagcaatgttagagttagccaacaatatcgagtactgtttgatttttttgttcagtatagttgttgatatttgttatgcaaagactattggtggctaccttagagataggatgaaccaaacacttaatcttgaatttctagagaattgcgtcataagatgttggaagtacaatcataatgactatgccaaatacaagttacaccacatcacatgcttttgtcattaatggtgacaggttggccaattaatctgtctctttggaaaaccttcaaagaaagattagcttatttgactttttgtcatggtgattatttgatgataactcactttggaacatcctcaagattcatttgcttagatgccctttaataaaaactcttgacaagaagataaagataaatattgaccattttatttatggaactacagtagcatactattctgtaaataagcacattgcaattattcttggacaatatcaaacctagtggaaatccttccttatggtgtacagaaacctacttacagaatatgacaggattcttaaataagaattagtccatttcatgtggttcttgcaagggcaagaatattttcttaactcttcacatcctaggattaatgacatgttcaatagatatttgtcaaatgcataagtaaatgggcaattgaatgaactcaagaaaatgtgtgacttttaaatggaaaatagtgaaagttacacaatatttaaaaagtaacttaatattcaaaaagctgctgaggacaatataaaagataccaatataaccacctgatagtgttaacagattacaatattgaccatatgctttacctccttttttctttttaataaaagaaaatattgcctgcctttcttcctcagaggcacctctcaccatgaatttcaagtctactcttaatatgcacacttttcctacatttttgtatgttaataaaaaatacgtacaactgtattttatgtttttaaatctacatttatgatgtcacaatctatgtatccttccgcagttttcttcatgcagcattgtttttgagaaatgtcttattttattcattttgttgcatagtagttttctgttttttaattatatcataatttgctgaactgtttactttttgatgatgtaagctgttgctggtttttccagttacagatatgtcatggtgcccatccctgtgtggatctctgtatgcatgtgtggtaaattctctgagacatgtgtctgcaagtggagtggggagtcgtggtgtggcatggtgtgtgtttcctgaaggggatgtcttgatttatccttccactggcatataggagagcactttgctccatacttcttttaaaaggctttggcatttagttagtaaaatagtgttttgtgtatgtgtgtttttttaagttcatcgtaggtggcttaactgcatttaatttcacaaaattcaaattccttttcataaccatagagaaagacagaccacataataaacaaaacacttgtgaatgaaaaaagagaacagccatggaatgaaataggagacataaagttaaattgcctttgttgctctccatcaaagctgctgttttgtttttttgagacggagtttcactcttgtcacccaggctggtgtgcaatggtgcaatctcagctcactgcaacctctgcctcctgggttcaagcgattctcctgcctcagcctcctgagtagttgggattataggcacctgccaccatgcccggctaatttctgtatttttagtagagatggggtttcaccatgttagccaggctggtctcgaactcctgacctcagatgatccacctgcctcgcaactcccaaagtgctgggattataggcctgagccaccgcgcccggccgcaaagttgctgttgaactcactgaagtgcgtctcattctgaaagggccggtggctcaccctcctgattacaatcctggttgaaaagactacatcattatcattttcagccctaaatacttagtcttgtatcagcctgaattgatgttttttgagaggcatgttataaaatgaaagtagatatctactgaaaggttctggatttaatagcttaagtgagtaagaatcagctttcacagttattggattaaccatcctgaccactctgaacatctttttgaacctcttttttctagaacaggttatcatttcttttatgtgaaaactacttttggcagaaatgaaacctggttttgtcagaagggtaagaaaaagcatctggctaattttatggataacattttttttttctttcttctcttgacagcgggttccattttcttctcagttctgcaggaagagcccatttccttgctatgattttcctttcatgtatactgtaaataacaaatgttagactgccttctaacttcccatctcttccattctttttggggtttcattctttaactgaaatgtctatctaagtttagaaatgattttggctggccaggtgctgtggctcacgcctgtaatcccagcactttgggggaccgaggcgggtggatcacctgaggtcaggagttcgagaccagctggccaacatggtaaaaccccatctctgctaaaaatacaaaaattagctgggcatgggggtgcccagctactcgggaggctgaggcaggagaatcgcttgaacccgagaggcagaggttgcagtgagccgagattgcgctattgcactcctgcctgggtgacaagagtgaaactccatctcaaaaaaaagaaagaaatgactatggctaatatgatgttccatatcttttgcttaaagtttctattcctcttgccaaatattcttcttgttcagagtattatttctacttacccagtactagaatctcaaaaaccgcctaggtttaaagtcttccacccagataccactcactgtgctttttcaacaaaatagcaccttttcttctttcttcacctccttccttttctgccctaatttgactggtgtcatatgttaacattaaaggcctgctcagggctgctacctagaaatcttgggcaaaaggcataagacagagcagagggcaggcattgtgtccttatactaagcatggtcaaatgcttgagtgtccacttgccagttatttgtgataaatagcacaaaacagattggtttttctcacaaggcaacaggttgtcaggtcacttgaataccctcgccctggtgaatctgatgcacatccaagtttggggcccgttgagctaagcaaaggagaacttggaaaggaaattggtgaagagcctgtgaggcatccactagctgaaaacaatagtaataactcttgtgctgtctgttgttcagggctatctgctctgccacttgccttccattatcatagaaaactgaatattgattgaaattattaaatcaagaagatggcaataatgattctactcgacagtctgcaagcctgagggattgttttacaacgaagcaaatggccacttcaatggctaatgcctaaaagaaaataaccagcaagtccaagggcaacgaaactctctctccttgctatgatctcctattattttctactggaaatgtgtatttgtgaagaatttctgaattgttagctgtaggcaaatacttgtgtgagccaaatggagtacagagcagtgaaagtggaggttataacgcaaagaggaaggcagcggtgagtggcagtgatgggtgtgagcccagctggggtatcttctgcagcctttgcaggcctgcacacatgcttggcctatagcgctcccgaagctggaccagccaaccgcagctttccttccagaggtgatgaaggtgcaggctcttgccctcagtgactgttgcgctgactttacaaaaatgaaatgaaagggacaggaagtcattcctgtccctccacttactggaattaaagtgaagaacttcaggcaaggccacggccaccctgcctctcactcagatgcttgaaatgccaccattttctccttattcttttcatcagagaattattattgattttttcaaaagagcatattttttctttctttctttcttttctctttctctctttctttctctccctctctctctctctctctttctttcgagatggagtcttgctctgttgcccaggctgaagtgcattggatcaatcatagctcactgcagccttgaactcctgagctcaagtgatccttccacctcagtccctttgttgctgggaccacaggcatgcaacaccatacctggataatttttttaagagatggggtcttgctgtgtgcccagactggtctcaaactaccggctttaagtgatcctccagccttggcctcccaaagtattgggattacaggcgtgagccaccttacccagcaagaacaccttttctaggagggataatattaagttttattgctcatttaactcttattattgtagactagatgaaggacggagatgacaagaggatgctgtatgtcttacaagatcataggaaaagggaggttgagggcacggatgtttctcacagagcttagggactggggagaaaacacacatcctttcttctacctcgccattcaatatggttatattagtgaaaccagaataagatatatcagtgaaatcagaataagatatattagtgaaatcagaataagttgactcaagggcatcattaaaaagaagcaaaacagccagagaggaaattgcggaaaagcaacaggttgtccaatggcctgtgttagaaaaggaagcaggcactgttgtgtagtggcagagccaggactcccttcccctggtaactagctagctgataacctgtggtcacaccccactgacctgtggtcatatcacagttgtcctgcgtgaccttacgtgagactgctagtctctctgaaccacagtgtccttatctgcaaaactggggaaacgatgctgactttgcagagctgttgccaggattaaatatattgtcatctgcaaagcccctggattgaggtgtgtgtgtgatatgtgttgattcccttacctcatggtgacatgctgagtggtgaaggcacccaggctgctcaccacctgcttctcctcctgttcctctgacttggtgcctttcagagtcattgaatgccctcaactccctattccccacaaaaagcaaaaagcagatgcctcttcaaagttatgaccagaatcagggcattcaccttgattgccttgctttgggtaaggacaaccactgggggaggagtggagccatcacctgcttcagggagcatctgccttctgtgggcccagaggttagttttaacttatctacaaggttaatggattgaattgtgtgttagattgtaattaagaattttccccaattaatgatgctggtgtaggaaaagtcataaatcctcccctggctcagcaggcttaggcttgaagttaagtggtgtttagaggaagttcctgtgttcctaatatatacttttgtgcacattggtttcaatcaatattgatgaactgatctcttagaaagaagataggtgcattagaccttagatcatctatttagtaaatcagtggctatgcttggagtattagtgtcaggccctattgtgaaacattactttctaagtaatggaaaagtggagtaaattatttattgagaactttggtcataaaatacctcctggtcactggaggcaataagattaaccatgtaacatgtgaaataatacatgattttggtcaacagttaataatgataaatgtggaggagaaagaggaaaacgttttttaaataggtcagaaacacaatgcttatgttggtttatacttctgcttgaaattttaaaagattaacatgtgtatcactttcagttatttgaaatatgctgttaagaattaaggatttaaaagtttccccaaaatatatttaatcttttaagaatttgcgctattaaaaagatcatggaggatcaagtaaaagcattttaaatgtaaatcttagaagcagaaagaatgatagtactttgtgtggtgtcctgtttatttttctaacatgaaattaaatgtcacgtactcgggaagccacccagtgttttctctaaatagtagatacttatgggaagtaggaataaatatgccagtgctagaaatgagacaaataaagcatgaatttacatgaatgaaaaccatctattaacgggattatttggaacataaatagagaccgaccctaacccaaacaatctcaaaacaattgcatcacaaaaaatgattagactgtatgatgggtattaggtcttttctccaaaacagtatcctcaaggtgctgcctgaactaaggaactatttgagctcatgcgatttttgcttgagcacttctgatttgtggctacagaaaagtcaaagcagcacataagggctgtgtgcatctaaagtgaatgcagtgtaagggcccgccccatccagtaagccatttctccataactgtgcatatagtttacattattggccttcatgtttaaaaagttactttggagattttttttttttttttgagacagagtttgttcctgttacccaagctggagtgcaatggcacgatctcggctcactgcaacttctgcctcccgagttcaagtgattctcctgcctcagcctctggagtaactgcgattattggcatgcgccaccacgcccagttcatttttgtatcattagtagacatgggattttaccatgttgcccaggctggtttcaagcccctgaccccaggtgatccacccgccttggcctcccaaagtgctgggattacaggtgtgagccaccgtgcccggcctggcaatttcttttagttagtgttttctgacatccaggaaaccaagatgtgaccaacaatttttactacagatctgaggaagttttgtggagtgtggttgccatgtgaagacctctctatcctgtgtaaagatttaagtaactttaaatatgagtgaattgggaagaaaatgctttcaaatgtaatttgacattgaaaatagtttccgtggcaagtttctggatctgtttttttagatattgacagttttaggccagatgccatggctggtgcctgtaatcccggcactttgggaagcccagacaggaggatcacttgaggccaggagttcaagaccagcctgggcaacaaagtgagattctatctctatgaaaaataaaaatattagctgggtgtgctggcaaggacctgtggacccagctactcaggaggctggggtgggaggatcacttttgcccaggaggttgaggctgcagtgagcaatgatcacaccactcggccagggtgacacagtgagacactgtctcaaaacaacaacaacaacaacaacaacaacaacaaacaaaccaataaccccaaaaataaattttaaaaatgagtcagagaaacctttattttttgcatatttgttttgccctcacgcaataatctgcctcaaaagtagtgagctgcacccgagaatgccaggaaatcaccgagaaagtcacacgatgtgtgaaagtgcgactttcaagctggcacctgttagtgcataggcagccctccccagctgatcacatattgtatgttgcctatttagcaatctctggtctgtgctctgaatccttatcaaattgtaagatcatctttcatggtggtatcatttcaatatgaatctgtaatattatccaatacttgccatacagcaaatacataaagcaaattgtagctatttcttgaagccattagttctgcaagaaatggttgtgtttcctttctcccacaccatttatggcagtgaaacatgaatcagaaagaccatgttcaaatctcagctctgctacttaccagctgtgagagcctcagtttactcctttcaaaatgaggataccgcgcggtggctcacgcctgtaatcccagcactttgggaggctgaggcaggcagatcacctgaggtcgggagttagagaccagcctgaccaacatggagaaaccctgtctctactaaaaatacaaaattagctgggcgtggtggtgcattcccgtaattccagctactcgggagcctgaggcaggataatcacttgaacccaggagggggaggttgcagtgaactgagatcgcaccactgcactccagcctgggcgacagagcaagactccatctcaaaaataaataaataaataaattaattaaataaataaaaataaaataaacataataaataataaataaaataaaatgaggatactactgctaattcacaggcctgtcaatcttttcagcctctaataagatatacaaagtccctcatatctggctagctgaagtttattagaaaagaagtgccaggttttttgttgttgtttgtttgatttggcacactatctctactatcactgttgataaaatagcccacagagaacaagtacaggtcaaagtagactttgtgaaaaatgtattgaattgaactgattggaattcagccggcagtgggtggctcaaggggaggctggagaagaagccaaattggaagaaggggaggtcacattgctgctggagagtggatcacttggcagtgagggaacagacagtcaaaatataagaaataggaacagctcaggagagcattcagcttccatgtggtgaaggaacaaatcatccttacatatcttagcagcttggaggctgttttacagtagagcatgatagctaatgtttaaattatgctcagtctactgtgaattattaagggaactttaaattatgctcaaggtattgtgtttagaagagaaggaaaatttacaatatggcttagaaaactttccattagaaggagtaaggtaacaatctatactgtattttatttaagccttaattatctagattaaaaataataaaaaaacttccctagaattcctttgcaaaagtgccagatgacttcacgtacaccttttagcttcctgacattggattgaacagcaatttcctcatctttccagtggaaagaaaaagacgactcaccctatagctggtaagaggtttaaatcagacaaaccatagaaagcacttagcacagtacctaacatgtagtgtgtgctaaatacattaggttctattattggtggtggtattatcaatgttacaactactattttacctttttaagtttgtttgttttttcctgaaattattagttccactcttttcacattgcctgtaggtccttgctctctgctcccctgtttgatctgtatttctttttctttcactgattttccaaatattgcttttatcatggataaatcactgcccataaaaagcttgggaatgggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaagcttgggaatggagtttatattacattgtatgtgatggttataattttctctcccttctctttctttccttggcttggatattcctttggtgtcctctccaggcaggttcacaattttcctcccaagcagtaaatagtatccatgcagcatgactgcttgccagccacagttaataaactgaagtgtgcaagtgtgttcctgttcatttttgttcagtctgcaattatatttatcttcttctttcttctcaccctttctagttgtaacatttctcttggtttaacaaaatgtcacaagcacattctaaaaaatgatactgcatggtatctactttttctgacataattgtaacttgagcacatttgttcgcaacagagaggagtgtgacatttctaaacaaacaaaaataacagcctgtaccatgtcttatattgccatttataaagcatcagctcaggtagaaaaggccaggttttcaactgaagtaaaaatgaaaaaattgagtttcaattgacatcagataccggtctttttcttgaaaagaggctttaaactttttggaatgatagttctgattaaacatttaatggcatgtataatgtggcattctaggaaccaggatctgcattgtaactttgtgtacctgaagtatacgattcagagaaagagagacagctacagaggtggtttgaatttaacttttaagaatgatcagagacaaatatttgactgaatataatgtttactgatggatgttcaaataattattatactaagtatactgaaaaatcaaataaatggagaacttttccatctcactagtaattctacctaaaagaaatttcaattgctcatttcatggtgatatttgaaaaacattaatctgatcctgtcactgtcccagccccacccccactacctaaaacccttagtgacttactggtgcctttacaagaaagtgcagactctttcacaggaccagctccttagaggagttctaggttggctcgccactcctcttcttcactgggttccaggcatgctggccttcacttccttacacacgcccagatccttcctgcctcaggacctcccagtatattccccttcttttgggacactctttctcacattctttacatggttaattcctcctccactttcactttgcattgttccagttgcttccttagagaggcacttcctggtaccccaggacctcaaagttgccatccttcatggtctcctgttctttctttatatggcacctactgcattttataactatgcatttatttgtgtgtttctttagtatctttagcatcttattcacaactgtgtacctagcacaaatagtaagcagtcagtaactgtgtgctaacttggtaaatactcatgtaacattgcatgaaaagagtaaataattgaaatggtgtgttgtccttgcatcctttctatgtctagtttaaacagtctacctctcatgaggtttcctcaaagaaaccattatatgattatcttaatttgaacagtaacaacacagacatttattgagatatgatctggatgtagcaacaaaggtaaagtagatatggcttctactttgatagaactcagtataagcaggagataaacatagaggtcattacaagggcttgtgtttgggggtgaggtggagagaatagaagaaacgttcatagaggagatgacattgaaacttagtgggttgggaaggaggagtgaattttgttagctggagaaggctggaaagccactcttagcataaaaactatcatgaactaaggtagaggggcaccaaagtatatactggattcaggaaattggtgagaagttctgtgtggctgagggtgcttgtgaagaagggtgggtaaggagaagagtggtaggagatgacacgagaaagatagactggatgtaggttctgggtcatttgggtgattttcctgaggagcttgggtgttattttgtaggccatgaaatgtttgaagcatgggaatgagagagcagatctgtgtttgagaaacatgatgctggagtggtggcaatgcattgttgagtgagggggaagtgacataagagggcaatgaatacaagtcaaatttggcagaagttaggttgttatggggagagaaagaatgaagggatcacttttaaaattctttttttaaattatgaaagtaatgcatgcttacagggataatttggaaaatgcagaaaattataaaaaagaaaagaacgatcataatatggtatgtggaaagaaaagcagagtcaaggggaaatgcttttacgatggtaaggatgacaggggaaacttttggaaaggatccagaaggatcctcccttttagagatctctagtttatttcttttttacaggccttaattttgtccatctggaagcaccacaaccttttggatctccagggttttgcacatatttttttttttctctctggactagttcctcctgctattcccttctctcccttttgcctggcaaacttttattccttattcaggccaatagtaatagtaataataagcatcatcatcatcatcatcatcatcataacagtagttacagaaacacacaacaatcacctatccagtgcttgtccctgtggttagtgctttgttaatccttacgtgagtcctgtaaggtaagcactactattaccccatcctacagatgaagatactaaggcattacaaggttaagtgacttgagcaaatgtaaatatcacaacttatcacttccctcaccaagtctggagtccctgtaatgtgatctcataagctcctaatttctcctgggagacttttatcatactcgtacttgtttgatgaatgccagttttctctgctggactgtaagccctgtgagagcaggtagtacgtctgtcttgttctctgctataccctccagtgcttagctttgtgattacgtggtacaagcacttgacactgttgattaccattctcgtaataaggtcattctaagcctgttgcactgacctgtaaaagtgcacaccttggaagagaatacagttggccttccatatctgcaggttctgcatccatggattgaacaaccacagattgaaaatatttttaaaaataaacaatgaataacaatacaacaacaaaaaatatagtataaccactatttacatagcatttatgttgtattatgtgttattaatataagtaattaagagatcatttaaatatacagggggatgtccctaggttatatgcaaatactttgtcattttatataaggaacttaagcatctggggattttggtgtcttctgggggtcctggaacccatctcccatggatgaggaatgactgtacttattagctcaccatgatagccctgggacctttagatgaggactttgggatttcctgggagctcagaggcctccatatcaatctgtatctttttttttccatctcctctaagttccagtaattccatagagccttctcataactgatctgattttctaggcctcaaactagatcacatccccatggagatccagatgacaaggactctagtcctgccatgattgatacttaaattctttgtacagcctctttaaggggttcaagtttgcttttattcaggttttatttggttttcattagatagataaaacctaaatataagattttataatttgaaaaaaaacttagatggaaataataaaaggatgattttttaagatactgctgcattggccaggcgcggtgcctcatgcctgtaatcccaacactttaggaggccgaggagggtagattacctgaggtcaggagttcaagaccagcctggccaacatggtgaaaacaccatctgtactaaaaatacaaaatttagccgggagtggtggcgcacacctgtaatcccagctactcgggtggctgaggcaggagaattgcttgagcccaggagatggaggttgcagtgagccgagattgcaccactgcactccagcctgactgacagagcaagactctgtcaaaaaaataataataataataataaaaacagtgctgcattaaacgttttatttctatattttgtctggtgcattgggtttaagtagatttgaaaattactaataacacactaaggttattttactaccaaaatgataaattattgatgtttacattttaatccaaatatagattatacttgtacattgtaaaggaaatactttttttggattagttttgtacctgttgcttctttatttcatttatcaaaggagataaaaactatgaaggcactggaaggtgaacactcatcagggttaatcacggatattttgaacaaaacaaccaacacccaaagagcaaacattggtttaacacaagcagataaatttagagatcctgagtgtttctttgacaattaatacaaaacatcaagacaataaacatgttatgatattttctctagtttttatttatttatttttttttttctgaagcatggtcttgctctgtcacccaggctggaatacagtggtgctcatcacagctcactgcagcctcaaactcctgggctcaagggatcctcccacttcagcctcccaactagctgggacaacaggcatgcagcactatatctgactgatttttatagttttttgtagagatggggtctcactatgttgccctcgcctcaagtgatcctcctgccttggcctcccaaagtgctgggattacagacgtgagccactgcacctgtcctttttctagttttagatacttgagtttgttgttgttgttgtttttcttaataaaaatcagtcacagtattaagtaaggtatttaagtcaggtcaacacaagtttcaaaatattggcttgggagctacttcagtctgtatctttatcttcctgtttaattatagactggaaaaggaagacagcatttcctgcttttacagtttcctaatgatgatatctcagcttgtaatgatttaatccaaaggaagaaggcattctatctacatctacaaaacaaaccaccactattacaaactgggttaatgttttttgtttttttttttttttcattttttattttttattttttttgagatggaatttcacttttgttgcccagcctggagtgcaatggtgcaatcttggctcactgcagcctccgccctctgggttcaagcgattttcctgcctcagcctcccaagtagctgggattacaggcacctttcatcacgcccggctaattttttgtatttagtagagatggggtttcaccatgttggtcaagctggtcttgaattcctgacctcaggtgatccacccacctctgcctcccaaatgctgggattacaggtgtgagccacagcacctggccaatgggtgcaaggttagtacctgcgtacagcactgtgaagattgcatgaagtgattcccatagagtgcttagcacccctcgtagattccacaaaaagagtgtttcctctgtgcctggtatacagcaggtggcagttgtcattcaggatggcagcaagtgctggtatggttggtgtggtcagcagggtgaagggtgtatgctgcagagtggagggggtgagaaaggaatctgcaaaagaaggagggtgggcttgaggtggggcttgtttgtaagtcatactgagggcagcagggagtcctgtggcctcatcaggttggagatgtatagagctgaaaatgagaaatgagctttggtgaaggggagagccacatttagcaccaagcagggcaggtattctttccattcatcccccattttttaatttttttttagtatttattgatcgttcttgggtgtttctcagagagggggatttggcagggtcacaggacaatagtggaggggaggtcagcagataaacatgggaacaagggtctctggttttcctaggcagaggaccctagggccttccgcagtgtttgtgtccctgggtacttgagatgagggagtggtgatgactcttaaggagcatgctgccttcaagcatctgtttaacaaagcacatcttgcaccgcccttaatccgtttaaccctgagtggacacagcacatgtttcagagagcacggggttgggggtaaggttatagattaacagcatcccaaggcagaagaatttttcttagtacagaacaaaatggagtctcccatgtctacttctttctacacagacacagtaacaatctgatctctctttcttttccccacatttcccccttttctattcgacaaaaacgccatcgtcatcatggcccattctcaatgagctgttgggtacacctcccagatggggtggcggccgggcagaggggctcctcacttcccagacggggcggctgggcagaggcgccccccacctccctcccagatggggcggctggcctggcgggggctgccccccacctccctcctggacggtgcggctgcccggcggagacgctcctcacttcccagtgggggcggctgccgggcggaggggctcctcacttcccagacggggcggctgccgggcggaggggctcctcacttcccagacggggcagctgccgggcggaggggctcctcacttctcagacagggtggccgggcagacacactcctcacctcccagacagggtggcggtcgggcagagacactcctcagttcccagacgggatggcgaccgggcagaggcactcctcacatcccagatggggtggcggggcagaggcgctccccacatctcagacgatgggcggccaggcagagacgctcctcacttcctagacaggatggcggccgggaagaggcgctcctcacttcccagactgggtggctgggcagaggggctcctcacatcccagacgatgggcggccaggcagagacgctcctcacttcccagacgggttggcggccgggcagaggctgcaatctcggcactttgggaggccaaggcaggcggctgggaggtggaggtcgtagcgagccgagatcacgccactgcactccagcctgggcaacatcgagcactgagtgagcgagactctgtctgcaatcctggcacctcgggaggccgaggcaggcagattactcgcggtcaggagctggagaccagcccggccaacacggggaaaccccgtctccatcaaaaaatgcaaaaaccagtcaggcgtggctgcgcgcgcctgcaatcccaggcactctgcaggctgaggcaggagaattaggcagggaggttgcagtgagccgagatggcggcagtacagtccagcctccgctcggcatcagagggagaccgtgcaaagagggagacgggagagggggagggggagggggagggggagttaatggttttcaaatccccaagtagtcaggtgatttctaccatttcactttatttaaaaatgaatacaactttctaaaaaaattattagactaaaatatattagagctgatattatggaaagaatataagaatagacaatattataaaaggatataaagataattgttataagccagtaaaaactgtttgacagcattttatggctggtcctgttatcagattttgttacttttggcatgaaaattaaagttaacatagcctatgatctgattagcctatttataacaatatttttcagtgttttacatttattcgttcaaccgtttttaagagtgctgagtgctaaggattcagtgatgagtaagactcagatcagagtcttggggaaaggagatggctgcatcttccccatggttatcaagggcatcatccaattctgtgtaagagctactgtagcatctcttgacccccagcactcagaagagcatgctgcagtatctcttgatctttggattttcaagtaccattttagcaatctagttaggaattgcagaaagaatagacaaagactcattcatgctgtctcaactataaatggacatttgtagcaggaatgtcctgcactatattctagcagtataaaaatgaaggccacattgctggcctccaggaacttacagttcagctggggaaagaaacaagtaaatatgcagaatttcaccacccagtggagcagtgcttttatccttttataagtatccttttctaatactgtatattcttgtatcattttaaaaataccagttctagtaatatcagtaagcatagactttcacgaagaacaaaatagaattatgaatttagcaaccctgtttcattttcttcctgcagctccatttcttagcttctttgcagtaagtttggaggcctgtgattgagttgtggtaagtggaatgtgggcagaaggaacatatactacatcttggcctgggcataaaatctcctatacaagccttcatgatctttcttcactttctgagatgaccttggaggtcaggtgtagaaggtggccacattctcggaccttgaaggatggccatgtgtagctcactcgcccacctagaaatactatccctgcccctggactattgaactggaatataaatgagaagtaaactttcactgtgtccttaagatttgaaggttatttcgtaagtacttcgtctatactgattaacacattctactttgcattctcaggctgcctgcctggagtaagcattagttacatgaagaaggggtgcaaggtggtgttggtggagaacaacatgaggtggcaagaaagcttggaactttcaggcgccaatcagtagtctggtgtggccagggtgcagcggcagtagagggcagtattcatgacaagaatggagagaaaagtcaaggcaagcatgtggaacgttttgtgggatgggagaggaaagccctgtcaaccggaggggacagcagtccgaggaatggggagtaaaatggggtggacaaacaacaaagaaaaggtgctagctggtatctggtaattagtttaaaacagaaataatttcttataatagagataagttttgatagtggacatgtccactgggttctctcacatacacggtttccaaaggtatatatcttagacccttccattgatattgatgtgtccatggatgtgaacagagcatgagaaaagtgaagatgctgagaacgctttggcctaagaggaaagaaagaccataatctctaccttcaagtgtcagaaaggatcgcaagtaaaagaggtgtcctacttgactaagtgacccctaagggtgagttagaacaaacaggtagaagtgtagggagacagatatgggctcagcataaggaagagctttgtcataattgcctgaagagcaatcggccaatcctggagaagatggcaatgagtttatgaacaggatgagttcaaatagactggttcttaacatggagggactgtcatagacagggttcaagtattggatgaggctgggactaggtaacttttggagcctctgcttatagtctcatattctttgatacttgtctgaaatgtaaaactttttgaaggtaggtgttatttaaactctgatttcaatgtgagggaaacgttatgataatgatataaggttgaaaaactttcaaagaaagaaaactattcttgcccagatgtctttacctggagttaaccacttgacacttaatacattttttttttttggagctgatggatatgcatttaatccagttaacatagccagatgggccttgcagtgatatcactgaacagtatctccaagagaatgtcagacctcagcaacaaggcagtggggtgaatgaaaaggcagatactatcttcctctgagatactgggagaagaaactttcccttaactcccttatttataaaaaccagatagcttagttgttcctctgaaactgtcagaatttctctcatcaccgcctctgaactgatggatggggattggtcttgcttactaaatgtgcattgtagcaagacacaactttatttaaaataccattaagatgcaagcacattgtggctactctgaaggccttcacttacaacatgaattattcaaatagcttcttaataactgtattgatttccacagttaaaagcagatcagattatggaatctgctcaataccacttaaatgtttatagatgttagagttgacaaagaccttttagacactgataattcctttcactgatcagaatgctagagatttggcattgctagtaatgctttgtgattatttttaataaatcaggaacactgtaacagcaatcatttaaggtcttcattcttattccattttagtcccagagtctttgcctgaaaatctagttatgctaaaaatctgaccagaaacttttacatttatattgatcagaagcttttatgtttcttttgcaaagatcaatgtagtaaacatgtcttaacctgcatgtattgatgtgaatattaaaaaatatctatgaatatttataatgataaaatccaataaggtttcagtttctcagttgcttttagtaccctgtgaaaaggtaaaagggggcaagtgtactagtatgagaagaaattataggtggagtaaaaattagatcttttattctttctgattctccccttatttggaagtctctgggaagggaaatttccagagtggattgattagtctgctcgggctgccataacaagataccatagactgggtggtttaaacagcagaaatttgttttttcacagttctggaggatgggagtccaagatcggggtgccagcatggtcaggttctagtgagggctcttcctggcttgccaagggtgtctccttgctgtgtgcgcatgtgtccttccttagtgcatatgtgtttggtgctggggttgggggatctcttcctctctcttcctcttcttgtaaggccaccagacctgtaggattagggccccagccttttgacctcatttaactttaattacctcctacagcccctgtctccaaatacagtcatagtaggagtaaggtcttcaacatagccatttttgggagacacagttcagtgcacagcacaaaggcagtgggttctggagtcagactgcctgagtttgaatgtaatccggggcaagttgccctttttgtttctcggttttctgtaaactgagaatagcgatagtaatttcacagctttatcatgttgaataaatgagttgagtaagacacgcaaagtacacagaacagtatatggcatttataaagtgctcaataaaagttagttattattaataaatatgtaactagatatttgtgcttttagctgagacttttatgattttatgtatgtggtttccacgtactttatgtttacatatcaaatgatttttggcatcaggattcagagtatgctttgaaaaatttctccatgaatcttgatagatgcttaaatataagggaatagagtgtgttttattttatacaatgtattttataatatttgtaaagaagttgttccattttcccacttaactcttatacgcacacacacacactggttttctacctgtacaataaaaaacagaatgttgttgtagaccttattactgtggaaatcaaagtacttcattcataacaagaaatccagcaatctttggactcttcctaaagagagtttggggtcaaagatatccccattgagttagtatctgggaaagctaagtagagagcagttgacatcttaccagaaactctacaagtagagtttctgcaagtacagaagtacagaagtacaagtactacaagtacagaaactctacaagtaaagtagagtggcctaattcattgaccaatattctatttcttgtgttaatggaatttgaattaaaatgtgacagaaagcacactgtgctaggccattcttgcattgctataaagaaatatctgaggctgggtaatttatgcagaaaagaggtttgattggttcacagttctgcagactgtacaggaagcatggcatcggcatctgcttagcttctggggaggccttagggagctttgactcgtgacagaaggcaaagccagagcaggcacttcacatggcgaaagcaggaaccagagagagagtgggggtggggggaggtgccacacacttttaaatgaccagatctcggtgtgaactcagatcaagagctcactcatcaccaggagatggcccaggctattcaagagggatccacccccacgatccaaacacctcccatcaggctgcatcgccaacattggagatcacatttcaacatgagatttgggtggggacaaatattcagactatagcacatgcttaactgattttcaaatctttcatgattgtcattatactatgaggctgtcttcagttcttctgggctgcttctaagtccagaggaggggctgtgctctctttctgtgtaagtcaaggtttttttttttgtttttttttttgttttcttaagacaaggtctcactgtcacgcaggctggagttcagtggcgcaatctcggctcactgcaacctccgcctcctgggttccagcaattcttctgcctcagcctcccaagtagttgggattacaggtgcccgccaccacacccggctaatttttgtatttttaattaagatgggatttaaccatgttggccaggctagtctcgaactcctgacctcaagtgatccacccgcctctgcctcccaaagtgctgagattacaggcgtgagccaccgcgcccagcctcaaggtcattttaatttggcaggcagggtttaaaaagaaacaagaaggagaaaaaaagaaagaaactgcccatgagttcccttagtgccctttctagcaggcggttgttccttcctgccttctgctgcctgcgttgggcctcctgttgcctctctattccatttcaagtacaggaacaagtcgtggatattttacacttagaaacatttcattctaaatagttgtacttatgagtcaaattataagactttcactaaaattagaacctaagagtctttttatatctgagctcctgctttaaaaaaatcaaagtgaaatatttatataacgcaaagtctctagctgctgtaggatgtgcagtttaaatgatctatccttgtaatacttctcagtattgggatggctagttctactagaatgttgaatgcagcagaaaataaaatcagcatggcgtgggcatgtacaacttacatgtaaactaaggtgtttaaattagatttcaaatacactggatactactatttcccaaactatgggcaaatgtagtactaagaagcagtctctctgggaaaaaaatgaaattttatacctatttctatactaaaaatttaatttgaattgagttataaacccgaatataaacttggaactgtaaatcttctggaagaagacatggaagtgtcattgtgatctcagagtaggcaaagcttttttgcacatgacataaaaagcacagatcataaacaaaaaattgataaatcggacattatcaaaattaaacatttctgcttaccaacatatactatctttaagaaactgaatagacaggttccaacttggaaaatgttcatagcatatatatctgacaaagtatttggatctggaatacataaaggatttctacaaatctaccataaaaagacaaacaatccaattaaatacttgaaaaggcactgcacaaaagaagatatatgaatggctagtaaccttgaaaaaggtgcttcacatcattagatatcagggaaaatgcaaattatagccataattcgaggccatttcacattcactagaatagataacataaaaaagacggccaacacctactgttagggaggatgtatagcacttggtattcttaatcatagtggaaatgtaaagtggtctaactatgttagagaactgttcagcagtttcttataaagttttcgtctcactctgttgcctaggctggagtgcagtggtgtgagcatagctcactgcagcctcaaatcttgggctcaagagatcttcctgccatagcctccctagtagctgcaactacaggcacatgccactatacccagataattttttaaattttttatagagatgcagtcttgccatgttccccaggttggtcttgaactcctggcctcaagcagtgctcctgccttggcctcccaaagtgctgagattacaggtgtgagtcactgtgcccggcctcttaaaagttaaacatacgtttaatacatttacctggtatgacccagaaataccacccttaggtatttaccaacaagaaataaaaacataggttcacaaaaaagacttacataaagatgttttagcagccttatttttaaagccccaaactggaaacaatccaaatgtccattaacaggagaatgggtaaacaaattatcttaaaatgtcatactacttagcaataaaaaaagaacaagcaactgattcaggcaacaatattgatgactctcaaaaacactccaagtgaaagaagccagttgcaaaaaaacgactttatcctgtgatttcatctacatgaaatccagatactggcaaaactcctctatgatgacagacatcagacagtggttggagagggagttgacaggaaagggacatgagggaacactcgtggaagggaatgtctcatgtcttgttttcagtggtggttacacaactgtatacaattgtcaaaactcatgaactgaacacttaagatctatgtattttattctgttaattatatctcaatttttttaaaaagcaaaacaatctaccttcccctgctaaaatgattacacactgatgaataatccaagatggaaacctagaggatgtgagaagatgttgtaagtgagatttcttgggagaaggtgatagctgcctccaatgtgcacaaatacgtctgtgctataagaatccctagaaagaatgttacagagagtgacctcgagtcaacaacctactaaggaaatggaaatggaaagtactgtatatttccacttctgtgccagcagatctagggacatcaccggagaggccattttagagtgactagattttggtgagggtgggggagagatggggacaggctttgctagcagtaaatatggcgaccctcatgcctcatccagtggagaaggtggtacatggagatccttcctggggtatttgaggtgttcttcagcttgggagtcaaacgatggatgaaagatcagttggtaagtgtatgctgaaggtggagctgaggtggaagcatcatcaagtcagggatgctggattcgttttaggtgtcagaattgttcttgtgcattgtttcttgaggccagggatgttgggtcctgcctcagataggagatgaagttcatgtggtcaggcttcctaatggagaaggataaatcctttatgttcacaattataagaaagtattgagaacccaggaggcagagcttgcagtgagccgagatcacgccactgcactctagcctgggcaacagagactctgtctcagggaaaaaaagaaaaaagccctctcccctctcccctctcccctctcccctctcccctctccacggtctccctctccctctctttccacggtctccctctgatgccgagccgaagctggacggtactgctgccatctcggctcactgcaacctccctgcctgattctcctgcctcagcttgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccaaggtgctgggattgcagacggagtctcgttcactcagtgctcagtggtgcccaggctggagtgcagtggcatgatctcggcttgctacaacctccacctcccagcagcctgccttggcctcccaaagtgccgagattgcagcctctgcccggccgccaccccgtccgggaagtgaggagcgtctccgcctggccgcccatcgtctgggatgtgaggagcccctctgcctggctgcccagtctggaaagtgaggagcgtctctgcccggccgccatcccatctaggaagtgaggagcgcctcctcccggccgccatcacatctgggaagtgaggagcgtctctgcccggctgcccatcgtctgagatgtggggagcacctctgccctgccgccccgtccgggatgtgaggggcgtctctgcccggccgccccgtctgagaagtgaggagaccctctgcctggcaaccgccccgtctgagaagtgaggagcccttccgcccggcagccgccctgtctgagaagtgaggagcccttccgcccagcagccaccccgtctgggaagtgaggagcgtctccgtccggcagccacctcgtccgagagggaggtgggggggtcagccccccgtccggccagccgccccgtccgggagggaggtggggggatcagccccccgcccggccagccgccccatccggcaggtgaggggtgcctctgcccggccgcccctactgggaagtgaggagcccctctgctcggccagctgccccgtccaggagggagattggggggtcagccccccgcctggccagccgccccgtccgggaggtgaggggcgcctctgcccggccgcccctactgggaagtgaggagcccctctgcccggccagccgccccgtccaggagggaggtggggggagtcagccccccgtccggccagccgccctgtccgggaggtgaggggcgcctctgcccggccgcgcctactgggaagtgaggagcccctctgcccggccaccaccccgtctgggaggtatacccaacagctcattgagaacgggccatgatgacaatggcggttttgtggaatagaaaggggggaaaggtggggaaaagactgagaaatcggatggttgccatgtctgtgtagaaagaggtagacatgggagacttttcattttgttctgtactaagaaaaattcttctgccttgggatcctgttgattggtgaccttatccccaatcctgtgctctctgaaacatgtgctgtgtccactcagggttgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaaaaaagaaagtattgagcctctgaagattgcctttcgtctgcataaacaatggactttttatataacttgattcccctatggagtctgctataatgatctcgaagaatattctttacttctgaatgctttcagtgctactgaaaagaaaaaggacttgagaagttagagagggtatcaacatcaaagtgacttcttcccttccagcaatggtaggaacaggaggaccctaaggcatttcttagtttttgtccaggtcctgtcaaaaatcttagctaatctccctgatcacaggagtaaaagtggatgaacaaggtgattctcctgccttttaagagtcaggctcttagaaactgttttagagaatttcacttgtgtatcattaatcccttaaatgaggtagtatcaatatggcgataattggaacttgactttagaaaaactgtgacatataactcaggtcccttgataatcagtgcctgtgatttttcctgaatgacagctatgtgtttagcacaggcaatatggaccattcctttgtatctgtagccctcagaatttgaacatctatgttatacattcttaagatgcaaaaatgttctgagacattgtccatcaaacccttgggaagtcgatccagacgaagtgtcgtattcacatactgcctttgttcatattgctacggatatttcaagattcatttgtcaggcacaaagttggtcatattttaacatctgttactccttcactgttactgatggaaagatgaagattctgtgtagtgaatacttgattggagtgttgacatttctgacagaactggcaatttttgaaattgagtgaggcattaggtagactgctttgtggattctatattactttcctatggtttatatactattcttgctaattgtgcaaaactgggagggacttcaagaaaaatgagaacaatctaggctttgcacttctcccttctcaagagttcctttagaagggctcaggtgggagcaacaaactagaccaaaaatgaagcaggtggcagtggtggagataagtttggtgtccctaagggcaaccatgaagttctgggatggcggcctttgggatagtagttgtcaatttgctattctatttctgtataagttttctttttttcctttaacatcgctcttccagggtccaagctaaatgaatggggcactatacagtaggttttaccttggagagtattccctttgagcattgtagacttctctagctatgctccccaggttcgtctggttatttttcttcattgcccttcaaatttctgtataaagaccttagctacagattcttttgctaaacacattgtcttcaaacaatgtgaaaatggaggctatgcttttccaggagcccattattctgttagctcctttaaaattttatttttattagatggtggcaataagaatgggacgaatgtagcaggaaacctcagggatgagctttctgtctgggtgggccttttccatgacagcagcaccctcggaaatatttgtgttcagccatatttaaacttgagtgaaaatggacagctgaaagttagttcttgtattaagaatgagagaaagagagattactacttttcaagttacttttaaaattcagaataaaaaggagaagtagcaagcttggtaatcaagtaaggtaatagataaaacatatcaacccaaaactttgtggcttaaaaaagtaatgatttattatttctcatgattctgtggctcaggaatttggaggggcagttggctgttccacatgtcatcatctgggtgaggcagtgggctgcattcagcaggcagcttggatgggctagaatattaggaaggtttcccttttaatagctggtgccccttgctttattgttagcatttctctctctacacggggagcttggcctttctcacgggtcagtggtctcaagatacttggactttttacatggtggtcagcttccaagaggagaggaataagctgccaggagcagcatcacctctactacacattattggtcaaagccactcaccatgccagcccaaattcgagcagagacgaggtagattctactttttctggtgagtaccagaaaggaaggagttgacagtggctcattggagattatctatcacagttacttacatatgttacttaagttggaagggaccattgtagcagttaaactgggtgactttaacttttttcaagtcaagtagcaatcatgaaacctttattgataatctcttggactcatggaggtgacttgatgaatcctgtaatgcttatcaaaactgcctcctgctcctctataccccagtcaaattatccattctcattaaataataacttggctattgatgaaacatttagttacacactctaagtcattaggatactataatgaatgcattcttgagtgctaggaaatttaggcaaagaagattaatacagtctggacctaaaataattcaagattttccatcattctatttcaattgctcatataacttcttgcttttccttgctttttatgtgaggagtataggtttcttttctcatagccagagatgatcttgaaaataagtgccttttttgacagaaaaaagtaaggctggaattctaatgtaaaaggtcctccaaaatacaaagaaaagcctaaggcttggacaatataaaaatctgccattcctattgcattccaactattaaacagtaaaatatactatataatcgttcctttattaaatactctgaagaaagagatgtggaatagcaatcagaggactgatgttcgggtcacctttggcaaatcacttaacttcaagcctttcttttaatctataaaatgaggataataatttcttctccacctacctcagtgtttgtgaaacttaaatgaataaaagtattcgggaccacacataaggcataataactgtatgattaaaaaattgttggtataccaataaaaaagagataaaaccccaattaaatatttatatgtcccccataaggggctcatggtctcaacagagtgtatatccagtaggttatttagttaaggtgtagtgatagtttaaaataaccccactctttccatagaaagttagcaagatctttcttttcatttctgcttggttctacttattctgtagaaagttggggtcatgttgaactgccctggctaaaataccagtcctctttaaatgtctaattcctgagaaagctgggtaagatggcagaacagtaacaataggactcagggtcgggcttgtcttttctgccctgggattcttaccatttctggccatctttgaccaggaagtcaaagctccttttatttatttgtagtccaagctctttttcatggctgatttagtaatgatttttaaagatcatcagataaccattagataaaaataattctagactcctgctggccgcaagataattgccatatttaactgatcataaacaatagtttcatttttcagggatttagttaattataagcctgtgctgtctaatagggtagccacaaactctatttaaatttaaattacttaaaaattaagtttcttagttatgctagccatatttcaagtgcccattagctgcatgtggctagaggccactgtattactgcagatgtagaatattttcatcgtcacagaaaattctaatggatagcactgttagagacttctttctaacctgtgcgttgctgtttttttttttcctttctgtctccctcaaaggctctttctttcatgtttgtttgttttgggtgagcaatgtggggggaaaaggagctcacactcatgccctattttttagtagtgttgatgaaatagttggtaattggatggactgaaactattggctagagtaagattttgaaaatatttttgaatttaatatatatgtattgcccaaagcagtagttgtagaggtttttatttgttttttaaatggactagaatcctgtatcagctaaacacttctcatgaactagtgactacagtttttctattgaatgttatttcattacttttaaacgttttattttataacaagctcctttactacagtgaaaattcagctcctgtgctcatatcgaagtcatttgactagtatatgcccttttctcaatttaaacacaatttctaatccaagatccattcagatcttgatatgccaattaaaatattgactttaaacaaaagggtcataaaaatgtgagattaaaatgattaggagctgagtccttatcacataatccaaagtaaacgaggattgcacaatgccatacttaagaggaagcgcagttcagttgcacagacatgttcctagatattccaaactgctttgaaattatagtgctttgtgttgaaagattgatattaaaatatacttgggaattaaaattcactttatgaagaattgttgccaaaaggctttaagatagcactgtgaagacatgatatgaaaaagaacagtctccaaagccaagccacatttctgcagatcagaatcagaaaattttatgtaggcagtgtggcttaccaaatgtgtctttcataacggaagcctatttttcactttaacattgacatactgtatgtaaatccaggaatcaaaattatacctcagtgtcacttaatgtttgttatttggaccaaatttcacttgttttaattgtgaagctaaaaatggaattttgttgctgaaaacttgaattcagtgaactcaagttctcataactgtgaacaaacttgttttaaagtttttttgtgttttgttttgtttttttctggcgacaaggtctcacactgtgggccaggctaacgtgcagtggcacaatctcggctcattgcagcctcaacttccaggctcaagcgatcctcctacctcagcctcccgagtagctgagactatgggtgtgcaccaccacacctggctagtttttgtatttttttgtagagacagggtttcaccatgttgctcaggctggtcttgaactcttgagcccaagcgatccacctgtcttggcctcccaaagtgctgggaccacagatgtgagctacctcactcagtctaaagattttttttttttttaatattcgtatcaaaaccagtgagagtaggtgctcatcccggagatgtgaccagttagctagaagccaggaacctcagaagagaagagtagctcgtaactcagcttgctggatccaacaggatgagaattccctgaggattgggcaactagggtgatttcccagatctaattctgctctgttctgggtagttgggcaggctatgtagtatatccgaattccaaaccattaagtgaaatgcttgttattagtgatacccaatcattgtttcatgacacaccagtgtgtcacaaagatttcctgcagtgttggcagtgagcctcacttttcccaaagctctggctccttctctgacacattgccaccaggtggcctgcgtgacctttactcccttttccccgcccaaacatcttacattccttataccttatatctggatttaagaaaagacttcttttggacaattgatttgcagttcctaatctgagttcttacacagttgccaagctattattgctgcaaggagttaaatcggttttcacacagttctaatagtttattgtcaaaatgtcatttatttgagttaagcattgccaatgcccccattaaaccactgtttcttttatttcctggagtttggaaggcattcgggaataccaagtgaaaaggaagagtgaagaacagaaaaatgttagtgggatggcaaacactgtgaacattgctgtttctagtgggccagaaaaatgtatgtataaatcttccctgttcttagaggcgctttcagattctcctccacaaagcttcctatggtcaccatttagagtcaatccccttttccctgttctccatggtatgttatttagttctcttcatattactggatcagagtctgctttaccacttggtcatttgtgcatgtctttttcttactgaaactgtcagattcttctttgtatcttcagaagtacatataatataatgtaacatatgcaagtttatatgtagacatacatttttaaattctttaaatataatagattcatgttcaataaatagtattgaatacctattctgtactatacaaaacactggtgataaaacaatgagcaaaacaggcacaaccccgtttctcaaagagcttttataatgaggcagaaaggatggacattaaataataatttagattgcagctttgtgagtccagaaaaggagatatacagtatgctatatgagggttatataacaggaagacccagcctattctggggattaagagggaagattttctggtataagtaatttaagccgagccttgaagaataagttggagttaactaggcaaagaggtagagaaggagcattccatgcatagagaatagcatgtgtgaaacatactgctggattggttgccttgcaagtataaggaactgaaagtccagattacctggttcttagtggtgaggaagacaatagtgcaagatagtactggagaaataagtatgagtcaagtcttgcagagatatgtgggccatgtgaaagatttggttctttagcctaagattatgaaacagactttggaaggtatcaagtagaagatgcttaatctacatttatcttaacagcctcccagtagattcctggcttccagcctctataacttaacatttatacttattgttctcatttgcattgtgactgctgtgggaaacgaggaagtagcatgtcttctgcaggtaatgagaacctttgtaccaaaagatagtgggatgcttgcttcctcagaaaagaatctggctagtaggttgattcggtctggatccaaagctttcaaaacttgaattttattctgtcttgaatgtggaccacttagtttattctgaaaatctgatttctagcagattttcagaataaactaataaatccaagaatggcctgggttacctaggcaatagtctaattttattagactattttattagactattgcctaggtaacccaggccattcttggattctgagaccattcctcctgccacacacaactccccgcaagaacacttagctatcagtgggaaaaatccagtgtctttctcttgctgggaccgtcatgtccatatcagtcatatacaatatcacaggtaaccctggaggagggaaagggggatggggaaccaaaatgcaaaggacctggtgctaagcgccccatcattatttcatgcaactgaaagtcaagcagataggagagttgtaaaacttgtctacaatgagaataagcaaggaaagaattaagggtcatttcacatttaaaaattcagcttaccacttgaagctgtcagtgctttgtgtgtagaactttcaaataattaacatttctcaaacatcaaaacacagctagaggtgtgcataaataaagaggcacaggtcccaaaatactatttttactttttgaactggtaggactaatagaaaaataaatgaatacaattgtttagattaactagttcttatggaaaagaagcacgggagaaagtagttgttaaccaatacttgattatttgttaatcactactacataagataaaaagtagaaaaatagggatatatagcatttacttaagagaaacatctctctcttaaactttgtatttgtttttaagcactccaagatcttggccaggatatttaacctttgatctagtttcccactgcatggtatggctataggaaatagtggatgtaaaagggcttttaaaaaatatagaccatgatacaaacatatttactagtattattgtttcaattatctattatggagtaacaaattacctccaacttaaaacttaaaatgacttaaaaatgacttaaaacttaaaaatgacttaaaattttgcattttcctgggttggctgggatcagctgggtggctcttctgctccatttgactttggctgggtcactcaggcagctgcatgcagttgggagctcagctggggattgaatgtccaagatggcctcattgacatgcctcacagttgtctggctgttgactggagtgcctccattctcctctgtgtagcttctcattctgtacagcctctctttccatgtggattctaactggaaggcagactagcccagatttctttacagggtgattggctgaaagcctcttcaggcccagatctgaaagtcactcagccatacttctgcattctactgtcacacagggccatcccttaggcaaggagaggtgaaacaggttccagtcctggactttggaggagagaatcacattgggaaagcacatgcagagtgggagggattgtgggcaggtatttctggaaatgtctaccacagttattattaaatacagcttgaaagagtaaaagattacaatcccaatgaataagaatgcttattcattgtactgcttccagatattaaaattattaagttacctttaacatatgtgtgctgtacataataaccatggcatatattcaccatagctattctaactgaaggaaaagatatattccccaaaaacctaattcttgatttagtcttattgtttaattttttaaaaagtgtactacaatcatagtttttattgtttcagaggttaaatgcactttacgtgtttactgatacaaagggaattttgaactccctctagtggcaaaagattttcttttattttttccaagagcttacttaataagatggctgacatgtataacaacatagtttcaaaaatgacctgttcttaccatcagaagatgcccactttctcctgtgtgagttatggtgggtcctttaatctcttatgagaaatgttaacctttccaagaaacattgatcatattatatgaaaaaaaaggaagaaaggagacttcctgttaactttaaagtgcaaaaactgctaactgctccctttagtcagggtcttaaataaaaactattatattttgacaattaaaatatcattttccctggctaaaaagtaaattaaattttaaatttttgcctgaagaattattttttgaacagacaaatgtatttaattgaaacaatctttacatagaaagcaatagataactgttgaaaagtgcagcttggaaagcactaatagccaaactaggaggatcatagggatcccaaagtgttatgcttgtcttgaattcaaatttggattttcatagccaatagggaaggaacatggttatcaccattacgccatacaaaaggaagcacaatgtcaaagggcgggaatagaaaaacagctattacagactttgtaaattaagttttcttatccccaccccattgccaaagagaattaataatactaattaacttagtctgttacgggtccatctatagacagatttattctggttctttatatagtaaaaggacatttctgtgatgctaaaagacattctttaaaaatgctcttttcccagctatttgtggaagccgatccaacctatcctgtactgtctcgtaggttgacacccaaaacctctgttctcctacccacagtagtaggaaaatggccagggatggtaagaatccatagagtttttttcttcttcttcttcttcttttaaagctctagaaagtggaacctaggattataaaaataattccccgacatgctgttttgtttgggactaaactatgaaatagcaagatttcactacaataattaatccagccaataaaaagttagactttgtttctttccaatacctctttttagttcgacatttataactaagtctgtgtctcttgtggtctcgattacatccggtgttttcagctggcagcatttcctctgctgaggccaccccacgttttttgccaggctacatttctgtgaatataaagagagaaaaccaagttgtattagagagtgaaatttaaggagaaattgagtataactttgatttttgaaacaaaaaccaagccactgtatttgttataaacaaactggtgattaaaatatgtaggctccagaagtacatggaaagtcttatagccatctcgtagccatcctgcatgttttctcttaaatatttataataacctaatttaactaacaaacagagaccagagattcccttccagctttgcttgcacagatttgaaataatgaaagtgaatttgcatttcttaaaatggtgttttcttccagctctcatagaaatgtttttggaacagtgatctgtgctaacagctgtattcaatcttgagtaaaagtcacttcctgaagagaatgaaattcaacttaacattcgaacttgcctagaacataatcctgtagggtgagtgtactatgtgattatgaaactggacacaggcaccctgctgagatgatttcttgtaaataatacccaacagaaaccattaatcagtgtcagtgtttttaactgaagaattaatattctaaaagtgttccttattcatacagataaccgtcttagttttcaagaattttagtctttgatattttaaaaatgtaattcccttgtggaattggatctatatgaaatctctatgtattaatatataccatcagatagacataaatatagatacagataaacatatatgtttatatatttaggctttaacaatttttttaattgtgtcattcttgattttcaggtaaaatttatttttgactcagttctctttacctattcactcatttatttattgcagtgagctcaatttaaatagaattttgttcctggcctcataaaattagttgtaggtatatatatgggaggtacagttttagctatgatggatttaaaaaatatctcttagatagttattattgacctctactttcctaaatattatacttctttattttaaagaaggaaaatgttgtattaacgtaacttggatattgctaaaaccttaatggaatcatcccttagatggaaaagtgtccactgaatcttctgttttctttatggatcattattttgtcatctaaacaatgaatgtggagttttcagtcataggctatcaaattgattagagataaagtctaacacgttaaggcagaattaacaaacatacagaaaaattccaaccatctcaatttgtaggaatcaaaaccgtttccggccttactttggtaacaaaaaaggagctaggctttcttccattccttgaccaaaccactaagttgccttgaagacctttgtttataatgtcttcttacattcttttccccctgacatgctcccctccctccagcagtgagatactaattaaagagaggccactgtgaccctaggttgtttagaagtcacccggaatgaggtggcggcacagatctggagaggaagcgctcattcctaaatataacacagtccttaagaccatcttgtcaaaaatctgttggcttctaatagcaaacaaagtacctcctttgacttaaaaggtatacacttgaaactaaaatggaatctctaaaacctactttaacaacatctatatccactttttataagaattggcaacaaataaaattaactcatgtatgtcacatgatagtttctttcagagacactaaaatataaacattaaaaacattttaaatttgataaaggataatctaatttttatgtttgttgagggagagggagcatgtatcttgccattccttttaaaaaattagagacagcttagattgtgtatgagaagactcttttctttttttccctctctccttccctctttccttccttcctttccttccttccttccttccttccttccttccttccttctttcttttctttctttctttctttctttctttctttctttctttctttctttctttctttctttctttctttctttcttctgtctctctctctttcttcctttctttcgtttggacaccaggcaacactttaattgggatgataaaatgaacatggtgcctgccaatcgtggaagtgcaaggactgcagatttttcttaatataagtgttttgaaagacatggaaataatttaataacttgccttaaatgagcaggtggtgctgcctgacattaaattatttccttcttaagtggacttgctgttgctaagtactaacttacaagaagcagtttcttgcacaattttattagtgcttgtttagcaggatacttctgattgcaagcacagtaatagagacccactactgtttgtgttaagtaatgaggtggaattgttctaagaatatataagggaataagaatcttagttatgaaacccgatctcaacagaacctgagaaagcagcctcctaggtgggtctatggagaccagttggatgacagttttccattcaaggcacaaaatcaagagcaggagttttgaatttttccccttgaacttctgccatttctgctgtagttgctctttgtttagctgggttagagtccggctgctttgcttcttactgtctactgccattcttctactctctgagtctcactgtcctgtgattcactttccaagtgatgattcctctacctcattgcttctccttccttccagcattgcttgctcatggcccctcagctaccttatataaggcctccttctccatgcacagtacccggtggttttagactccctgtaaacactgactgaatgaatagatgaggaacattgttagggaattataaaatgtaagcattttgtgttttcttttagttagcctttaagggagctaagaaaatataaattaattaaaagccagctggaagacaaatgttattttgaaaaatttaagagacctaatcatctccctttaggttaaaaaggattcactgtaatagtagtaagaaattatttatttacagaggcactgaacaagtgtataccgttaaacttgagattctggactaccttataaaaaatagtagtgcttttaaatgctctcacttcacactgccccatttaagcagccacactggcaggaatggagatgataatttaacttcagactccaagaagggaagcagtcattttttattgaccatattccatttaggagccaaaattaaggtctaatagggatctgaagactttttttttttaatccttcagatcttcatcttaataatttatctgtgaatagatgatcaattcctgattatttttaaggcagtctttttttaaggatttttaaatcccccaccttcctattgctgctcattttttccccctttttagttgcccaggggacaaaaataaataccaagaaagagttctcaattcttcatccctttgctgccttttatttttttaacatgaaaggttataaacattctgtaaaatctttcttaatttctgctattcatatagtcatttgtgagtgaatagacagtagtcataagaagacccaaatatgtatttttttaatcatataaagtttttaactgaatgttgggttgaagaagaacccaaacagcagtttaaaattcagttgctcagcttcccggttatagcatgaacatccagaagtggccagttaatggggcttcattcccctgcactttggaaatgaccagcagtcccaaatgcatttgagagtattttcactcatgagagaaaacgtgcttctcagattctgaaggctttctgagtgaaaaccagacaaaacagacagtaagagtgctaataagtatgagacatctttctttttgtttccccccccccccaatctctcacctctggcttaaattcttaattttatgaaatgatacttggctgggtgcggtggctcatgcctgtaatgccagcactttgggaggctgaggcgggtggatcatttgaggtcaggagtttgagaccagcctggccaacatggtgaaacctgtctctgctaaaaatacaaaaattagccagcgtgtggtggcgggcgcctgtaatcccagctacttgggaggctgaggcaggagaatcacttgaacccaagtggcggaggttacagtgagctgagattgtaccactgcactccagcctgggcgacagagtgagactctgtctcaaaaaaaaaaaaaagaaatggcactttttttcttgaacttccaagtcaataaattttaaataacttttctttctagagttgtaacagtgtacaaggcattgaggtagaccggatgctctggacgagtttaccctccagtgaaatggacagatagatagaaccaaagtacaatacaaatggccttggtggggcacaccagtttcagtagtgatatcagagagagagaggagcgaaggccaaccaggggacacaggacctcaaggaagtttgaaccaggggtctagatcccaagagaagagccaagattggagctctggctgtggtattcttttgttcactggtgattactgaaatgttagttgtgggtgagatcatacgtggaaaagaacctagagcagagaaaaaaagatggtaaaggaggaccccaaaagagtagacaacttggaattccatgaagatgagtggctggtgctgtcataaaactacatcatgttgtgtggggacaagtgggagtcagaagccaagttatagtggtctgtatctggaatgggcagtgaagtgcaaacgtccactgacggacagtctttcaagaactccagcagcgaaagagagaaggaataaagtagcataagaagcaagggaatcatttccctcccccccaccccgcttttttttagaatagagaagacttgagcaagttagtttactggaaaaatgccattgcatctgctgttcacatttttaaaaggaaaatatattaatgtattacttttatagtaaaaaatgtattaagttgccaagaaaaattgaaagaaaaaaagaaaagaaaagaaaaagaaaagcaagcaatcaaactggtatagaagttgggctggggaaagtcaagtgagggtatgttatagagaagttcattcgaaatcaaggatgcaaatggaaacctaaatcttgaacacagagaagctatctagctaggatagagaagagtgccaagaagagatgcaaaagtatagatatgtatttgagagataactgagagaatttcatgtaaataatgaatgatctctaccttatcattgtaggggtaggattaggaatttgagaaaaaaactaaaaggtttggaattaattctccttgggatgggatagggagccacttgcaaatgagtaaaatgaatgctatacagcagtaaaggtataactaaaattgagtttttagcatagtatgatttgcctgggaggttgtgagtaactcaggagaggaatagaaaaatctggtgaaaaaaatgcttattttaaagataggatgaaagggctatgaataccaggcactagaaataacaaacttgaattagctgactggggaatttaggtttgttaagtaaattaaatgtggtggggcggggggagctgtgaggggtgggtgctggtggtgctagtggtggtgatggtgacctcatagactagaggatgggagaataaagagaatgagggagaaacttacatttccaggtctgaaaatgagaataatagtgtggtgtggggattgatgaaataatgcctgtaaaatacttaaaacaatgtctggcacaattaaaatgtctaatgctataatttttgtgaacaagagtacagaatagatggaagaattggaattacagaacttgatgatacacaatgatgtcagtcaatgaaagaaagtggatgtgtaggttttcttgaagtggaactgtcaggcttactcacgaccccctaaactcaaggcttaggtttagatgaaatgatatcacccaggaagagtgcttagctatatgctatatttatctgaaaaaggtgggcattagaagaaggtaaataaatgatgataaatatctttgtcatttaacaaactgaaatgtctgctttgtttcctacaaaaactctgtgaggatgatattgttgtctttttgctttttacagctgaacagtagatttaggtgaaagtagctaacagccagtagaactgtctttttgacacagtagttcttcttgaaagcccattccttgcccgctactcattactataaatggcagcatatagaatgagttagagtgaagacatttatgcagccaacagacacatgaaaaaatgctcatcatccctggccatcagagaaatgcaaatcaaaaccacaatgagataccatctcacaccagttagaatggtgctcattaaaaagtcaggaaaccacaggtgctggagaggatgtggagaaatagaaacatttttacactgttggtgggactgtaaactagttcaaccattgtggaagacagtgtggcgattcctcaaggatccagaaccagaaataccatttgacccagccatcccattactgggtatatacccaaaggattataaatcatgctgctataaagacacatgcacacatatgtttattgtgacactattcacaatagcaaagacttggaaccaacccaaatgtccatcaatgatagactggattgagaaaatgtggcacatatataccatggaatactatgcagccataaaaaaggatgagttcatgtcctttgtagggacttggatgaagctggaaaccatcattctcaacaaactatctcaaggacaaaaaaccaaacaccgcatgttctcactcataggtgggaattgaacaatgagaacacttggatacaggaaggggaacatcacacaccggggcctgtcgtggggtgggggaaggggggagggaatagcattaggagatctacctaatgttaaatgaggagttaatgggtgccgcacactagcagggcacaggtatatatatgtaacaaacctgcacgttgtacacatgtaccctagaacttaaagtataataataaaaaaaaaaagaaaaaagaataagttagagtggatctcaagagctgtcctgctgtaccttgaagaggaaaaggaagagacggtgcctcttggtgtggggaagacagaacggtcaaccattggagtttcaacagaagttgtgccatccggggaaagtaattcttggttgctttagtcattctaaaatacatcgtggtaccatcttgggttttaataaataaatgctcacccaagataacagtgaatcatttccaaaccttcttacctcaagaggctataatttttatgtatctgacagcaaaacttgttttatagcagagaaagttgtagggggtactgaggttaatgcttatcttttctgggttcctgtaaccatgttctggttcattctttgtaacaaaaattttcagtaaagttgggagcatgtgtcctcataatttctggctcaggatcatgtagaagtgagccacagtgactgaggggaatatatcataatcctcaggtgagctggactggaaaggaggccgagaactactgactgacagtgaagccaggtcaatgggtacttgctgactgtcgcaggctgcatttcaatagagtacgtatggggagtatgtgctaaatcttggccatcattgtatcttcaatagaggagtttataatgtaaagacactgagctggcctaatttaggcattaataccatccttagaaaatgtagcaagaggtcttggaaaatagatgagagtaggaaaaactcagagtgggtagaccatgaggcatgatttcaacagagtaaacggagggatgagtgtggtttggctgatggaaaaacagaggctgtttcctggcaaagctcagagctagagaagagtgagttcatgggcagccaagacacaaatagtagctggaaatagaggtaaagggacaagggagttagaaagtggagagctttacaagtgctgttcagaaatttgcatttgatgtgggagttttaggaagtagagtgatacagccaaagaggccagaaaaaaattattttggaagcagggtatacaacaatttggagtaaataaggaccagtcagagggaaaaacagaagagttccagcagttcaagctcgagaaaactccataaaagatatggagaaagagaagagagtcagtatgaatcacagataagctgctaatttaaaaatcgtgtattttcactgtcaaatgtagaaattagcagcctcctatttgtttcatcactcagatttgcagcatttctcaatgggtttactgtaacctttgtactatccagactgtagtctcataactttttaaatgtttggtttttttcccattttcttttttaggagagattcatgaggaaaaggtaaatgggcagataaagtagttatttaaaagaaaacttataaccggctatgtagtcacttcctaggtgctgtagcaccaagaatcagtttacttttgttgtctgggatcctctgaatcaacctcacaagtcttttaatacactgacatccactaaaaatacttgaattgcggacattttcaaacatacaataaggtggaaagaaaaacttcagcaattatcagcactttgtccattcttatttactgatataaccttttaaatgttaaatgatagaatgaaacgaatgatatgattttgaactacaagagtttatacacctaggagtagacatgggactaaaacaaaatttttttaaagagtttatacacctactttaaaaaatctgtcagtcactaaaagcttaaattatgattcatttttaaaataaagggccaaacaggcatagaaagggaggaaaacagttcctatagtgatttgcaatattttttagcctgatatatttaataatgttcatagcaaatagcttaagtgaattctaagacttcttaaaagagtccccctaaaatagaatatattttaaatcaatcaagaaattacaaattacagaatttagcatgatattctttaatattgaggaagtttggctggtaaattagaatgtaaaatttatcactgaattaaccgtgattaattatctcacccaagataacagtgactcatttacaaaccttcttaagtatttcttaagtatttgaaagtcataagcttgttttaactttatagaataataacatctgtttgaataggacttgcatacatttttaatatattgcttattcattcattccaacattcatgaaccaatattcaaacacttaatatgtgccaagccctgtgttagaggcttggctatatcagtagtttggtatgttaataattcttattagatgactttcaaggtgagatcaattataattttcttttataacaaggggaacattacagataaatgaaattaatggataatccccaagcctcaggttaatcaacctgcagtcaataaataaattggctggtttgtttcagtttttcatgttggttttatcatcacaccagcagttaaatgactaaaaggaatgctgcatatggaagaagaggaaatgcaaggaactagtcagttcctgaacaaatatgaagtatcagatactaatagtcgttgttccaaatgtgaatcatttacatcttttcctgtaactgggtcatcttaactgttgttattgcttttgattcactttgtaatttcatataaattttaaggactgtgataatcatttcagatatatgtctttttatctgatttacctgatctatgtaaaaattacttttccaatctgaagacccagaaagactaagaactggcactccaggtaccgtaaaagggtggaaatttgtgaggctcatcagttggaattgatgccgtgtgccggaacagtactgatgactgatctttggagtgtatgcgtgtctgtgtatatgcatgcatttgactaaaacttgccaaagaagtaacagtccagtattcatgttctcaaggtatgtttgcaactgacagtttaaagcagtaacagcaagaagtgtacagtggcaaagtctgataaatatctatagatttaggttcatctccctttcatctttcttattatataaatgcactgaaaaacacttgaagtagaatgacgtgattgtggagagagagctgaggagggaagcagacagctcagcttgttcctttgtgatggatgtctttgtgagattagggtgaagtttctcattctgatgcgtgcagactgtgcccactacttgtaagacacactgtcagatctccttggaaaaactgagcatatgagtcatttacttgtaaaaacttagtagctctgtgttcttaggaagattaaaaatgagtgtttgacaaatatttttctaaagccaaggttatgaatagaaaggacatggatatgcatttgcatgctgtgtattcatgtacttgtatgccatgctttatagattctaagactcaccttttttacatttcaacatctctgcagttgaaatgcaggttgtaagttatggtgtcttttaattactgtagtccacttttttcaaatgtcaattaacatctctgtaattttcaggcagctcacaatcagtggtatcttagattgcatgacatacagtttatgtctgaatatttataggacactgatacagagagatgagtgtgatacttctcttttacccaaaaaataaagtgagaagatttattctgacaattaatggttgaagtcaagagaaactatttggtcatagaatctcatttactgaataagtaagtcacatacagttgcaaaatgcaacacttatttacagtctctctttatgatcttaagtaatctaaagattaggatgcaaattcactatgtagtttataaagcatgttctttcttatttgattactgcatcactacattttttacatatatataactctttttaacccagatattcatggttttgaaaagaaggtgaaaattatttctgtcctttctgtgtgtgtgtgcatgcgtgtgtgtgtgtgcacgcgcaagaaaacttttacctcatccattcatgcctgcaacaaaacataactatgtgcaggacattaggttaagttaaattgttagagatttacagactgcttaagcaatcttataagattcttaaagcgcaagaaaagatgacttagctctcacttttataagttgaccagtacagaatacagagaaaaagcactatacaatctatagaagccaccgattctagtcctgcggtagaactatgatggatggtttcagatttcaaggctgtttaacaaagttttctagtagatatggctaaatatgaatagatggaatgaatttattattggtctaggtgtccaaggagagacagtagcattcattcaattactgaaagatttattgataatgattattgtatagcaattacaaggaccggcccttaataattctttccacctctgaaattctatatttctagggcttcatgtcagagggcaagttgcctgatcgacctgagggtatctacctgttcaaaaaaaggtcggcactggtggcggggcaggggcaggtggtaagaatacctgtcctgcctccttcccctagactttaatgagataatgcataataaagcattttataaattgtaacatttttataaattcattatgtcttacatgtgaaaaatgtaaatagcccccaaaaatgtaaatgtcttcagaagttatctacttcttccttctggcactttctccagtttaaaagagtctaactgaattttaacacttaataataatgacttgtttgaaacattgtatttgccactagatcaaacattagattgggaggtgaaggaagggtggttctgggagtatctaatatgttgtcagcgttctgggagtgttttttacagtttggaattaggaatcactgatgtcatgatcagtcacattgtcatggcaacatcggaatttcctcatttgccttctcttcacttggggagtatcaatttgccacaggtctgtcatcagttcaccccatgtgttaaacatactagataacccagaactagtcattcttaaagatactcagggtggggaatttttataaactccttaaatatcctatttcagtactcttaactatgtatcctgatgttggaaactttaccttcatacatattcaactgaatagaaattcatttgtaattccatatcttcttatttgaacctttataattcaggggagaatgaaaggcttttcagtattctcatttacataaaggacatcattaattattctagcatcctcctctttaaatgaaatagacctaatttaatggtaattttagcaactgaagagaaaggaaacttactgtttctttccttctgtgtattgaatgctttaaaaccttacttgtgctatccatcttaggttttggatagacattggttatgcaccctctccctacagataattaggaaattcttattaaataaccttttgcaattgttagcttacatgagggttttgtttttcccgggtacagtttgctgttaaagttagctttttactcatgtaaaggacatggtcattccaggtttgaattaattttgtttcccacgatataaagatttttggctccagttttccacaattttttttttaaatttcctaagtactttctgtctcttcccaggtcctagtagcaagagtggatgtgatcagaaattttcccagcacacccattccttccttcctcacctcagctcttgtcttttacccacagtttgctcacatacataggtaattatgttacttccatctctttggagtcagagagacccaagatcaaactccagctctactactgtaatttcagagattacctagtaatatctttccatcacaatttatgagttttactataattcatggaaaattcattgaattaacttgaaatattctgaaaataagcacttacatttttataggcttacaataggcatggagaataacagctccatactagatttgcacaatcagagtatagaagattgagacatcgtccagtcaatttaggaaaacagcaattcacaatatatgaaaaatggaccttctctttgtcttggtatcccaaatagtttacttattttgctgtggaatttgatctatagctacaaattcactgttgtttaagccaaagcaaaatcttgaattttaatttaaatggcattttattcagatgttgtatttttgaaaaggatatgactccatgtacctgtttttatagattttttttttttttttgagacagggtcttgctctgttgcccaggctggagtgcagtggtgcaatctcggctcactgcagcctcagcctcccaggttagttgggctagctaactcaacgatttttttaatagaaaaacttagggacagaaacttatagataacccttatgccaaaaattgctgtcagctttgaatttttattaactattatgccagagcagagcaataactaatttatgaacagattagatcacaaaatgtttataagttatttgtttcaaatttggaggatgtttcttcatagagagatgttgtaaatggtgattaggattttagttgacctaaaataagcatctatgaatctcataacttagctaatatctaatatggtctctcacccttttttgagggaaaataaaacttggttccagttcaggattctggaaataactttcacctaaccaccatctcagccatcctacaatatcccagaagataaatttttctgcttctctcctaactctgtcccaccaatgattccagaaaaaaaaacaaaaaaacaaaaaaactggtttaaagagagaagttataccttagcaaccatcagtgaagtgagatttagatgctaggttggggctgaatatatatacctgtactattcacgatatattcgaatattggaaagtttgcatttatattcagtggaatggaaattcaatgtaaatccacatgcttttacaactgagcaaatgggggcttctagaagggataagtgccttgcccaatgtgacacagatggtaaatggtgaagccaggattcagggtcaggtgttctgatgcccaagctttggctcttaataccatgtaagtttttctctatggggcttggacttgatccatagctaatagtagtaataaccattattaatattattggagacaggggactttggagtcaaagagacccaagatcaaaccccaactctactatgtattggatttgtgaccttgggcaagttactcagttttctctttggtaaaatgggatagtcattcttctgtcctggggtatgtgtgtgtaatgtgcttagaaagtgcctggaatatagttagttactcaataaatgacagctattattatttaatactacatgcagagaagcagcagtgggacaaaactcatttattctgttttgttaaccaggacagaataatcagactatggcttctggtaggactcatcagaatatggctgtgtttgtattgttctctataccttctaggattatagctatagttttattttattacagtggtttcagttttatacgcatgtacttttatacatgtctagggagcctttacgtttggaataagaattgcagattttttaaaaagcaaaatagtaaataatagaaaatgttgctgctactttagaaatagggtactttatcaactctattttgtacgaggaaagaacagaaagaatctgctgaccccctattttttcttctttttttttctcctgttttgctgggagccagaggctttgtgagctcttatacatagactctcaaaagtaaataggttttttttggtgtgaactgcatatactaacctatacagtgtggctatattttatgcattaaaggttgcagtctgatatagtgttgaatgaatttttcctcttaattcctttcacctttcaatttcacccaaataaaaatgggtgcctgaaatggttcaacagcaatagagggatagaacctgctgtaggtcagttcttttcttgatagaggtgttctattcttatctcttggacatcttctctgcccccattttttttccttctttcaaagcttagcttcgccaccatactttctttgtagtaatttcattcaaagcttactcttttatgtggggctcggtaatatgtgtattagggtgttgggtcctctaggacgcctcaccttccccttttaggaagttcatcaattagcaatgatttcagcagtgattaccccaagtctgcattgtccctcatgctagccttctatctgtagttctgtttttctgatcatctgcacaatgcttctttctgagtatccttctaacaaaacatttatacagttgagcttcccacgcccatgttatatccaatattgatctctccctgctgtggactcccatagcacacgattgtctagaacacttgcctggcacttatcacttaatgtcttgcattattagtgtacagcaagcaatttgggcgctctatggtttacaagtactcacctaggaattgaagcatcatcatctataaggctttttttgagatgcggcgttacagagttttagagagcataagacttagtaaatcttttaaccctagccaggtctagattttaatcctagtttgctacttgcttactagctttgtggataggtcacccagccttaactttttttctttcatctgtacattgaggcttataacccttccaacctcaaaggttgttgtgaaagttaaatgagacgtgaaaggtttaaaaatgaaactttcattttaaaattgttgctttgggacaaatgtctttcaaattcaattctctaatttcaggtatatgagctcttttaagtggcagaaggcattattacctatgtgtgtcatctcctattttagattgcaggcttctgcatgtactggtggctgcatccttattattctagttggtatacacctcctggcttatgagagtgatctctgatactgctcacagtcttccaattcattcaaaaatggctcttctccaacacctaacttctttaaaggaaactggacaaaaacagatgaagaaaaacttcagtgcacctaggctcttgaaacagacctttttttagactttcgttttccttttaaagttaaatctgcagtatacacaaccttagaaagaatattcattcagccatttaacagttttttacaaaaatgccctccccttgcctaaatttgcttgtgcttaattcctgctgtacccttgctcctgttctttgatgttcagcatcagttatttgcacagtgcaaccatttaaatctaggcatcaccatgataaaacctggaaaaaaataacaacaactgccatttactgagtttgacacttttgtccatgtactgtacttaagacaattttgtgaggagtctggcactcaagagaggttagcaaacttgcccagagcacaagtgggaagctgaaatatggacccagatctgcttggttctgctttaattctgttccttggattgcaaagtccagattcctttaagctttctgaagaagggtgttttaagtacacatgtggaggggctgttgtaagtcttaagagccaaagcagctctagggactgcagccccctccatcatttcatggccaaatgctcacccactcctggcatgctctactctctgcccgctgccagtaagcttcctgtttactcatagtttctgcttcctcataaccttggcttgcatatggttttggcttgttgtggcctcaactctacccctggcactcttatagttgctggccccttagtaactggttcagccattgaagttttcagaatcaaatccccaagggtgagaattggattggtcctgctcattttttcagtcccagccaggtcataggtcactggcctgtcagttgcccttggatcagattcccacagcttctttacctaccagctgagtgaggtgagggaggaagacataggacagcccaggcagcaaagtctgtttcccttgaaagaggatgagcattggtgaggtgcggtggctcaggcctgtaatcccagaactttgggaggccgagatgggcggatcacgaggtcaagagatcgagaccatcctggccaacatggtgaaacatcatctctactaaaaatacaaaaattagacaggcgtggtggcacacgcctgtagtcccagctactcgggaggctgaggcagaagaatcgctggaacccgagaggcagaggttgcagtgagctgagatcgcgccactgcactgcagcctggtaacagagcgagacttcgtctcaaaaaaaaaagaggatgagcatctctaggacaggttcttccaaagccccgtttttaccatgataacttgcagtctctctggactgttttcttactttctatgtgttagaacatatttgtttcaaaggtcgaggaactttttcagatgaacctcaccaggatctgtccctgtaatcactcttacaactaagcacttatgaataatctataattgagtgtgtatgttatatacagggtctcatagttatgtttttttttcttacgttgcattctttgtgtttgagtgacttcattacattttagattttgttgagggtagacaatctatcttatctctttgtaatgctttacttaagaacacagtacctagttaagtttggaacttttgaaccccggtggacattgtttttttaaaacatatatgccttatattctctccttttatgtcattcaccattatagaacatacattttgttggcttttagatatccttctctagtcttagagtcttttaattttttttttttttttttttttttttgagacggggtctcactctgtcacccagactggggtgcagcggcgtgatctcggctcactgcaagctccgcctcctgggttcacgccattctcctgcctcagcctcctgagtagctgggactacaggcgcccgccactatgcccggctaattttttgtatttttagtagagacggggtttcaccgtgttagcctggatggtctcgagacctcgtgatccgcccgcctcagcctaccaaagtgctgggattacaggcgtgagccaccgtgcccggccagagtctttttaacattcttttagtattcttagtatatcttagtatttagtattagaattcttttagttttctaatttaaatttcatcatcacttaaaaacttttcttatccccataaaactattgcagagtgtatccaatcaaattttagcattctggattgcacagcatccaaaatatcatgaccttagagtacagccatagaaaaattaatctattctcttcttttgtggtttacattgtggtttcctaagagaccactcttgacaactgaggttgtacagggaattttttccatagatgcacagacgacaggtctgagctgctggggtgttgagcagtaagttctcagagaaaggcacctatgacttgaacattctgatgaatgttttctattttatacttgtgcttgataacttgcagtaaagggtcctagtgagaggagacagcaaaagggaagtcaaaacagttgtcttatgcatggagtagcagaaaatagttccaccagatacaccaattttcaatgaatgctcattatactgtgtttgatacttaatcactttaaaggacagatttttacgtaaattttgtctggcaagttcttactcgtccattgtgcacctagcactgtgcccagaataagttactttgcttttttttttttttaatgaaaagaatcaggaattacatgtgtgttttatacggttatttataataggtgaggctttccagttatctggctggagaatgttggaagagcctgagtatggaagaggttcactaagtcaccagcaggatatctaggatgaatattttttccagttccttgctgctagaaaagcctttgaatggccacagctttgccagaagacttcatttccataggggacactgttttccttagggaagccagaaggcatacgccttcactttttagacaagttaggatttttcattatcatggcagatgagcctttccaggaaggtattaagagaccagaaaccaaggaagaactctgtagtatttactgcagcgatagtattctgtaaaagtcaccgtggaacaggccaatgtgaaggatggcaagcccgtcccagtggcttatccagagaccgcaggctctgtcagtccgggctgctgtggaggccttctgcactgcacaggttcggggcttcatacgtccacggaaaggtggtcgagaaaagggacggcttgagcagccgtaggtcatttacatcgggaaacaaagggaagtccctcctccctttgtctcttttttgccgagtttctgtgtcctaagaaaacacatttgtgtcgcatctaataattaacataaggaaggattacactgttccaggttttagggagaaaggtttaccaaaccggtggccttaaatgattttcgctccttgatattatcatcttgaaggaaagctggtaaactctggcttagggataaaacaaaactttaccgatcgtatttgggtgaggggctggggagtggagagctgtttcctctgctaaaattttagcgtgtgaatcgggggatggagatttgcagaggtttgacgggagggtcgtgtgttcgttgaagtaggggtgattgtccacaccttttcttgaagagtggcgcggggggcctagttcgaaaggtgaagaagagagggaagaccgaggtgccagagtggtccccgaagcgacgaccttaaaaggggcttcgagccggggtgcaaagctgccgctggtgcttaggaaagaaccgagggggaaaaagaacagaggaggggggttggctactccgaggaatgtgcggcatgcggggagccagacccaaccattgcaccagagcgggggcgccggctgctccccgggccgcccggccccggctccggccccgatcccgggagggagagcgcgggggccgggcgggcgatggggcggcaggcgccgcgcccagcgggcgggcggggaggcgcgggtgggcctgggcgcggcgcgaggcggtgcgctgccgcctccccgcccccggccggcgcgctctcagggcggtggttgaggccgcggtaggtggggacgcggcggcgctgctcctccgctgccgccgggagagtcggcgacgccgccagctccgcgcgcgaactcccgtccatggcacgcagggcggcggctgcccgagctgctcgagtctcgcccgctgccgcgccgtacttttaggcgagtgcggaggtcgaaggcggaggggaagtcagcgcggagctgcagcccccgccggccgccgccgcgcggcgagagggagttcccagagctgccgcggccccgggcccggccggccacctccttgcgccctccccctcgcggcgaggctgccccgcgcccgcgcccgcgcccgcacccgccgccgccgcccgcagcgatgatcttccccagcagcagtggcaaccccgggggcagcagcaactgccggacgccctatcgcaagcaggtgaggcggcggccgggatgccgcgccgaggtcggcgagccccgcgttacaaagggggccgcgctcaggggctccgcgcctcctcggagggaccggctgggcggtgaccttgtttcccaggaaggcggccgcggggactgctcggccggcgacctgagcaggggagatgccctcgccgccgccgcccgggccgggcagggtgggaagtggaggaaggggcaggggcaggagcggagagccggcgagggcagaagcgcgccgggccgggggcttcacccagctctgcaacaagtttgggtttttcccaaaacctttgtgtgtagcggagtgcggtaataagtcgtcacgctggtgtgcagtcttcgctaggaacctcagagaacctgtctgattcgtaggaaacccggaagacgtgtgtctgtgtgtgtgtgtctgtgtctctgtgtgtgtctgtgtgttcgcgcgcgcccccctcatttaaagaaaaaaaaagagaaagaaacaggaacttctactgtcactttctcaaggttttcagtagcacagggaaatcctgtgacatcctagttgcagaagatacttggatatgcctgagtcatacacatgctctttcctattttaataccgtttcatacattttttaacagattgaactcgaaagccacttcagtggttagatcacaatcccctgctgggaaaaggaatggagctgggagcttatagttgaggccttttgtttttcatctttgtttttaaaagaaggttactgaagccatgttgtgatacatctcacagagcctttcagcagcagcaataacaaaacgtagctttaaattatctaaaaaatgtgcaagtctgtttagaaaaggttaaattgatttagaggtcagtggcaagatgcttgttgagaaaacaaaaacaggattgcagatatttttcctccataataaatctcttgtctgcatccttagccactgagacaaatcaattaagttattatcccaaaaaggatgcaagcgaactgtagccttccatgcagaccgtggctctcttaagatcacgaccgatggcagtgatgcttggtggcttccctttaggtatttacaggattattgattatgtttaggtcttgttgtcgtcagagtcattcttttttgtgtgtatgtcctagcgtaagtgtatttgcaagtattttggcagtgtcgaaaagaaatgttttctgccttctggtctttggttcttttctatgttaacttttctttaaagaggcagtaaacacacaccgtggtctgtgtgcccttgatgtggaagtccatggaacttttacctgggttaagaagttctttcctttaattaattaaataaataaaatctgcatttatgactcggctgaaggatatgctaagatagtcaagattcagaagcaggcatctcgaagtcatttcatgtggcttcatttaaaagaaatgctctcggatccagtacacttacatcaacttcataaatgcagccaatttacaataaacattccccttgcaacccctcctcccccacccacctcactctacctgaaaagatggctaattatgttagggccttgtgtattcatttatttgttgtcaaaacccggcggggtgttagctctgaaatggggaaaaggctctgagggcgaggcctttggctgtgaggggctggaggttttgtgtgtgaaggggggtagcctgctggtctggagcacgctgataagatgctcttcttttcacagggctctccttagattcaaagactaaaagggctgactgaatcagaaaaacaaacagactttcttttttctataggcaaagaaagaaatgaatgtgtaggcattatacagacacaagaccccgggtaccagtggtatttgagtcaaaggtttcttttgttagtatttagccattcactgggaaagcacacttccagcgcggggacctggttaccatgagtgactttgtgatctcatcctggcttagcctaaatgggaagtctaattaatgctttttataagattttgtgatgttaagcttcaaccttgcagttcatattagtttgttcattttgatgaaagaattggcagattttaggtatatgatgcagtttgattttagtctagaaatacataatcagctgttagagctgatctcagctaatttgccagaaaaaaaaaaaatggaatgtaaggaatactttacagtcacctttggaaaaaacaccgtaatggtttggaatcacacttgcattatacatacatagtagtagtagctaactttcattgagtacttcactacctgctgattgctgttctgaatgtttttggcagattaactcatttagtcatcttaaaagccctgtgaggcaggcaatatttgtatatccattttacaattaagaacactgaggcatagattaagcaaattgcccaaagtctattcaactcaaagtgcagagccaggatttgaaccctgacaatcactcccttccaagccaccacactacggctgcctgcctacatgtactgctcaatagcaacccatagagaacttatctgcatcatagcccatcacccttctaatctcagaagtccagtttagggattcctcccacctttttggggagggagaacttgtgagctaggaggtgaatgatgaagcaaatggatgatacagatggtaagtttgtgatgtttggaagcagcattgatataaaaatgtggctgtactgaatgattgtacaactcttaaagctttctacattttacatatacagtcatctctcagcatccgaggaagattggttccaggatggctcaaggtcctgatataaaattgcgtagtatttgtatataacctatgtacatcttctcgtattctttaatctctagattacttataatacctgatactatgtagatgctatgtaaataattgttatactgtattattttcaaattgttttattgctatttttattgcttttccctgaaatatttttaatccacagtaggcggatgcagaacctctttatacggagggtcgactgtgtaggagtgagctagtttcagttaaagcagcggtggttggtactcatctctcacctgcccccacgtagtgtagctagggcatcagggagtactgatctctggcatcatctgggatcaacaggattttcctgcctcacaggcctgtgagcacattagaaatacacctgctcagctcaagtcaaagtgagaagcttttgaatggagtgataaccgagtaggcagtatctaaataaagatgattggttcaagtctcagtggacaaatgtgtacgttctattactgttgactgtgactttgaagtatatggtgttcattaagcaaatccaatctgatcgtatgaaaagagcaccccaaaaaccaaaatgaaaccatttatcaggacttttgtagctatgaaaatattttagtgtgttttgaaacaaaaaaagtgatttatactcaaaggcttttagatatagaaaattggtattttcatttttcctttgtgttgtttcttgaattcttttattagctactcctcttcctgtttccttccattttggaactgctttcttgaggtagctaagttacaaaccaaccatactttggtttctgcacatcgtggcatgtaggaaggccttttttgctaagcagtatgttgtcctagtggtttccagtagggttttggaggtaggggagtgaatgcaaaatttttctgcatgtgtgtatgtgtgtgtttatatctgtgtgtgtttaatggtcttgccctccaatagttgtacttgttaaatgttgctaacttttgatgagggaagtacttatcttcccagtttaagtagatttacatagtttactgccttcttcaagattaactgggtgtagctgcacgtgaggaattcaacagtgattcagtgtttggccttgtttagaggatgacatacaaagctgttgattaatcctcttcaggcagtttctgttcacagcaatttgtgtttagtagattgggttttgttaaagtttgaagattaaacttgtgcatagaagatatttaaatgaacactgcctgaaacagtcccaatttgttgttgttttaaagaaagtaaacgtcttcaagctacagagattggaggtttagtggagagtagcagaaaggtaaattggtatgtataagtaaggtattggcccatttttatgttatgttatctctgtgtatttgtggtcaggtaggatctatgagtcatgatgatgatattttaaaatctacccatacatagccatttgaaaactgtacaattcatcgtgattgtccactttttctactagggaccgttttggcatctcattacatgttccatagttcacttcaggttttgaacatacttctagttttttacttttccttatttttagagattactgtcaactgggctcaccatatattagtacttttatttttgagacctttcttaggagggtaagagtctatctgatccaggtttctgagaatatatttataaagtactcacccaataaataaatattttaaggatgtataaacctcagtcatatttaatcttcatagcatccatatagagaaggtctggagttttgaggcagtgacatcttaagtggcctacatggtgaaagctaggtccctggagtcaagggctgtgtctgctactaggaaaaagaaagcccgtcaagaacagctgtggcctcactacacttccctttacttggcctcccaaagacatgtggcccacagtgtccagatttcagatgtgggaattgtagctcttgaatgtattagtgtttttttgtttgttttataaaggctttcacagatgacatactagacactgagttaaatttgaatttcagataaacagtgaataattttttagtataagtatgtcccagattttcatcacactgcatttttgaatttgctaaatctagcagccctctctcagggaaatccaattcgctttttaaaactcattataaaaaaaatcatgataataagacatactattactttttccactgaaaagtttgccccttagcatattccttaggccctgataacgcacgtttcacattttacctccttgaaccatttggtccatgcttccgcctgcactctacctaattgaaagactatggcttaagttgtggctctaccatttgcatgctttttcacttaacctccctaagtctgagtttctgctaagtaaagataatagtgcccacttcacagggtagttgttaatccttctaaggtgctattattaatgtccccacagagcaagcaacagcgggtggtcctaggagacttctgtgtggtctagggagaccttgacacagtcgcctaagaatggaccgtgtttacagcctctaagaatggactgtgtttagaatgaggggcagcctgaaaaagggtaaggacctgaggttgaaaatgaaattctcaaccacatttttttaaaaaaagaaagtaccaagaagtagaaaagtggatcccaccatatttttaaacagttggtcatggtttatgccctcgatagcagaatttgcttcctctctggggaagactttcaatcctttcttctttatttcatgcaaatatattaggaaggtaaaaagagcattgatcattcttatcagtgaaaaatgctactttttaatttgctggaaaacaggtttgattattagtatatgcacaattatttcctgaattctttcctttgtcttgtttgtgtatttgattttcaaagatatcgtctttgcattactcagaaaaataaacattttttttgtccttggacatctgtaggtgtttagtgggtgtttgtttttaaactcgcatctgtacagaatgctttgcttaacacattctaaaatcttggtgtaaactttaaaatagtatagaacacactgtgaggaaaggaagaaagcatttcctggaattaggataaggtgaaagaattaaatggagcaaatgaaatcctggactaaaataaaaaatcaatataactgttgggacttaacacttaatataacgacagcagcagcaagaaacttggtgttacacagaacagtaccctaatacatagaaatctatgttggctccactttattcatttaaacatatggaatttcataacagtgtaatgtaaactagagaagattatcttttgtttgtcaattgtatatgcaatacaatctcaaaaatgtatttttaaaaactggaaggaaatatgccaaaatattaacaaatggcttcctctgctatagaatcacaaatgactgttttttatgatcctttacatttttttcaaccatccagtctctcttgtcccccacaatgagcatgcagtcctttggctatcaagaaaaagacagtgaaaaaacaaaacaaaacgaaacctagaaaattgtattttttaaatgtctcaaaattgtggtgaaattgcaaagaattcattttgagaatttcaatcacgcatgaaggtactgcttgtttctaatgcctgagttttgaggggtggtcctttcctattctttatgtattatttttgtttcctgcaaactcctgtcctacctttttagaaatcacttgtttctgacagatactttttaacttaataacttaaaattttcctattttttatacatattttaaatatgccttctgtactttttgaaacatttttaaggcacaaatttatgtacatgagttagtgagggggaaacgtagctatatatatgaaatttcatattctagattacttttcaggagagtagctgttctaaatattctaaatatagaggcattatcacaatcacctgttttcatttgacttacagctgttttgtggacagataaattttctccacatttaatttctgtattaaatgtgacaagccaagactgtcctacctatgttggaatcctttgggtttattttattatgaatacatatgattgtcttcattgcaaacttgctttttggctcttagcttcttttttttttttcctcatatatatgtttgtatttttcattttgtttctttcgttttttaaatttaatttaatttaatttccagttccgagatacatgtgcaagcttttccctttttgaaagggccgtgcagtgggaggtgtggcttctttagaggtttctttaatgtataatggaagagtaaggatttctgtaagaagtacaaggtacagataatgtcagcattgtagaagcagctgttagtgtataacccaggggagttttcagtgtgtctggggagttttaggtgtgcactgcagaggctgcaaagctccagagcaagatggggaggagcagggagtgctgaagagagggaaggggaagtaggggctaagagagaagaaagcactcttaccttgtttgtttcttactttgctagttgatgtatcactttgcaaaattggttccagtctcattgttttggtgctgtgtaggttgggagcaaatatgtagcctcattgttttgaattgtcttagattcttaaatctccccctttttttcttagttatcggtcctatcgtccagcattttctttctctgttctaagacaaaatctctttgtctctctcctctttggagaactgcctataaatcctttttggaagaccatttgtgatcaacccaaccctgccaattcagatattctagaaagtactttggctctattttgtattctcagttttatatgttaaatgtatcagaccaattctaagacagtgaatagttcttttgtttaaactgaaagtttaagaggggctcagaaacattgagttataattaattgagttgtaggtgtaagtgatttaaaaaaaaaaaaagcatacaggaatctttgcgaagtaaactggtggcatgcaggagataatactggtgcacattaggggagaaactgggcagggaaaccagctagctagttgttaaaactgctgagagctagtgaggacccaaaagaagtcagttaaattgtaggcaggaggagtgaccaaattttatagatactgaaatacaggaagcccttaaaattgtatgcaaaatgtgcatacattggctgtttctttggtagagattcatagctttcatccatttgtcagagggatctgtgtcctccaaaagttctcgtgactgcatttggaaggagagggagaagaacttgaacaaaatttctaactcaggagacaggataattggttgcatcatggaaggcgacatttcaggtaaaaagaacattgattcagcaaagatttgaagatagaaaacatgggctttatcagggaagtagtgggtagttcaggttaggttgactgcagggtagagtttgaagaacagaggtcaataggagcaagcttgctaaaatgggtgagagcagagcctgagtttagaaggtattgtctcagttgaaataaagatgtaaaatgtggcagtgtgaatgtattaaatagaatggattcaagatattgtgtagaaagaattgacaagatttggctggtgactggctggatggggaggggaaggtctcgggaatagaccatcgtaggcttctagtcgtaaatgattgggaaaatgaaaagttactgcaaccttttttgctctggggctcagtgatgaggaaaaacccagcctttctattacaaggattttccacatcatcatcatcattattattattactgttattattttgctattaaaataaattggagagggattgttgaattctgatactggtgtccagacaccagggatacttaatatcctgcagtgtccagctcagtttctcataaggaagaatcgtccagcctaaatggctaatcacacacccctagtgaaaaccactttaagaagttattttggttggggagatggttgtaagcatttctttaccactcccttgagattaccttgaagtcagagtagaagctgcctcacatgtctgcatggattttcgtgtttgtcctggatcttctcaaacacattgttatatggcaaatttcattcttggtaatatacgtcattcataattatacagtcacctttaatatctatagtctaacaagtacattggttatattaaaacatctcccacctcaaaggaatatggaagatgggcagatatagtggtgagtggtttagagtattcagcctaccaaaataagagtttctgggggaaaggcagtgagtttggtttggccattttaacttgtccacatgaattacacattattcttcccacttgccatcccaggcagaaatttctagcaagcagttagagaaccggagctctggggaagaagcacagaaacttctcagatttaataggtggagcattgggaatggattaaagcactccgaggagagaatgtgtcaagacaagagatgggacagacttcggggagcacagattctatattgggcaggagtaggggggagccttaggcaaagtaggaggaaagaagtggcacaaaactgagagaatccggagagtgtcacagaagccaaggagaacaaagttttaagaagaggtggtcagctccattaaatgttgccaagaggtcaagaaagacaaaagcctagtaaagggccattggaaatacccattgggaggtctttgtaaacttttaaaacagaagtctcagtggagtcctgtgtgtgtagtggggcgggaaaggagggtggaggcaggggtgagggaagcacattccaaagggtttaaagagtgaatgaatgaagagggtgtgtctttaggaaagtcagacgccaaagagagtttttttcctgaaaatttcaagtgacagcctagagacaagattatttcagcatctgtgtttgtaggtaaagcaaggtgctagaaaaaagagggaatatttggaaatagggcttacttttatgaaaggttgaggcaggattagtcttacaggaaagggctcctcagaagtcttcctgacagtgattacaggaaggagaaaatgggttatgctagagaaggcaggaaggccagtgaagctcacctttttatgaaagcttaggattcagtaaggaggcgaggttgtctgttcagattctataaaataaaaaagatgggattttcagtttaaggagtatgacaaaagatttggaataatgctcttgggaatttggtgagcattcaaacagaaatgagtgcaaggatgactcaagcagtagtaaggagccatgggagttcagaggtacgagttggcatggtatcctgaccctccacgagcaataagtaagggaaagcatctggataatgggtttatatagggtttgacattggtaagatgagtatgctctgaaaattgagagcactgttccaaaggctaaggaaacgtgaaatcaagaaagacaatgagcttttggtatagggtggggcatggagattctgataagatccttccgcctaggggaaagtccccggacctcggtcagagagtgccacgtgcatgcgcaggtagacattccctacggctgggcgcggtggctcacgcctgtaatcccagcactttgggagtccgaggtgggcggattacgaggtcaggagttcgagaccagcctgaccaacatggtgaaaccccgtctctactaaaaatacaaaaatcagccgggcttggtggcgcctgcctgtatcccagccactcaggaggctgaggcaggagaattgcttgaacccgggaggcggaggttgcagtgagctgagatggtgccactgtactccagcctaggcaacagagtgagacttccttcatctcaaaaaaaaaaaaaaaaaaaaaaaaaaaaagataaaaagaaaagtccctgggagagagaggtgaaacaggctgcttcagagaggaagttctgaggtaaaagccttgaaggtagaatagtcctgggatccttccttgtggagttgtttggaggattaaatgagatagtacatatgggtctgtctggcacctagtaagaactgaggtggttgtaattattaagatgaagttcttgtataaattacacctccctctaactactgttgtaatatttgtgtaaatcaaatcatatttcaaacagattccacaaaccatgaaacacaaaccaaaataaagtgttaatttttttcaactgaaccacatggccaacgtccatttaaaaaaatttcactatcaaaccatttcaaaacacaggttgcttttaaagaaaaaaagttggacattggtgtggatcccagctcttatcactcgaagggacatttcttaaactttctgggtcttaatttccttggcagcaaaaccaggggtaatagttactcagtgttattgagatgattacatgacatcatctgggtgacagcacgtggcacattacctggcacaggtactctggatgcttccctccttccttggggtgtctcctaacaggtcagtttgtatacaaaagaggattttggaggaagggtcaaggaaagcctacggttataatcgtggaagaaaattgtgatcattctgttcactagccgaaaatccttgtgatgagaaagacttgtgaggattattatatttgtccttgcttctcagggttaagggtcaaaagagttaatgtaagataaagtgctttatgatatgtaaacactatggagatgttattacagtttctgaaatagatgccctcgactattatgtgagcattttccttctttcagcatctgatttttttttttttttttttttttgagacggagtctcgctgtgtcacccaggctggagtgcagtggcgcgatctcagctcactgcaagctccgcctcccgggttcacgccattctcctgcctcagcctcccaagtagctaggactgcaggcgcccgccaccacgcccggctaattttttgtatttttagtagagacggggtttcaccgtgttagccaggatggtctcgatctcctgaccgcgtgatctgcccgcctcggcctcccaaagtgctgggattacaggcgtgagccactgcgcccggccttcagcatctgattttaaattcagaagtttattgttcaaagctgctttccttaattgtgcttactaagatacacggattctattaaaggttgaaagtgttcaaggaattaaaatactcattttacaaagaaacttcggaaacactacatactatgtagtattgtccaggagagtaaaagtgtaaattagcagtaaaaagtcttcaagaagtcctacagtggagatatttgtctgacttcatgatttgttttcctagaattacttgatcatggaataatttagttttagaatatttactaattgtgttcttggaacagtttgggaaccacttatttaaaagaagcttttgcattttagtgttggaaaggacattagagattatcgggttcaacccctttaatttactcctaaataattaaaatccagaaacattgagtgatttgtttaaattctcacagcttgaaaagctggatcttctgacttttacttagtgcttcaccatcctaccttaaaatctttgtttttctaagtatggcacacacttgcactaatgtttttctaatgaatgttaaagagtgtatctttttaaaaaatcattgatagaacttcagaattgcttttatgtgaggtttaaaaagtcattctctgaacagagtaggcctttagcaatagtaagttgcatgttaacttcaggcaaaataaactagtatctgccaactctcatttctttttttgcttttaatttctcctctgttaaggtcagtttttccacctgttttattgctttttaaagcatttacaaagtcaagaaagctgacttgagaaatcaatctagtttaaaatgtcagtgatctggaaaactcacacattctaataatgaatattcttttgtcctctaaatttgttttgtctttctcatataattggctgtgggtagaaaaatttgcatactttcagtcccttcctgcctgacttattacagcatgcagaatttactctgtggtttctaggtgtaagttcctgtatagaagaaaccacagttaggactttacaaccctactgtggagaaggctcgtctgtgaggaacacactgctgtgtgttcttgaaaattctgaatggccacttgatcatcctttgttataataggtaatctagactaaattgttcacttgtaccatctaaaaaaaaatctatattaaggttcttagttgcatagtccaacgaaaagtgggtggaagtctgtcggtctccctcaccaactgtttctggtgtctacaacatgaaattttatcctgaatgaattctgcgatgtgatactagtgtttcggatgaagtgatctgaaggaatgttcagtatataatgtgttattacaaaagaagtgtagtatactaggccaaaaggacccagagatgagcttttcccagtacttattttagaggtgaggacatcgcatagcttatttgtaacaaaaccaggactagaacccagagatcctgactgccagtgaagcttggctattttctttttttttctttttcttgttttcttttctttttttttttttggagatggagtctctcttgttgtccaggctggagtgcaatggcgtgatctcagctcatcacagcctccgcctcccagattcaagtgcgtctcctgcctcagcctcccgagtagctgggattacagacatgtgccaccacacccggctaattttgtatttttagtggagacgaagtttctctttgttggtcaggctggtctcaaactcccgacctcggtgctctgcccgcctcggcctcccaaagttgctaggattacaggtgtgagccaccgcgcccggccagcttggccattttcaaccaaattcagcttggattatcattcattcagtcaatattttagagtacattatgggccaagaactgtgttaggccctgagggcaataacaaattagtaatcctgttgtcaaccttacagtctaagagagagtatggagcaagtgtataaataactatataagttagaaattagtgccataagagcttcagatatttaagaaatgcctagtaagaacatgtctgatttgcagctgacatgctacagtttacctgaattttgaccatttttcttccaggtgcatttgatttgtttcctgtatagaaacagagttctcaatgggctgttttgtgttgattgtcaccttagagttagtctaccctttaactgactctatgaaactgcttattaggatactaaattagaatagggaaaaaaaggaaatatatcttccatgttcttgacatcaattcattgccgagtttggttttatctctttaaaaggggtgcagaaaaactggcgagcattaagagaaatttaagcaaaaaagaaggtagtatttaacattctaagaggtcctttctctctctctttttttttcttgagacagggtcttgctctgttgcccgggctggagtgtggtgcagtggtgcaatcatgtcttattgcagcctcaacctcccaagctggagcaatcctcccaccttagccacccaaatagctgggaccgcaggcacacaccaccacatgcagttaattttttaattttttgtagagataagatctcactatgttgcccagagtggtcttgagccactctgagcttaagcagttctcccaccttgacttcccaaagtgctagaatgcccttcctctttttattgttctctagtgaaatgtgtgaaataggattggaaaatagtactaatggaattgggattattgacaatcgagagaaacaagcaataaaggtttacgtgggaactgctcatatatttcatacactatctatagttgggatcagggtttttttttttttgtgaagggccagatagtaaatattttaagctttgtaggccataaggtctctgtcacaattactcagcactgcctttgtaactggaaagcagccatagataatatataaacaaatgggcatggttgtgtttcaataaaactttaaatacaaaagccagctgcaggcagtgtttgaccggcagaccatagtttgcagacccctgatgtgtaggatccttctttgttgacacttttaccagaagatgcacagaaggacttgaaagaaaatgaaacccaaaccagatagtacttattagcaccatcagtataggtaggtacaaaataaaaccaagtgaaggtaggtctgattcataggtttggttaaaaggttttggattaagagctcaatcttgactagatagttcttttgcttggttttatttggggaagcatccttcacatatctgtgtaatcgttactacattggttattatttaattaattaatttggtttttttttttggagatggagtctccctctgcgccccaggctgtagtgcagtggtgcgatctcagctcggtgcaacctccgcctccctgcctcagcctcccgagtagctgagactacaagcatgtgccaccacgcccggctaatttttgtatttttagtggagacagggtttcgccatgttggccaggctgctctcgaactcctgacctcaggtggtctgcccatcttggcttcccaaagtgctgggattacaggcatgagccactgtgcccagccctacattggttatttttgttttgaatccctaagacttatccataattctgaagtggtgagacagaaggccatggtaaaatagtaattgcatcatggaagcaaaatattaatgtttttcttttaaaaatattttatggcaaaatgtgtgttttactagtcaacaggacaacctggcccaagcagactaccgaagcacctgagtattagtttgctagggctgctataacaaagttctacaaactgtgtttcttaaacacagaaactaattttctcagttttggaggctagcattctgagttcaaggtgtcagcagggccatgctccctctgaaggtgccagggaaggatccattccaggcttctctcttagcttctagtagttgacttgtggcaacataactcgtcttcacatgacattctgtctgtgtgcctgcctgtctgtgtgcctgcctgtctgtgtccaaacttctcattttaataaggctaccagtcatactagattagggcctcattttaacttgatttcctctgtaaaaaccctgtctccaaataaggtcacattccaaggtaccgggggttaggactccagtctgtcttcttgggtgcatacaattcaccccataacaatgtggtaccagagacattcaatttaggcaaaattcatcaactgggcacgttgttggacctgaaataaatgcaaaatacttcatgactcacttgtggtcacattagcttccatagcagaagtattatattggtggctctgttgtacataatgtatatggaaatgttattttttttttttggtggttgtttttaacttgcagttagaagatatttctttacagaaatattaatagcttaaatatgttaatggctatggcaatgtccatagccttcaaggatcctgagtgactgcccctttcttcccatcctctgctttgtgcaagttcatacctgccattccagccaaaagttcctcgttgctttttttttttttttttttttgagactgggtctcagcccaggctggagtgcagtggcatgcacatggctcactgcagcctcaacctcctgggcttaagcggtcttcccacctcagccttctgtgtagctggggccacaggcgtgtgccaccacactcggctaattaaaaaaaaatttttttcatagtgacaaggtcttaccatgctgcccacactgatctcaaacttctggcctcaagtgatcctcctgccttggccttccgaagtgttgagattacaggcatgagccatcagtcttgagcccttcctttctttctgaagtctttccttcctctcctccaagcttttgttaggctatcacaactggccacagaactacagcgtcctatcttcaagtttgtgtccctctcttctttaagttgaaattcaaggtctacctcttccaggcagatgatctcttttttttcctaaagttcctgctctttattacattagaacaattctgatgtgatgggtttcatccaccacatctcacttggggtgtgtaagtgggtggagtggaaaagcaataatgcctgttgtcttgagaaagggatgggttgcaccactacccattaaggtatcaggttacctctagggaatgggagtgagttcttgtaatattcttgcccatttgtaagattgttttgaaagctattacagagctgcaattctgtaagaatatgaagtagcattaaaacttaagtttcttgagtcttatgtaagaatttaaagatgtacatatgttttattagaggggcctctctttagtttttctcaaccttcaggtttttggtaaaattttcctctcctcccctccccaccagaatacaggggacacatcttagatggattgattgaaaaaaaaaaaaaactagtaattttcattataaaaggattcctcattatgtgattgttggttaattactgagggttttttgccttttttttttttttttttttttttttttttgagacaagagtcttgctctgttgcctaggctggaatgcagtggtgcaaacttggctcactgcaacctccacctcctgggttcaagcgattctcctgcctcagcctcctgagtagctgggactacaggtgtgcgccaccccgcctggctaatttttgtatttttagtagagatggggttttgccatgttggctaggctggttttgaactcctgacctcaggtgatccacctgccttggcctcccgaagtgctggcattacaggcatgagccaccacgcccatcctgctgagttgttttttaagcttttgtttaggtatgtttatcattaccagctagattgtttaatatctttgagcactggaacctctctttgtaacaatagcatttatgtatttcatgcatattttgcagggcacagcattttctggtatttttctcaggctttctttaaaaattgtgtttcctcatcacatttaaaacatggatttgctcatatcaaatttttccagaacacatccagggtgtgaagttaggtatacttatcggtcattatctcagcaagaattgtcagtgtgtgacagtgctctgtgtcagggatgcgcctagaggtgctccaccctttctgattaaaatgaggtcgttgggttgaccaggacagctgttttctgaaatttttgccacaaacaatcacgtcaactaaagtaaggatggagacagtttgtgagatgagcacatgtggaaattactctatgcctgaataggaacagaaagatctggcctgtcactgtgtgggtgtatgctgtggaaggcctccccccagggggattcatcccagcaatttgtttatcccaataaagtttgtagacctgttaacctaggaactccctacatgtcaattagaggagccatgaaaacctctcgcatcgcagggagggttggttagaagtgtcagttcagggaaccggaaattgcttggctcagctgacacaaaagaggatctgaagggtgcgggcagagagcaggcagttttagaaccaggagacgccttttcctgctggggagtgacaagtcaagtgtcatttggaagagttgaaaggtggactctgtgtggagcaagggacaagatggggctgctttgggagtgacacggacccagagctagagtgcccagaagattccgattagctgtggaatcccgtggagtagcccttccagcttagcaggggcactgggtctctgaatttcaaagacttgctgtcttggttttacccctcaccgtaccacctgcatcagaaactcttggggtgctcattaaaaatgtaaaccattgggtccctctgtcgccggcaaaaacaatgtggggggcattttaggctatctgggttacctggaatctcactgaaggctaaggaccactgggtgaattattcctcaaagagcggttgctctgtgtgtttgaacctttcagtgatgagaaatgaactgtcttctaaagcagtgatcttttaagtctggggtgatgcaggcaggaaatgtaaatgggtgccaaataagagaatgacagtcttatgagtaactgagttaaaattgagtccaaagaaaaattgggatactttgcttaggattgacgtcagaaaagctaacagcacatgttagttggaaccctgtttggctgtagtaccggagcagctggactgatgcatgagagccattctgagttcctctaggacactggaaatagtttcagaggtcagcctgtggacatgctgagccagctaagatgccagggccaggcataaacctctgggttcagatgaagctctctgaaatctaggataaggaaaagctttttcttttctttttttttttcctgtctaatgtctgccatataatttttaaagtaactgcctgatggggtggcagtgtatgcatttgcacattatggggtgggaggatctgtgtgttttgtgggggaggctgtcacaaaaaggagagattcctgagcatatattgagcccaaatactgtgagcaatgagaatgagtttccattttctttctttttgttgacccttttcctcaccctctctgctgtacacagagtaggaaagactgtcatttgcagcacagacagaaaatgttccagggcttgtgccattgcagaaaccccttcctcccctgaaactggtcagctgtctaatcagagaggcacccagaccacgacgtggctcctctccctgcctctgcttgttcaggcaccatccctaaaacctgccagttaatgctacctttaggaaaaaacatttagtgattaaaagctcttgctaaaatgtggagatttacccaattcttattcatccctcctaagggaagactgcaaaaaaaaaaaatcattaaaataaaaagactagatactgtaatgtaatctcacttgcctcagtcttttcccatttactagcatcaccgcatccccagctgctgcagctaataacattttgaaatttttaacttctatactgacaaccatatatagggctattgaacagctagaggggaaagcagccaggaatatcaaggggtggggacagtcttagaatttgataaacagacagtgtcctgtgatcaaattggttgaaagcagcaacttgtacaccatgtagaaaacatgcttcccagttcttcagctgacacctagctaggaggagtggtgatgtacacaaaataacagtagcttccagaaagcggcacactggaaggtaagcccacgtttgtaataggaataaataatcataaaatcctgcatttctgtgaaaaatactgagggaattctagtatgactaggtgtataaaaagacctgaatggttgatgtcttagttcaggccgctctaacaaagtagactaggtggcttatcaacaacagaaatctatttgtcacagttctggaggctggaagtctgagatcagggtgccaacatgatcgggttctggtgagggctctcttctgggtggtagactgctgactgctgtattttcatgtggcagagagagccatagggttctctggggtatgtttttataagggcagtaatcctattcatgagggctccatctttatgacctaaatcaccttccaaaggccacatctttttttttttttttgagatggagtctcactctgtctcccaggctggagtgcaatagcacgatctcagctctcagcactgcaacctccgcctcctgggttcaagtgattctcctgcctcaacctcctgaatagctgggattacaggcacgcgccaccatgcctggctaagttttgtatttttagtaaagacggtgtttcactgtgttggtcaggctggtctcgaactcttgacctcgtgatccacctgcctcagcctcccaaagtgttgggattacaggcgtgagccactgtgcctggccaaggccccaccttctatactattacattaggggttaggatttcaacaaatgaactttaggaggacataaacattcaattcaaagtatttggtttgactataaatgagtattagccaacaaattaatttagctgcttacgcccttagcatagttttacctatattaataaaattatgatattttgattaagaaatgaaatcatcatactacctagacaaataaattctagttcagaagttctttcagtttggctttttgaagtcagaacacatgtttttgtgtgtagaaacattataccatgtttggaagccaggttcctaggtttcccaggttaccacagaaacccagcctttcagtggacgtttcgaaccaatatagccagcatccattctgagtctcttgtgagcgcaggtttgtcatgtggtacatagatagaggaagagtatcttccttgcatctaataatcttaccaaaaaatgtagatgggatgatcttttgcattctcttctctctgtgaagcttgagaataataaaagggaggcaccccgaacagaacacgtgggcatctctacattcccttcctgatgctcttctcagttgtcctaagtgatgagcatttcatcacgtcacatcctggaagttttgagattttaaagtggggccctgacccaaatgcctctctctttagagtttcagatgataaaacaatctcaagtgacaaaatcccagaacaatgacagtctggaacaggccaggccttccagggacctcttctggggaagtggctctcccagcttcacctgcctgttacttttgaacctaggggtttttgttgttgttgttttagttagctttctctctctcttttttattttttatttatttatttttttatgaggctgtgcaaagaagcctccaagcccctgagtaggacgagggggatcgagaagctctttatatgtataggctgattttaaggttagaactggtcatgtgtgccctcggcggagccctcctggatatcaggaaataaaatttagagatgaacattgtgttagtctgttggtggttctataaagaaatatccaaggctgggtagtttataaagaaagagatctaattggcacatggttctgcaggctgtacaggaggcatggcaccaccatctgcttggcttcaagtcaggcctcagagagcttacagtcatggcagaagacagagtgggagcagatgtgtcacatggcaagagagggagcaagagagagagagggaaaggccacacacttttaaacaaccggatctcagagtgagaactcactcatcaccaggggatggtgttaagccactcatgagggatctgccacatgattcaaaccccccaccaggtcccaccttcaacagtggggatcacatttcagtgtgagatttggagggacacaaatctaaaccatatcagacattgagaaagatggactcaagtgtaggtagcagttactgagcacttcttacaagcccgacagtttattaattagcttgtgtaatctttacaacaacactgcgagctagtatggaatagatggtatcctcctcctcactgtacagatgaagagatgagacttggaagctttaaatgctttgcccaaggtcacctagttagtgagtgaccatggtgggatatgaactgtaatttcagaatccatcctttcattcctaattgctgtactgcctccttagaagttgcccaagccaaagaaattgtttggttattgtttgttttgaggtttagaggaatattattgggggataatagttatcactaaagatttaaagttggttaaaagaaggggagactagacttgttctatgttgtagcagttagaaatgttttagaaataaattgggacatctgctgttttctaatgacattttaaatttcttaaatttacccccaccccaaatctctatgctataggtaaaattctatgccataaagaaaattcaattttttttcatttaaaaaatgacatttaaagtttttatttatttatttatttattttgagacagagtctcgctccctcgcccaggctggagtgcggtggcacgatcttggctcactgcaagctccgcctcccaggttcacaccattctcctgcctcagcctccctagtagctgggactacaggcacctgccaccacgcctggctaattttttgtatttttagtagagacggggtttcactgtgttagccaggatggtctcgatctcctgaccttgtgatctgcctgcctcggtctcccaaagtgctgggattacaggcgtgagccactgcacccgaccttaagtttttatttatttactccatccccaatctctatgccttaaagaaaattcctactttggatatgagactggacaagatgacctattagttgttatctggatctaaatatggttaaagaactcattggtattacaacgtagtggctgcttctgtaaaataattctctgtatgtgctctgattacatagctcgctataccaccatagaatgactatagttaacaataatgtatagtttcaaatagctagaaggaggatattgaatattcataacacaaataaatgatagaggtttgagatgatagatatgctaattaccctgatctgattactacacattgtatgtactgaaacatcactaagtactccatcattttgtatacttattatttgtctattttttaaaaataaaatagtcctttagagaaagccactgtagtgggtcagttcccccccccccaattcatgtctaaccagaaccccagaatgtaaccttatttggaaatagggtggttgtaattaattaattacaggtagaattaattaaggatcttgagatgaccagtgaccattgactggtgtcctttcaagaagaggataggatgcagagagaaggccacgtgaagatggaggttgatattggtattctgccgtcacaaggcaaggaacagcaggagtcgctactggaagaggcaaggaaggcttctcccttacagctttcagggggaatgttaacctgctaacaccctaattgcagacttctgttttcctgaattgggagagaatgcatttctgttgttttaatctacccagttcgtagtaattggttacagcatcccttggaaactaacagccactttccactctctccattgatatttcatcttaaattttggaataggttcatgtccatgtacagtgttgtagttactgtataaatcgtacattttacgtttcctgacaggagccaatcacatttaaattgtattaggatggctctacatgtgaactgaatgttttaaagagatgaaatgcattttaaggagtagctttttaaaaaaaaaaaaattaagtaaactacgttagtgttgtggggtgggagtgttgtgattcttctgaaagaattttatcaaaccacccagatgactctattaacaagttagtcctctaacgaactctctcacacttctctaaggttaaaaatcaattagaaggattggagtgaaggtgtcatttttcagttgaaagtctaataaagcaaatcctggaaagaatgaataacaactgcctgaccagatgtggccattaccaaaggcaggaggatcccaaagtgattacatcttcttgaaggtttatagtaattctgattaatctgttttgaaaagacagatacccatataccccatgtatgcaaaggtaataagattattaggactcaaatttttttctgaattataattcttgctatcagtcataatttgtctactgtccctggtgttttgaaatctaaactaggaattttaaaagtccacctgtcatggagttgggaaattgttctggagatgctttagtctggagaggaaatataataaatttcaagtgaaagattctgtttcagtgaggaaaatgatatgattaatgcatttctccccagatttcagactcctttctaagatacttaggttccaccaccatctagcccttgccaacttcacccacctccttatacgctggaggtgttcaacatataacattttaatcactgcagcagcttcatggtttctaacataatgttaatctatgttccttcaccaaacacataaagcttagtccaggctctaagacatagggtgggattactaggcagggcctggtcccttatcctgcaggggttgacaggctggtaggggagatttgttctttaatccaaatgtagaaacaccatttagaaagtactgactttttgttgagttgaaatatcatatattgggatctaaaggaaagcaggtttcctgaatgttttctagcaataatccttcacagtaatgctgtgctgttggtattagaggaaggaaggaaggccgtgtcactcagttgtactgttttgcaaccagtttcttgagccaaaccttttggttatgttttattggaagatgtttagtaaccatgacatagatataccattcgtagcaaaggtcagtttctctaaaagcctcatagagtagttctctatcaaacaaagcccccagtatggtgaaactgaatggcatatgcctccttcactcccattttctcttccactcagctcctgaagaggttgtcgactgatctttcacaacctgactgctacctcctcggtgaccttggggaactcccttttctgttctcttatctgtaaactgaatgaagaatgcatttagcttgatgccaaaaacagagtaaatgctcaataatgttagcaattagtattatgcgtaacacttagttctctggggaaaaaatattttccagaaattgtcatgctttgggtttttcctctttagtttttgcttattaaactatttttaaggactgcctaggttattttgatagtaacaaaaagataaaatattatagatccatttttacccattttactaaaatgggtaaaaagagagctaaacctatccccctattaagggaaaacattgttcccagtgttttatctatttctaggatgactgctatccaggatttgcatatgagctattattgtaagggaagattgaattttgcaattagggagaacagagatgaagttagttagagtctataaggcagaccaagtttctacatgtattcctggggagagcagaatgagataacctctccaggattttatggataagttctcactgcaatatttacaatttatatattaatttaaaaaaacatatccaggcaggattaaactgtcctgcagatttttatcttcatttaatttgctttgtgatggaagttcttctaaaggtaggatgatgttttaatttgagcaatttttatgtaactggagcaactactgggttgcggggaagagcagagtggctgccaccgttccctgccacgagggtgtgggtggacttccccagcttcctggccgcagtggagaaaaggaagcttgtctattccttcctaaattgttttccatactagaagttatcatgcttggttccgatctttaccagaaacaaaacaacaacaacaacaaaccaccatttctcttaatgcattctttttgctctgctctaagatttaaactgttagatccgaagacttgaattttaggaatatgtgaagttgtctttttaaagaaatataaattttaaaactgtttgtgtatcctcttcctgcattttttcttttttagcaaaatgatttgatatcgtacggggcgctctgaagtttccatgctactgcttttttctgtttacttcgctttgaggtcctggcgtagctgcaggccacacctagaatgctgttcctgtctgccctgtcctctgggcaggggtccaccatagtgtttctccatgtttgggctctagtctgtttttccctttcctgttctggaaagcccactggtggctttggcttaggtgggggtgggcagagagctgctccccgtcactagtcattgagtgtgaggctcctgaagccagtttccacttaggcatcattttcttcataaatgtgtttctctgtggtgagtgaggagagatggtgtcattttcttattttgtgcatttagaaaggctgagatttacaaaactcattttgggtactcgtcactaattagtttaatctgggataacaatggaaaatgaaagattgcatgtttgatcatgcacagcaaagaaaaaagatttataatgaaactaaatatcatgaaagaagagaaggatcagaaaactcaagtgtaggaactgagttctgtgttgcccactgatctccacacccagcccccaaacacacagaggtcctgggtctctgttctagaggccagaactttatgttgtccgaggttctttggaaaagaaattttctttgacattttcaataactagcaatgtgcacattttggtaaaagagatgaaatgatgctttatgattagctttagcaacagaaaagtaaaaaggtgcagagaaagactaatatcttcactttttttcttgttgagcaataacttcctactccaaatagaatattgtgaaataattttaaaacgaaaagaaaaaatgttgcatccgatttctgtaaacattgaaagcatttcccagatcctgcttaccacagaatgacgttctacttcaatttatctgcttcagaagagatgaagagaggaatgaggcttgccagcatttggtttggttagctcccagggcacctatgtattcccaggttgataccatcaccactaaagtgattagacaatagtgcatgggctgactccataaaacagaggaaagtctcagggctgttgttagcagtagatactcagtccaaatatgcagtatcattaaatagaaatttcacctgaaataaactttgtccctgtaaaaatgggaaaatgcttaggtcaaattagaaacagcccttcagagtataatggtgggctgctggaagcaaggttcacattaacttttttttttttttttaagacaggttcttcctctattgccccccaagctggggtgcaatggtgcacactctgatcactgcaacctctgccaactgggctcaagtgatcctctggccacagccaccagagtagctgggactacaggcatgcaccaccatgcccagctgatttttgtgtttttgtagagatagggttttgccatgttgcccatgctggttttgaactcctgatctcaaacagtctgcccatctctgcctcccaaagtgctgggattataggcatgagccaccacgtccggcccacattaactgaaggaaaaccagtttgttttagagaatttatctaagtatatgctttgtgaagctttaggaagaagcaaacagtggagttcacaaaataaaacaatcttacaaatctctccattttatttttaaagaaacagagtatgaagtaacttgttttgagtgtatgaatttgtgacatatatagggagacatgaccatgggtaggcaattctagtgattctttaagggttcctaattcaagccggttaaattggtagttgactctgagtgtactcttatgacagaaaagcatcaaagtgctttttttttttttttatagatagagtcttactttggtgcccaggctgaagagcagagcagtggcatgatctcagctcagtgcagccttgacctcccggctcaagtgatcgtcccacctcagcttccccagtagttggacacaggtgtgaaccaccacacccagctaatttttttttcctttttgtataaatgggattttgctatgttgcccaggctgatcttgaattcctgggctcaagtgatcacctgccttggcttcccaaagtgttgggatgcaggcgtgagccactgcatccagtctccaaactgctttaattaacctgtttgatttttgtatcttcttgtaaatggtacagataatgatcttgtatgctactcaaaaattcttaatataaataaatacaaaaatagaaatgggtggcattcacgagcattttttgggagctttaaattatcaatttcataggtgtgtttccttttttttttttctttaaagcaagcaactggatatctagcatagacctggacatctaagtaagtgatctagaagttgacagtggataaaatctgaggtataaaagaggctgcacaaaataatttttgtctgctgtcttaacaggtctagcatatcaattttactcagtttttaaaaactcattaataaaatttggcctgtaccatcatctttgctgcaatcctcgtaacaaacaaggactggtgctttatgacagcagtgtcgggactggaagcccagttctccctctgattagctgtatggccttggatatgtggtttgacttctcctggcctcaggtttcctgaaaagtgaggggttgcattacatcagtgtttctcagcattttcaaagccaagctccctttgccaaaaattcaagtatgtccccacctctgcttcccctcctgccatctcccaagatttccttatacttctagtggataattattggctcttatgatccctcatacccctcccagctctagcattttgttattctgagcagatactgggtttgaaatcagtggaacaaaggtttttatctcactgtgtgaatagatgcagcttgctcctccttaaagctggaagggggcccttcccaaattcattcacacagaccaggagtcctgccttgtgcatgagcaaaacctggaagcttgtgttagaaatgcagaaacttgaccccaccccaaatggctgagtcaaaatctgcattttaacagtgcaggtgcttcacgtgcacatcagtttgagaaacgctgctgaccactgttttttaacctgtaggtggcaatattagtgggaagtatcagttcagtgggttacaaccagcgtttatttcttttaacgaaatatactaggaaagataacattagggtacattgtatttggtaaaggaaaatattgtttcacaaaacttacgtttcagttttatatgtctgtgcctatttatgtatataggatggagaggtcaggcaaaaagttaacttttgaggtggatcttggacgaaaatgttaaaaaaaaaacccagcaagccccattctcaggcagtatagcttagagacagccatctcttcccctctatctttattcacacacacaaacatgactgttcacacacgcaaacatgacacagaaatacacagattgaccaggcccagtggctcatgcctgtagtcccagcactttgaaaggctgaggcaggaggatctcttgaagctgagttcaagagcagcctgggcaacacaggcaataaagtaagatccagtctctacaaagaaagtttttatttatttatttatttatttatttgattagccagacgcgatggcatgctcctattgtcccagctacgtgggaggctgtgacaggaggattacttgagcccaggagtttgagggtgtggtgagccatgattgcactactgcattccagcccatgaggcagagcgagactctgtctcttaaaaaaataaaataagataaattaaaaaataaaaaaaagaaatacatagactgatatataatagaagagctgttctagtatcactcactttctctaattattcatatcagatataagctactagattttaccatgagaaagaaacaaaagtagacagtattgttgagttatattaattcaaaaaattttctcagtgatgtttatacacaaaattacaacattgtcagataagattttatgtttttaagttattattatggggagattgcaaatacttgttcagtttcctgtaagtacagataatgcttttttctctaggggctaaattgtgaaacccatggtactgcaaggtcattcacatgtcccgctggatctaagaataaataaataagttggttttgtgggagtattttttttataagcttactcatataagttttctaacttaatatttaatcacctaataatactttcagtaagtttgtttaatgtggagaaagtatgtttttgaatgggtattttccaccctgaggactttacaatctcagcggtaattcattacttacaagaaatactaagatacagactgtactgtagatagactttaaaaaacagctgggaggaagttgtcagccctggaatcctaaatctactggggtgaggcaggaaatgcattgcagaggtattctgaactgtcatgataaaagtaatgtttcacttcccctaggaagttttctttctttttttttttttttccatttattttgagtaaaaagtaaaggaagagtttgctcttgtccccttcacaaggctctgtgttgaggaagaaaactggcatggatctggaaattcaaggaggaggaaaacactgcacacctgcattcagaattcagaagaataattaattttgcacctgaagttgggtgggattttgtgtttactgcgttctaattactgtttgtttgggctgtaatttatttattgtgttgaattttcttttaaagtggttttggagctgttacagggtccttttatatagaagagattgaatagaatgtgaaatgtaactctttatactgattacacgttgaaacacaaagatggcaggctgctaagtaacatacagtctctatagatcttaagttactatggttatttcagctgtaatattgtttctaccttaaggatactctggtttcaggagctctttaagattgttttttgttttacatttgttcctttaggcttcagttgttgttttaggatagcttacatatttagaatattttcttagaatcacttatgactaagtcgggaatccatgctggcctaaggggcataggaaaatggtgccgcagtatgatgtctgttggtcttaagttgcacgatgtcacagaagttggccttggagtctgccagtttaacaaactcttgctccatttctctatttggcagacagacaagagtactaaaggtcctgactgggctctgtcttgatatgtcttatctggagatggcactgtccagcactatccagaattttagagtattttggagctggaaggaagcttagaaatcatccaggctaacctgcttatttcacacgtgaagacctgagccttccagggataatactcattcctgctcctggccaggacaaaacttgaatctggatattctaacttttccgttcaattcctcccccccaccgtcccccgcccgagatgtagtttcactcttgttgcccaggctggagtgcaatggtgcaatctcagctcactataacctctgcctcctgggttcagatgattttcctgcctcagcctcccaagtagctgggatgacaggcgcccaccaccacacctggctaatttttgcatttttagtagagacagggtttcaccatattggtcaggctggtctcgaactcccgacctcaggtgatccacctgccttggcctcccaaagtactaggattacaggcatgagccaccgtgcccagccaattttttttattattattgttataaacattatttttatagaaggaagggaagtgtttttctagttttgcattctccagaagccatgctcttcatttactgtgtttaaattcttttctacatgtgagattctggtaacctgtgacatcatgtccacattccaccttgctttttaggttcttcctactacctttttagtaccaccacactcctaccccaacatcaacttgtgggagcttcctctgaaccaaccagggtaattctctggcttttgtgaagaatgatccttccagtctatgtccttgttggtcactcctcttcttactctacccacctttctttcagatttgccattccttttattgtttttgtttgtttgtttgtttttgtttttgagacaaggtctcgctctgttacccaggctggagtgcagtggcacaatcacagctcactgcagccttgacctgggctcaagtgatcctcttgtctcagccttttcagtagctgggactacaggcgtgtgccaccaaattttttttgtagagtcagggtcctgctatgttattcaggttggtctcaaccccctgggctcaagtgatcctcccaccttggcctcccaaagtgctgggattacagatatgagccaccaccccttttattcttaatgacatgtcatttgtattcagctcactcagccatccaccccctctgtgaagccttcctcaacctttttgtcccctgtcttttcatcctccctcctccctgatcttcccttggttgaactctatttttagaaactgtactgtactacaccattataagcaatgcaattaagggtagctaaggctgggaacccactcttaaaagcttttcctttctgatgaatgcattctctggcaaggaaattttgaaatcattgccttagtccccttactttctcttttggccctctagttttgtggtgattaatttaaatttaatgtcttcagtctggtatcttcatattcacacacccataccccttataaatgctgttacaaaaactagatggaacaaattgcacaaaaactcttgtgtgtttcctggcccagagttctcagtgggcaacttggcgagtcgctggagttcttagaagaacttttgaaggaaatagaacaattgggctgataagcattcaggagcacagaaccaacccttaaaagatacttgaatgataaggaatctaatgtcttgatgggatctggaaggaaatctcagtcagtcatgttgtattcaacaatgcaagtcttaactttaattcttttatctgaagcataagaaaatgatggtttattcatgaacttaggtaaagagatttctatgtggagattgcagttttacatgcaaggatcaactttgatggatatctttgagaattaattgtgaaacatattgggaatttttatttttaggttttattggaatagtgaaggtaacatgggcccctctcctttgacaggcttaatccagccaaaaaaaaaatttaatactctattggtcagtttcacagtcttgagaagctgcaaagtttttttccaaacaaggaacagtgaagatatgagaaccagtttcattaactaattagctatgtgattttaagctttgatatccttgttatcaaatgggattaattgattatttccttaactccatggtatgtataagtgagacacactggctgtgtaaaggggccttactcttcattaatctagtagctatgtgttttttaacatcctggcctcaggcattccttctctgacctatccataggagcaactgattcctggccagtttctcacccctctccagttcacctcccacatttagttttgtttttccagttccctgtgccagaacttctctttccagccaccattcccagccctctctcagtcactcatatggccaaaaggaaacaaagaaaatgttctgactgtagtgataactggcccatgtgggggcccccctcattcctttttgataatttatttaaattgttaaattccttttacatcttgaaagcatacagagaggaactggtgtatggaaataagtgtagcagacattgtcttcacatagtactcagttcatttcaggcttgatcttatactgtttccctgtgaaaatgataatgttctgtaaacttctgtctgctttcaggagcaactgtagtgattattttgcttctggatgaaggaaatagttgatgtattaaaccaacctgctgtttgggatggtggtggtggtggtcgtggtggtggtggtgggtgtaggggcaacaggggtgggaatgataaccttcttgaactataaggatgaaaactttaaagaagacttgaagaaaattaaagggcaggtcctagctttcctttcccttcaaaacgtactagaattattagagaagtggctaagtaaggtgggggtgggaagaggaggacagcttcagctataagattggtcagagcactgttctttagcctattagtaataggaaggaaatgagacaatagaattttaaatgacaagtttttgttttaaaattatctttgctgcatagaaatctataacaatgtacatgattactaatgtattttagttcacatgtggttaattttgtaaatgacctttagatttgtattcatagaggagagactatttctctcttctctatagggggtgatgtgatagagagggagatagtattaccctgtgtatagttgccctgtgcctgttgttgatccttttagtgtaggaggcccagtggggcttctggcgggaaggaggcatcagtgttgtccatgcaggaagtgctccctgattgctatccatagaggaagtcctccctgaatgctgcccacacaggacgtgctctctgagtgctgtccatacgggaagttctctctgagtgctgatgaacgctcttcctgatggtgccaaaccactcgtgcaggaaaggctgagggtctaatacaaccacccctttattcacgagtgactttgttttctatccattttggcatgcaaattaagcccatataaatattatcaagaaaattgaattagcttgttttctttgcccttggagatagaagaatgtagtttgtttgcctgacctgataacaggaaaaattaggctagagaaggctgagagactactaggctcttttgggatgagtgggcacttagcatgcttatccagccaccaggtcccctaattagattgaatgtgtgtaaatagttgcaagcttcatccatagagggtcttttcacgttccaaggcagcttccgggttttgagaggcaaaatgtagaaggactaccagtgatgaaaatggaactggctaaaatattgtccctttttgtccctttgtaagctttttaaaaatttgtttatcatttgtgctgccaagacacctaatctaacgcaaagtgtaattgctgtaaatttatcagagttctgaagctgtaattaaaggcttgtcagtatttgcattttaatctatgaatgagggtttaatttttcactgttttaagtcacgtcatcctaaaatgttgactctaatgtttagcagtaatatgctgaagctttcagaagttgtttgtagaatttattctttaatgaaaagatttttataaagtagaatttttaaaactgatttttttaagagctaatctttgtttttttaatacttaacagactgtgtgttaattaagtcaacttaaaggcaccttttactttcttaaaaaacattaaaggcaccttttactttcttaaaaaacatatctgccaatggtattaagtatcaaatttcagagaagctggaatttggtaattagtcagcaaaaatgatgggcacagaaaatgaaagaatacaaatagagcattcaggacatagaaagtgttttggggtcccacgtagagtactgtttgaaggctctgctctggctttgttttctagcagacctgcgttcaaattctagccctgccaccttctaaatgtgtggccctggcacatggcctaaccttttttgagactcggtttcctaatctgcacaatgggagaacaataacctacctgcctgtctgattgaattaagtatggtaatgtatgtaaagtactcagcagagtctgtatctttagtagagacggggtttcaccatggtggccaggctggtctcgaactcctgactccgtgatccacccacctcggcctcccaaagtgctgggattacaggcgtgagccactgcgcccggcccagtttcagtgacttctaaaaacgtaatcttgggtttaaaaatttctgcaccagaaaattaaaaattgacaacctagaataattcaacgcttctctctttcagttttctttctctgtcttcagttagccccaagaaagaattgatttggaaataaaatttgaatttgaactttgttctgtataggattcaccagaggctagtagtcctcattgggtacatttaggaaccctcttctgcctgggatcagatgctgggagatttcattccctcacaggggaaacttaacaggggaagcagggaagcacaggctgtacctgcttcccacattgggaaaatactgcagtaaatatggatggccatcaaatttatattaaactggctctgtaaattcagatatgtaaatcatagctgtattttggccagaaatgaatacataaataaaaaaacctactactttcatgtctaaataatctccaactaagtcatacatccaaatgtttctttaattatacaagtgcatgcccgccactccctttccactcctggcaaaatcaaaggttcaagtgaatgcagtcttggaatgcagtctttaaaatgcctgatggttcatttacttcgtgttgatgtaatcccactaagaggtaggggcgggcctgatccacagcttcttactgacttctccaagtctcatcccagatgaccacatttcatcgcccaacagctacgctaaacatactgggtcctactgtgaaaacagtgtggcttgtgtcagggatggtttctgagacactaatcaaaggaggtttaagagaaaattcagtcctgtctagttctaatagctacaagttctctgcgtcaatcaaaggcttgggacaggaggcaggtgtgtgggctactttccagcacctctgttctcactgatgtgaaaaatagagtagggctggatggcaggtagcaactcagtggcttcagagaaggagcacaggctttgtggggcatggccagtgctctgaggtgccacctgtggcagagcaagtgtcagaatttggtcttagttttatatctagtaagtagttagcccctagagaaaaactagtggtttggagaaaggatatgagttcagctgctcattaagggcatgaatcaaatagatttggtaggatatgatctcaggctgcttttattttgggattaagcaataccgatgttcccagttcaagttcagccttcagtgaatagcatttctgcattgactattattgaccctttgctgctctccttctaaaagagaatctctttaaataaagtggtgtttggactcagatgatatctcagcaaggaacctgggcagtggaaggaagaatctgaaggatataggaccagaaaaaatggtaacatatctaaattaatggggccaggcacgatggctcatgcctgtaatcccagcactttgggaaaccgagttgagcggatcacctgaggtctggagttcaagaccagccaggtcaacatggtgaaaccctgtctctactaaaaatacaaaaattagccaggcatggtgttgtgcgtctgtaatcccagctcctcaggaggctgaggcaagagaatcactggaaaccgggaggtggagggttccggtgagccgagattgcaccactgcactccagcctgggtgacagagcgagactccatctcaaataataaaaaataaaaataaattaatgagatccccatatgttgagatattatggaattaggatgaccatggcagaagctgggtacaaaactaggaatctatagtgggcaacggaggttggtgacaaggtaaatgaggatatgcttattgtaaggggtctgcttctccaactttccactgtgggatttgatttgtctcctatagacatgcctgactttcttgtttgtgctggtaaaaaccaagccatgagatttgaaccttttgactgtctagtgactatttaattttggatgttcaaactgttcatgagtgatgtccttgagttagtacagtatatttatgatttagaaaatgtgaggtgaaaaaacgtccctgtcctggtgtgaaattgctgcgcgtttgctgtgaggacacttggggttacgtgcccttttgtctcaagctgagccatttaacttcctcaaagtcatgtgtgtggcactgggtcagagaactgtggtttctttcagtcggtgcacagagaattatctggtatgagtacaatttcagacattcttcctaggtggctgccgactgtaaaaccacactgagtcctttggttgcaggctttactttgagttgtggtgggtgctgcaagctgggaagttttccagcttggacaccattctcacaggggttaaatttcacaaggttagccagagcgaaaggcagcctgcctgggaatcttacccagatgtctcaatgaagtcgtgtgcctgtcttagaactaggtgagatcgtccttattggagtatctggattaaactctaactttcttgtacttgagaagtaattttttttaagagtcatcctaataaaattttaagcaactttcaatcaaacgttcttcagaatttgaaaaccttttcaaaagtctagtgatttctaaattactgtgtattaagatggtatcatctaacttcatgcacgttttgagtctcagatgtgttcctgaaaaatgtgtgaataaattaatgttacataaatttagtcacatttaaggtgcacatagagaacttttacttagtaaaccctattatcaattttatgttgaaggagagggcttttttaaagtagcatgaacagaccttttttaaagtgtaaattaaaatttataactcaaagtagcttaaagtaatctatatttaaatcttggtaacttcattttatttggtgtcagcctcctaatgctagcatactaaggctcctgatctttgttttccagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccgtaagtagtagttgttcctattattttagctgctaagtattttcttgatcatattatagagtgatatatactgcattataagagaagtttataagaagtatctgtggactctcagtgtcacaacaataaaatgggtttcaagttttaacttcttaaatactttttgagtcaatattaacatcatcagactggctacatatcaaaatgaattggagcattttctcaatagaatttgactttatgggcatatgagaagtaaaatatgaatttttttaaaaaaaacttatggctagatatttttcaggagttctcattttttgtggatgcacctctgagggccggtctatcctatgagaggaactttagctatcattgtttgtcagaaagattgttaaccatctaacgtcatactgactgtaagctcttaattccagctgggaccatattagtctgtccccattagcatccatagttttgtggtctggattgtacaccctcatcactttaggaataagaactcaattctgccctttcagagtgttctgaagggatgtgtgcatgtgcataaagttccaaagtaaatttgcattatatgctaatgttgtcaatgaatagaatataaatgtgcttctttgctgcaattacactaactcactaagtaagaaagcactaattttaaaacaaggagccagaagcactgtatagtgcaaagatcattgtgtaaggactgaaagcatcaaattgcatcgagctagaaaagcctacacatataagcgtactttttatttatcctaagacaataatggtcccttaaagagagaattttgcataactgcaatagaagacttttgctagagaatgtttcctattacctgaatttcaaaacatctgactgataacatctcatttctcttttcctggtcaaaatccagattcattacttcttatttttttaagaaaaaaaaattcaaaactaacttggtcagttatttccaaactggaactaaaagtaacatctggccttccatgggtgggggaaggagtgatggttgttgtgctgtgtttgttttgaaaggggaggggtgggacagcaggtggttgctcttcaggatctggagaactttctagaaggccatccctcccagcactctccctgtgtttttctcatgtccccctttttgatcagcccttgtggactttgactccagtccttggcttttggggcagtgaaataatgtcctgcactagcgactgctgtgaaagcaagcccagctcttggggtttgtcattgctggctggaggcagagggaaccctgccaggcacgccctgccctattgcagctgttcaagaccacaaataagccttttgctatctcctctgctgctggcctttcagtggcgttgtcttatgtttttgcagcgtaattacaggtagataagagcaccataaagtctaaggaactaaaaatatgactgtaagaagcagaagaatggacgtaactctcaaattcatgaggtgtaagagaagaggagaggaattcaaaaaacaaattgttcttcagctagtgttgaattatgtagggtgagttttgatgtcaaggagacagttaaccctaaaatactggagtaatgccatgttttatatacagtaaatatgtacttgaaaaattgagtcagtaatttttttattgaactgaatcatattacaaatgtggcagaagaacattttatcatttttcctagaatattcatttcttttttgttgttctctttgacatgtatggattttcttaacgtgtgtaaacattactctccttgctattatcaatagcagcaataacgctttgcagccctcactctctcccgtcacttgcaaaggaaggctcttgtacaatcccaggttttatactgaagtctgataatagtcttcttgatatgtaccatgcagaggcaaaacataacaataacagaagagtctatctcaaaatttgctggaaacttcattccatttaacacagagaatctagtaaataccaaatttgacttgctgagagtttcgtgccttagaatgtagagaaagcacaaaagagcattcctgttctgaacttaattgtttccaataaagaagagctagttggtgacatagaagtgacaagaaccttatgaggaagggactcatgctagagcttaaaaaaccactggacataattagagatttttagaaaagtaggtatcagaaacatctcagaaaaaaagatataaatccatacctctaaaaaagaaaagaaatacttagaactaaaaatttagcactgtaattacaaattgacctggtgaggctgaattaggggggtaacgaaggaaacaaatgatttggctctgcagggggcttggatattttagaggattatttaacagaaagatggggacaagccaggaatgtttatcatggtggcccagttccatacaaacagtgcatgaagtccaaaggcaagtatgacatgaagattttaaaaactagagaggaaaacaaaaaatattttttaaaaactgtgtttgaagtagaacatagagatgctgtaatgttagaggcggttacagtggaaaagcagatgttgtgatattgagatgacagggaaaggcagccccacccagactcgaaagagggagtcatgaccctggaaagtgtagatcaccctggctaagaggaggaggcatgtggggtaggagctcagactggaagccaactagcctaagttcctgatacagggtggtgacagtgctgtcaggtaatctggattgaaaagagataaatttcctagaaacatttaatgaaagatgtcaaccagctctagttaacttctaaattgtgaaacacgtacgaggaatcttggaaccttgactgctgtaggctgctgcaactttgctccctatttctaagaggttatctattcacaaagaagatatcagtacagttaaccagcaagttcaggaaatggaacaatccaggtagccaaaaggattcatctactatcccttggcctaattctcttccttctctgaaatcaagccaaacaaacactctgcttgaccgtgcttatctgtgtggtctatttgtcatataaatatttgccaatgcaatatttctctcattgagacttctcaggcagactgtttagatggatgaattgagggctcatgttgtgtccattttcttgacatcttagccatttttattttgccttcagactttcaactgaaactgcactagcatcttaaatatctcttattttccctagctttttttttcactctcatccctctcctgctcaactctctgcccttctggtttctgttttcttggctgcctcctccatagtcccatcctctgatagggttattctccactctttctactttcctgcacattttccatttgaatattttatttgttttatttttacctcatactcaacctcaaattcaaaatatcctttctctcaacactgtctcttttccaaatttactttcttaaacatgaagctttaggaaagctttaggagtcagcagctccttctctttgtccctttgtcactaagttttgtggattcttctttggcccttcttccttcttctccagcccttcttccttcttctccctaccagaagaaccggctgactcctccctccctacagtgtgacaggagaaccatttgctcctctactacctcccatccggtgcctcccctccccatctctattcagcaaggccaggtccaaacgctgtttgcctcctttgtgcttggaccacaccagtaactctcctctttatttctaaatttttatgtattgccagctcataatcagcatcttatttccatatagttctgttctccaagtgcctgttacattacttagccacatgtctgtgacagtacatgatgctaacagcgtatcatcttaaacagatttgtcacccagactacaaaagcgttgtagtcaggattgctgggtttggtatcccagagttacctaaaagtgctaggcaagttctgaattctcagtcaacagactgtaaaataggtcaaataacgctattatcaaaaattgtgataagcattaaatcaaataatgtaagtaaaagagctggtccagagcctacaacacaattgtctctgaacaaatattagtatctcttgtttcttccatccttgaaattctgctagaataagcttaatttatattgaattgtacatttaaaacaaaggaggaagaagctctaccagattttgattttgaaagctgagaaagccagggaagtagcttaatgctaacataacctccaacctcctcttccttgaggctttttttttgggaggaaggggtacaggcatacctcgttttactgtgctttgcagatactgcttttaaaaaaaaatacaaattgaaggtttgtagcaaccctgcattgggcaagtctattggcatttttccaatagcatatgctcactttatgtctctgcgtcacattttggtaattttcactatatttcagatttcttcatcattattatgtctgttgtggtgatctgtgattagtgatctttaatgttcattgttttggggcaccacaaaccattcccatataggacttaatcaataaatgttatgtgtgttctgactgctccactggctggtcattccccttctgtctccttctcctccatttttctctgagatataatattgaaattaggccaaataatagccctgcagtggcctccaagtgttcaagtgaaaggaagaatctcccatctatcactttaaattaaaaccttttaaaatcaaaattaagcttagtgagaaaggcatgccaaatgccgagacaggccgaaagctaggtctcttgcaccaaacagcccgcaaaggaaaagttgaaggaaattcagagtgccactccagtgaacaaatgaataagaaagcaaaacgtccttattgctgatgtggagaaaatttgagtgatctgaataggagatcaaaccacctacaacattcccttaagccaaagcctaatccagagcaagaccctaattctttaactctgtgaaggctgagagaagtgagccttctctcttcaatgctatgaaacagcattgcatgctatagagaaatctttcatgaaaggaagagtccattgatgcagcaatcttcattgttgtcttattttaagaaattgccacagctatcccatccttcagccgccaccactctgatcagtcagcagccatcagcagcaaggcaaaatccttaaccaatgaaaaggttacaacttaggctgaaagctcagatgattgttaacacttttttataataaaatattttttaagagattggggtctcactgtgttgcccaggctggcgtgcagtggctattctcaagcatgattgtagtgcactgcagccttgaactcctgggctcaagtgattctgcctcagccttctgagtagctggagttacaggtgtgcaccactgtgcctggctaataaagtatttttaaattacggtatgcacaccgggcttttttagacataatgttattacataataagctacaatatagtgtaaacataacttttacatatgcttgggaaacaaaaaaattcgtttgacttgttttattgcaatactcgctgtatggcagcggtctggaaccaaacctgcaatgtctctgagatatgcctgtgtttgcagaagaattgttgcagccacatgctacccacccctgattattgctcatcataataattactgtggcatgtgaaatattccattatgtccagccttttttaaagatttacaaatagcataggtgtgcaagatttggtaatggctctccctgatttgtagtggagtaaatgtctgagagtctctgttggccaaggccgggtatcttaaaggttgctgtggtattgacatcatatgcagagttctagataactcagtgtagcagtaacttattttaatggaaaaaccagtgacttgatattaaaagaaaaatctctactctttgcgtcttttacagacagcccttccttcattcctaaaccaattcttgattcagtaaatttttaacttgtttccaagtgcagtaaaacatatgactttaatagaaatgtgaaattaaatctagcttatgatatgatagcctgttactatttaaaatgaaatatttttgaaatgtaatctgtttcctcatttataatattcaatacatatttattttctgtccctatgttttattttctctgtaagttttccttgtgcttttgaacacagcacagatcttaaaaggtgaaacagtaaagcaagacaggtcagcagagagacaggatagtattatcatcaatgtggtgtactgggagaagccagaagaaagctaaccttgatgtgaaggaattggggtagctttcaggaaggagatgacatctcagtcttaaaggacaacaaaaatttcatgaagggtgaaagcaatagtatcctccaggcatcaagaagtgcccaagaggtgtgagaacccttggatgtttaaaaaggcacagaaagggcttcttggtgcagagctggcactcggcagttgttagttacccggggttcccatgacggggtgtcagtgggtgtaaaggaatatgaggctggaggtgtaggttgggggcatattgttagcatcttgactaagacagttaacgctaacattttagtttggagtttattctttagttacagagaaaaagttagctgttggagtagaagagtagcataatgaatttctctcctttctttctgtctctctcagatgctaattttgacaaaagtaggaagagtggattggagaaggcaaggactctcataggtgagagggaagcctctagttgcattaactgggagagagcacacatgaaaggcaccgacttttagtggttctctcttagtcccaaaactccagcatctccctgtgttccccagatttgaccatgcttttatttttgttatctacaaatagggcccaatgaaccacttgcttttctgaaaccactagctagtttgttgaatgctgatttaaattattttttgagacagagtctcactctgttgcctaggctggagtgcagtggtgtgatcagctcactgcaacctctgtctcccgggttcaagcgattctcctgcctcagcctcccaagtagctgggatttaaaagaatattttaagttattcttactgtcataagaaattagggcaactaacaggagaaggacaacttgaaatggttatattcattatttgtacatctccattgatctctgtaatactaagatttcttaagcaatccatctgctaaaagatgttttctctccaccctgaaattaaataatcatcgcttttattacaaaatgattaggctacctttagggtaaaatttgaaagtgaaggcattctaataaattaaatagttttttgatgcttaatcagcttttaccctattatgaagttaccttcaacatttactctgaaaggagcaatgggcccaacagacccagtgttttgaaatctctatgtaaataggaaatcctttggaatgtatagaaattacctgaaataggagagcccttattttcaatacaaaagaatgatcctatgatgaggtaggaaaatcattccacccaggagggactcagttctcacttttaaattgaagagagaattttgagttaggggacccaaggtcaaatgacttgactcagtccaaaaagcctgaacatacccttagttattacatttattttagaaagaaagagacacacatgcttcacatgtattctacacaggagtattcagattgctatgcagatgtgacagacatagaccaaaggtttcattgcctgcattcggcatcattctaaagcaacgcctctgagtcttagaaacccgaagctcttcgtgtagggttaaattagaggctaatataaggaaatagcttctctttaagatataatttaccctttatgtgttatcttccaagcaaattgaagaactgtcttactgctggtgatggtgatagtggttatggtgtatttaactcacaggcattacaataaaatatccacagatgattttttctttggtagctactacatctcagataattgagattaggacatattgagctatattatattgtattgtagttgtttgaattttctgttttttttaaaatggtattttacaaagctactgaaatctgtatctagtgaatttttatttcttatatttctttgagggtcgaggaaagaaaaataaaagtaaacaaaaacatagggttgtgggcaaatagttcttctctcattaagtgtgtcctttaaaaattaaaaaaataaaaactaatctttattgactggtaaaaaatgttttagtcttcccaaaaagtgaaaattgggttaaagtgatgagttttctgcagttacttatagaaaatgcattccatttttgtgtctattactattatatagcttcttgcacccatttacaaattttgttttataaatcataggatttcttttgatttccaaatgtttttgttccagaaaacaactcatttttatcttctcaagttctttattcattgatctagaagattctccatacataaaatattaataacagtattttctggaacttggcttgcttctgttattgctagcataataggatgacacataataaatgacacaatgagggcttagaccaaggaacttgagcattttgctgaaaagtgtgatctatacgatgtgcagtttacagaatttgtcccatcgtaaaaaggaatgccaatctgctaagtcaaaatgttgagtcactgattgtaactcaattctctcatcatggacagtattccagtaaggttccatgttgaagagtttaacacatgatgcatttgagactgagcaaaacacagaaccttcgcaatcatcccccgtcccctgcccaataaatggacaccaaagcagagttgagagcttaagagcaattgtgtaattaactgaatcttcttcccattcatctcttgggtaagcgaaatatagaatccttttctttttcatgttagttgcatcattacttctcttggtttagaagattgttggcactttaagtaatactttatgtacagtacttctttgacataccaaggtatgtagtctgaagacttttggaaatccccagatttcacagaaataattttagcatcacagaaaaagaaaatcccatgaaataaatacctgcttcccaatagagaaccatctcatacctctgtgtatactttcttcgattttatcattagaactgtcagtcggtttgtcttcttagggggtggcagttttcaaaaattaacacagtgtttaatcccctcttgaaaattgctgtgtacacaattagaacaaaaccttattgaaatatggaccttaggtaatgggctatgcttcttcactggcttcataacgtgctctcctctgtgagagtatccacaattcaaatgtgtgctgttgcagtattaagcataactgcacgtcagggaattttaatgtcatcctgagttgttgaaacctcaaatattaattattaccaagtacctacttcatacatgcatttgatattttgacagaaaatctcagttatgtctattttctaatgtatccttagtataaaatctgctggtaagcatggatatttagaaatttagccaatcttcgttattgtcagttgacctttttctttagggtatctttttgttactcctaggcatgataaagagccattctgtcttctaatgcccaaatactgcacacaagctgttggcaaacccgttttaatatcagccttagcagaagttaattggggagccggcactggaaataattatcataaccataagaatttttttaaaaatcaccctttccttctctgtgattgaagatagtatttacatcctttccttgttcctttatatgagccttggatttctgtagcagcagcttggggatatttaaccattatacgaaggtgaaagtactgtcatcaggaataaaagcctctaaaatctttatttggcagttgtgcttggttttatgtagaatttccttattgagttactgttgaatctcagaaatgtataacttttcccttcatctttagttcataataaatgcatgtgaaaaaaaattctgtgtaatgtgtaaacatctaaataatgctagcagccaaaaattgtctaatgcttgttgtctcccgataactatgccaagtattttattatttaacccttagaagagttttatgagcaaaattatcatctctaattttctgtcttagtctgttatctgctgctataatagaataccacaaattaggtaatttataaaggaaagaagttaatttggctatggttctggaggctggaaagtccaagagcatgatgttggcatcaggtgagggccttcttgctgcttcataacatggaggaagaacaaaatgaagttgaaagatatttctttttcttattgcttaggataatacagctgataatggtggagccagaacttaagaatggacagtctgactccagagctcatcctctgaaccactgtgctttctgcctctccaagtgtaccctgaatgctactttattaacttcctctttacctcatcagcacccttgcttcctcatcagcaccacaaactacaatagactaatttctccaggaccctaagagatattgggccatgatagatttaacaagattttattagaaaaagcaccttttcttatgtccacttgaatagccaataaaataaaaaactcaaaataaaggcaggaggatagaggaggaacctgtctttcctgacatctagcaaaataatcccttttagcatagctggtcatatgaaactcagctcctggttagctgtctaatgtgcagctccccaagattacacagcatagagaaggtatccaacttgtcatttgctaggcgcctgagagggtttgtgcatatatgaaaagaaacaattttttaggggtcactgtcttacaagtcctaatactgctttagaaaataatgggcatataagaacattatagttttgctgtaagtataaatctgattaaaacataagatcaagacacttcggggagaagtgaatggtgaatcccattttttttgtaatttaacaaatatttattagacattatgccagtgatttttctagatactgcactgagacattttccacctttaaggaggtgtagaaaatgaacttcacacataatgtagatcagaatgtgagagatagaaagttactactgagattacaaagtagggagtgattgcatgtgatggggggcatcaggcaaagtttggcatttgaatgaatcttcaggatgagctaggcagccccaccccagcactgaagacaggactagcttgcctacctgccctgtctggtattcactgatgccatgatggggggaatctttaacaccagaagaggacttgtacttcactgagaaggtgggtgatacatgctgccccaaggtttgtccttgatagaatgtgggccagagggagggtagaggaagaatgtggttcaaagatgagtataagatttggagtcttaagaaactgggaatttgatatcattaacaaatatagggatcaggagaaagagtttgtttttattcttacctggaaattctcatctactctcaggggaaactgcaaattgagtgcctgtttgctttatgagttagtgtacttttggtgtggctattaaacagaaagaagtaatgcatgaattccaggctgttgaatcttcagtgcagaagagagactagtaattaaacattctgtcagctgaaacaggtgttctgtttgtttattactcactgattatttatagtggattcgaaactctcagtcgagatagcctgtatggtcagcagtgatctccaatacttaattattttcttagatgtttatactttgttttaggtgtataaattatttgaaaagttgttttttatttaataaagtgtttgcaactcccttgattagaattgtttgacttcaaactggagacttttgagacgaaatttcgtgagagagccgtggaactgagtgggaggaaaggaagatgagtttccataaatggtgtatctagaattagcgagaaagtagactcacagcacaaacaatcctgaccaagtttatggtgctgccagggcacatggactttctctcctcttgcctgtctatgcgcttactaacttggccatgccagacttaacgcttgtctaaattgcttaaggggccaggaccacttgtctccctcattttttctttgtgccatagcatcttcttgcctctgttaagtgtcacatgttaataaaggaatctgcatgggagatcagcatgtgtttgagtatcagcatttgcatgtacagctttagatttccagatttacaaaggacactttcctgcagcataaggactagttctttaaagatgaaacaaagagacattcatttgtggtcctcgaaacaaattgggcctgctagcccatttggacaggagcactgatgctttccaagtgggcttccaaagtgtttcatcttcaccttcaaagccaggccataaattgtggaattgttttcactgtcccttaatatgaggcatagcttttgctccaatgcttaacctatttcaatgcccctgtgtagctggctagataatattttgtttcttagattttcctccaccacccctattcattacccttagtttaagtttgacagcatgcaattaccttttaaaagccatacttatttaattttggctctgatttttgaggcacaagaatttgagcatttatttaattaaaaagtttattgaacttttttcatctctagtctgaattacagaactttacatctcttctagtcaagtggctgttaacgaggaacacgcaccagaatcaaaatttacatgtcaggtccttctatagattcaggagtcagaagacagagagatacttaatggagaaacagcataacaggcacttatactaaagagcacaggctcagagctttccacctggccccgcctcttgtttgagcaaatttctcaacctctctgtgccccagtttccttacctataaagtcgggataatcataatatctgcaacgtagggttcttgtagggactaagtgggttaatgtcaagtgctctgaacacttttggcatgtattaatgttactgctactgggaagcttttttaaagcttctaatggtcaatcccagttgagagcttgatttcgtctttttatgttataactgaaaaagctgaggctcagggaaggttaaatgacctttttggagtcacaaaactaggaaggggcaggcttgggaaaagagtccatatctcctgaaatatccactcttcttgatttgccactttacttttcacaagtgaatgttacacttaactctgctctttatcatgaggatgaaatatctgtacttcagtttcttgccaaagaacttaactttgtcctctccactgggcaggtcttgacacaagctcttcgaagaaataagatttatgaagaattgtatgaaggatttggagtttctttgttcatcacagagcttcccaacttggcagacagaggaaaggataatatttgtattatgttatattggcattgaattagattatgttggattgccacctatggatgaggctggtcattgctggaggtgacaggccccacccagtctccaagggttgacagaatcagcatctcctgacatgtttaagagaactagtccagcaagtgtagttttaaaaaaatgttcaacaaaactatatacaaaaatatttataagtggtatttttaattatatgctttataagtacaaatttacatttataaacttatcagggagaacagtgagacagttttgataaactcaaaaatgtggataacagttgcagaacagtatcagtaacatacctaatttatttctgtattttgttttggttgtatgacatttggaaaatccttatgcagctgcaaaaggttttaatttttaacaagctcattttgtcttgatatccccttgaattaatcttaatagaaactggaaataatttttttgcctcaacattgaattcataataatacagctattcacgtgcctcataatagatataaaagtcagaccagaagcacccaaaacttagcatcagtaccagtcaatgatgtcactttatcatgatgcaacgcggtaggcactttagtattatacagctgtctattagatcatggtgagggtgtgtgccaactagttgtacctgctcttggcctggcatttgtttgagcatgatggatgtgtaggtcatttgtacagttttatatgaacggacatgtgcagacttgaatttccaaaagaataccaacgcagagttacaactttcctaatcggtgactcacttatacaaagagatagcaggagatacatttgtctagtgtcagcacttgaagcaacttaatgtagatgtggtcatcagtaagttaacatttgttgtgctatatatttgcctgcatttcctattatttgtttttgtacttaaaggctaagaagtctttaaatacaaaatattcatatggaaaattgatggaacccctaaagtacttcttcagagcctaatttggtagccactgttccaaggaatgtgccatttatccctggatgcagcaatattatcagaaagccttgtgcattaaccacatagctatttgcccttgtagaattccagtacttgggccccaggtgatcccttgaccgtgcattgcacatagagtatggcttttaggaggaaccacaggaagacgctccttccggcattagagctgggaaaaacagaacttctcttaagcccaggacctggttttactctaatgaatactcaatttcgtaatgttgtatttccctatgttcactactaagaagttatgagtcagctttgcatccaacattagcagctctgcaggatctcactttcaggttcatgtgtctgtggaaaaactactcctgggttgattttttcttcacttaccttgaactttatatctatttttgtcttgtggtgttgcatatatttttgccagcagcctcaaactttttggggaaagaggtagaagcaaatgtttctcatgctctctgtttgactacccttaaaatcacagaaggaacattgcttagtcaccttcttttttcagtttgtatagcaatcgttatttttattatcaaagtggctcacttgggaatgctgatattttggatatctaatgcatttccattggaaaggagaatctggtcccttctcttaatggccctgcaaagaaattagtggatgcacaacagtttcctggactgtcagtaaacattaaagtcagcaaatactcaaaatcatgatttctagcaacttttagcttgattgacatctttgttgaaagttttttaaaatgtgatttttcttatacccattcttggtaggaatttactttggcattgaattaattgccccgcctttaattatttgaagacaggaaacattcagcaacttgcctggatatgtgtttcatatgcagaggtttgtattacctgtattttgcctgcttaataaatcacaatttaaaagtattggttctgacttttaaacctcctgtgaggtatgcatctgcttcattctctcttttttttttattatttattatactttaagttctagggtacatgtacacaatgtgcaggtttgttacatatgtatatatgtgccatgtttgtgtgctgcacccattaacttgtcatttacattaggtatatctcctaatgctattccctcccccctccccctaccccacgacaggccccggtgtgtggtgttccccttcctgtgtccaagtgttctcattgttcagttcccacctatgagtgagaacatgcggtgtttggttttttgtccttgagatagtttgctgagcatgatggtttccagcttcatccatgtccctacaaaggacatgaacttatccttttttatggcgaataggaacacttttacactgttggtgggactgtaaactagttcaaccattgtggaagacagtgtggcgattcctcaaggatctagaaatagaaataccatttgacccagccatcccattactgggtatatacccaaaggattctaaatcatgctgctataaagacacatgcacacgtttgtttattgcagcactattcacaatagcaaagacttggaaccaacccaaatgtccaacaatgatagactggattaagaaaatgtggcacatatacaccatggaatactatgcagccgtctgcttcattctctacctgagttcctgataaacctcttgataaattcccagccttgagcatgaaggaacattcttctggaagcagttcatcatgccattgttgttcattcctttcttttcctcctctcccctgctttcctttcaatgtctgcctaacagtaccagcgtttccttggcttgtgtagacagtaatgatatatctgttgtgagtctttctggattgcttttatttctttacagggctgttcatttgtacctcattgttattacacagatgtaatggtttttctgacctctgatactgctagaccaagatgtactccatgggtcccaccactgacaaatgtccagggcagaagaattttaataccacattgaggagaaatgaggagatgcttcctaaatgatcttggatgggagcagattaggcagtcttccattctccacttgtaatgctgttagtgtttaaaacttccatcagcagggtcctcggagtgctgctgccacactgacacggttgccaggctgtcttacgatggctacaagaccttatattttctgcctcctctccccataacttctctgactttatctccccttactgtcctccatcacttcacttcagccatagtggactccttggtgtttcttaagtgcaccaggccttccacgtgccttacaccaggttttcctcctctgcctgcactgctcctcccctggatccttctgacttgttccttcatatccttcaggaccttgctcatgtcaccttctccatcagcttacttcagccaccctttaaaaaattgtaatctgcctccacttcacctgggcattctcaatctcaacccccctccacccccccaccccgctttgcttgtgctattgtcataataccatcccctaacatattgtataatttgcttatttttgcttattataagcaaaatcagtaaatatttttgaatgaaagaataaaatgctgctttatatggcacaaaggaaggctgggtatgagcccaaatccctaattgcggaggcatttttatcttgatagccaaactcatgacctattcctggggtacatatttctctccctccctcccttcctttctctctctctctctctctctctctctctttctgtctctgagatgagcaactaaaatgtagtgaatgtggattactcagtgctgggaaaggctgtgttgaaaatgaaggctctaggatttgccacaagaacaaactttatcctcccacatgatacatattcttctctatcatcctggatttttttcatctatttattgttatgtgtatttctgtaacacatcaagtcatttttgtaatgaagcaggctacgaataaatacatctattaagcagtggtaaataatcagatacttttagcctctggctcttcattggtgacatcagcaaattaaaccagagatcagaaataaacaagcaagtggccatgtaccacctcatttcctctctcctggcagaattgctaataaatagatgagaatactctttcctactgtgcctggctgagcctcggaatctttccctatacaatacaaccactagtaactcatcagagtgggcatgcaagaggaaagctatttgaaactcttggcagattcctttctgctctgtgatccaaaaaaggagaaataaaggatttctcttcatctttctaaggtcctggaaccttgcttgtttcagattttttggtattaaatatccctctataaaacattaataaactcaagtaatcattaactgggctgtcttccagtatagtcaagaaataagttatactaattcatcaagttttcagattatagagttttaccttatatgtcttatatgaatcgtcaattttcaaagcaataggatgcattgagatacattttcttatcatcattcacattacatttatcacttgcattccagactcatcattaggaccaattaccattgaattatgcttgtgctgaagagctgcttatgatagatttcttgtcaatcaggtgcttcatctctaggtcatatgctgtatttgatcagtgcaggttgatagtcattagacaagctcttcaggctcagccatcaatgagaagcacttgaaacagtcagcctctgtgaaagccatttcattcctgcctcatttttgcctttgtcctgtgttctttgctgttgattttttacctttgccttctagggtatgtctctttgtaagctaccctaagtcctttctaaaacaagacaggctgtaatatgtatacatgctacatacataaatacacatacacacatacctgcacataagcatttatgtttgaatgtgtagatgggtaaatgtcatttttattcttgtaagtaaatgaaaaacatcaaccagaaacttttcattcctctggtgaagaggatattttgaatgagacacctttaaaataccttgttggggagcatttgggatatcaaatgcatatactcttttgggaaaataaatccagtattggcttggggtggatttatataatggtttactttctcactatgttttaggtgcaatacatagcatcctttaattggatcacaattaggaaaactttttccggtaataaaattagagataatcactgtgcaggccattgttctgttctagaatggtcaaagctcggaaataccactcctgcctattttccatgcattagacggtgcttaatttgttgctgtttattttagcctcatttctcaatcatggactctgaattaagattgaaataatgaatatgaaagcactaagtaataaagcactctattcaaacagaagattaaggatatcagggcttctactggtgtgttattgggctagatttgagacattgcccttgaagtgcagcaaaattccttagtctaaaaatgttatgaatcataatatatatgaaggtacttttgtatggtgttagagatcagtaaaaatgtaattctcaaaatgacaacttccacagatagaaattggtagacagaccttcaggtgatttcacccatagtattcagggctggtttatactggtacttgttgaccttcgatgagaaaactgattagttctactactgtcttgtgttcaccaccatttgcttagaataattttccagttctgtagtcttacttgatctttggcatcactggaattcattattgtggctgtctcttacatcactggatatcacactgatgctgtaagaggtgataaaagtaaggtttaagatggtgtttaaataaacatagtatggtgttataaccattaccttaaaatttgtttgagaatcttgtgttttggcaaggttgtatttgctttggtggtaaagttgtttgaaatgtcttgtgagcagttatgttgaatttttcactgaaactttaaaccatttgaattcgtacatctacagaggcaatagaatacagctttagcattctaagcaattaattgccggcccttagtgaaaaaaaagaaaaaagccatggtcccacctctgcattaatactcaaagtggatttttttcccctttagttcaaagtcattcatttttctgatattcatttcttacatgatttaagttaaagctgaaagactctgacagtggttttatacctatttttttcactggtgataagaaaatatctttttttcttagtactgctagaaaaggaaacaatgaagtttctttcataatcattcttttcaaagtttgctttttgagcagaacttccttgtaatattatatttagtttcaatttatcagggaatccaaatgaaaaataaggttttctttggtgtattttggaaggtagctttaagaaattttgttcataactctatagtgtttagaggattttgttattgtctaagactgctaatttctgttcttcagtttttccattccattgcattgccttcagagtcttaagttttaggaaggcttaaaacaattgaaagattcagtcttaggattaatcattgagagaattaatatgtagcacctattgcttgctggctgtcttcatcctaaccccattcctgcattggttaatgtatcttcaggaggagtggacggatgatggaagcttttccagttttacaacatgagaactcagatcaatttaggttcactttttaaatggatttaaaggagatttggatattttctgtgatttgtctctattttaaggatatgttctaattctcattttataccattttgataaacaaaatccctccttagaaagacaggaaagcaggccactcttctgaaagaatgcccaggctgccccagggccccatgcagcaccaggagaccccatgaactgctgcccactttgcttagtgtttgtgtcatacaaggagttaaatacttttagcatcacttctggactggcatattcatgttaaagagtacattcctacggtcggtaatatcgcagcccatctctgataactgtaaagacccagaacaaaagaggtcaagagccaaagctctagctaaaagtttttttaagaaggggcatacctgggagaaattcagtggttgagaaaaccctaaagaccggagaaggcttccaagatttggggaaaatttgtttatcaagtaattcaacaaatattattgagagtgcctactatgccgggttctgggaagtgaaaagtgaagttactaacgctccttcactctgaacagccattgtctgcttgcaataccaattttgacaccatactttgtatagcctggactgttacagtggtatccaaccttctttaagttttaaatctagcgttataaggaaagattgttcccactactcaccacccacttctgaagtgatcatcaaaatatttaacagttagaaaacagactctagccaatcagaacaagcactggaaaactgaatattatccccattctgccctcccatggggaacttctctgacatttttcaatgggattttaagggatatgatttatgtgagctgtcttctcaaagaataagtaaaagacaaagcatatgacttggagtcagtttagaaacagatgacctgacttcggaccttggacctaccagttaccagcaagggttgcttacaagccagtctttaagaatgcactgaatatttgcgtttctgtttctttatctttaaaatagaaatgctgttacatggaatatgaatttctaatctctacttcaggtctcctcactttcatcaggtgtgggcggtttcaggtgccacttgaactccacagtggtccctgaaacactactagcctccccgtataggcttaacttcctgcctttaaatgttagtaactcaccctttcctccctcacctttattttcagctgctctctataaactgatcatttctggtatgaaaatgtctggtatagccctcttttctgggctgttgtcttgtttttctgtctactagtctctaggactcgagtgccctctgagttactctacttagcattgtgggtttcacaataggaagaaaaagagtttccagtttcatttcttctgaaattaccatgtaatcttgggcaaatttgcctgagacttggtgtcctttcttgtaaaacaggcgtaaaatagtaacattctaagcttatttgtaggagatacatagaggtatgtatcctatcatgtagaccaccaaacctaagagactcatagctagaaatgtctattaatatatctttatcattatattttaagttaaagatgatacgtcacttttttagtctggggagttattgtatactaggtccagtttaataagcttttattgggcatctactatgtgtccagcactgtgctaaatggtgggatgatatgaagcccaaccagcagagccccccatagctcatggtacctaacacccatctgtactgtaataatgggttttcttctctgttctctctagtgtctgaactgaatgctaacacttagtaggcactcagtaaatagttgcaaaatgaacacagttgtaaatgttttgccatttccatgcacttggctcttgaaaattaaaatttgacctccttttgaataatttacacctttatagaaaccattggtgtttccatatactgttggagtcgtagactaaagtgttcattaagaatgaaacaacttctagaaataacaacaacaaaaaacaaaagaaaaatgaagtgttcatcaaggcaggcaaaacatcatagatagggaatgggatgcaaaaatatatttgcccatcttctgcctttgggtgtggctccacggaaggtatctcagaaagttaagtgcttaatcttggttaaaacttctagaggaataaaccactgtctttcttagtaatacctgctgttccccccagttgctgcttacaagttacctcttttgccttctttactggctattgcgaggactatgtggcatcgttagttttacaattaaaatatcagaagtgggttgttttaccgatttcatcttgacttttaaaaaatataactttcaggttaaaagaaagaaaatgtccatttaaaaggtagcagctgctttcctaatgacaagttgttcagattcctaattacttttcatatctttaatcttgcacaccagtgaaaaataacttattcatatcttttgaagatgttatatttggccaacaaagagtaggataggaaaatatgtttatttaaaacatatttgcgattcctatgatattgttttaaatgttagcctaatttcattcagtaaattcagtttcttgtagctcatgttcttgaactttgaaaaatatattatgcaatttgctaaattaataacgcatcaaaagtagaatagaatatattgtggtcttgccttctggatagtttatttttaggttttaaaaaggggctccactctaattattctcctaatggcagaacaagtgctataaaatagtattttacaatcacagatgcctcataagaagccattttatatcgtctttactcccattttctctggttgataattaaattttactccaggtgactcacagcagaggtcagaacttcctataatggcaataatgcacattaataactgtgtggtagccagtaacatgatccttaattagaaccagtaatccgataggcttaataatgaaacaggaggccccactgaacttgttccattttcatatgcagacccaggacaaagccatggctgtaatttggctacaataagacagcaaaatgtggctcagtgctgctgtattgctaactaaaatcagtctgtcattttaatgtagacttcttgtttttaattttttaaaaatttatgacattccaagagaatttctgaaatgcaaatcagccatctttgaacatacaagtaatgcacactctgcctttatttttagaaatattcactagaagtctgattctgtttgcctgagattcagtgaaaagaggaatctttgagaactctgcagttgcccctccttgggtgtagcatttcactgaagtgagcctttttgcccagctggcagtggtcttcttctggatgtggtctgtaatggaagtgttgcctgggatctcagtttgtcttatcagtaagtttccatgagctccatgccatggtggcttcataggtcccttattccagttcatgggagataattgttttttcttttctttctttttgtttttgtttgtttttgaggcagtctcactcttgttgcccaggctggaatgcgatggcatgatctcagctcactgcaacctccgctttccgggttcaaatgattcttctgcctcagcctcccaagtaactaggattacaagcgcctgccaccgtacccggctattttttttttttttttttttgtattttgtatttttagtagagatgggatttcaccatgttagccagtctggtctcaaaactcctgacctcacgtgatccgcccacctcggcctccctaagtgctgggattacaggcgtgagccacctcacccagccaataattattttttcacatatcatttggacatccctaagtttcactggtaatggggtaatggcaatctaacatttttcacacatatatatatatataaagtctgttgattttcctttctgaaatgctaacttgatatgtgcctcttaaggactttgacatgagcagatgatatggatgcttgcttccgggtggagtgagtgtctgtctgacctctagaatatgctctatttctgctgtgactctaacttagtcttaagaggagacttgactgtttgaacatttaaatactctaaatagtccactggcactattaacaaataaatataatggcttttaaaaataagcttttcttattttgcattacatgtgttacatctttcagttactgtaaggaacacaagtgaatagctgcttagattatttatgtttaaaattttatgggaacatagatttagattattggatactcaaaacacatgcttctcagaagatgatttttgtctcccagtttaatgatattatgccaagtattaatagaagccattttctatgaggagaagggtcagatatttaaggtaaatttctgtaaatgacagtaataaagcagctgctcagaattcaggacatctcaattagccctttgaaaaacaagttactgtcatttgatttcacaggcaagttcatctaggttttaggatcacattttaagactgcaaaacgaaattttagtcataaatgttttaaaacatataactagattggaggtgaaaggtcaaccttaggtcttgcccaggttcatttatcaacacaaatatttattgtgagattcaaaatggaagggaaattgagatgtgagataaaattatttgaacattttaatgtaccttgctagttcagtttaaaacataaaacagatggtagcacagcacaactgccctattgcctccctatttatgaacacccatttctaggagtccctaaaaacagggacaatgtccttgagatactgtctaattaagatttattttcttgtggtttatggtttgttttttcagttctgattcctttctgggccctgaattctgaattctcccctcctcacagtgaagatgagattccccttccccttttgggctaccaagagggagactttctgtcattgacagtggtaccaagtaatcagcttcagtgtcaggatgaaagtgccgggactcagggctctcctctgccacagtcactcaccctgcaggaacagtgagatgggtgctggtagagggaaggtcattatgggactgaagatggtagtaaaagggtgtttatcacaatgtcatttgtaataccaaaacattggaaacaatataaatactcagaaataatgagtttatagtgtgttcattaaaacatttattgcagatcttgctttggaggaatatttaatgacatgaaaaaattttcattatatgattaagtaaaaaggatttaatacttacagagccaacatcccagttctgttaaaaaattttcgttatccctccacccactcaaacatatatttttttaagctctaaaataactaataatttttctgattcttcaagaccaattttataatatttttaaaagaacattttataaaaggggagaaatggggaaaatgagagtaaactgtgaaaatgtacttagtcaccagattcagaaccatcatttggtgtatgacactgtctataaaagttgggtatttaagttggcttaaaggtattgatcatgcctctaagacttacatgagttttacaatagcaagtgttaaaaaatctgtatgtttactaacatgcctatgggtatcccagttttctaaaaaagtaaattggaagttttacaaacattaatggatggacaaatactgctaatttatttagctttagactcaggaagttttctttgttttgctaggtttttttttctggatggtggtaacagtttgcccatcttttataagttgtatatcagaaaattcttacctacatttcttcctacttgaatttgcacctgcctcagatctttttcaagtgttgttggttcctcacactccaagccccctataatttctattgttgtttccttagggtctctgttccaccctttcccccatgtaccctgaggtatgctagcgtgtttctgctgttactagattacaccttggagaaccgaaagctagtgttgggcctctacctcctgggaaaatgttttgagaaattcttccttctaaagtcttccagagtctcatatctgccataagaagataaactcaaagatgtctctttttaaagctgtcactggaattgagcagaattagagatgttttcaaataattgtctcatctggctactttaggtattttaacctatagtccttaaataaggttgatccattaataaatgacagcaaagaaatagtatgttttaatattttctgtcaaaagtaacataggtcatgaaaaattagaaaaaaataacattaaaaagtatatagaagaaagtaagaatcaaaaagtaataccattggtgaagaagccctctcaacagttgattggctaatactgaaattaatctaaactgatcctttaaggtctacacaacagagcaacagatttgtacatgttatgtgtgtgtctaagagtgagaatgactgagacatcagaacctgaacagtacaggcttctaaaggatgaggacatagagttacatagcactctgagtattgtgaacatttgatgagcagtaatgatctaaacatcaatgcaaagataaatacctttaaaacatgttgctgtgtgtttactcacagtagcttataacggtttactttggttgcaaaggctgttttttatatatacgtgtatgtatgtgtatgtgtgtgtatatatatatatattttaattgcatctctcacacacacgtatgtaaagatgtatgtcagtatggggaagatatagactatattcattttgctgttttggacctttcaataagaacctttttaaaagacacatcatggtgtgtaataaatacactcttgtgttttacttcctggcaccgtggcaaaaattaatttacagatgcttttcccagaacttttagatcaccacaaatgatttagagcatcaccatggctttgacatctgtttgtttccaactacatccaaaacacaggaaaaacgagtaacaagtcattgttaccataaacttcaaaggaataagagctcaaaatatttttttcctggaattttatcttgaatgttattaaaataacttgttcatcaatttagaatttgtgctgagatggtcatgttattcaaaatgaaaacatttgtttcagtggactggaaggagttgtgttacaggtaaaggaaaaagggaaaatgtaactctctcgttagatgacatgcaatagaatttttcttcagagtctgtgcagctggcttcttggctttttcttcagcagctcctcccaccatgcctggcctccagtgctgagggcgctggggagagagatgtgatttggctcaggcaggcctaatgaaaccctgcttgcctgtgtaataggtggatgatcctggacaacttgcttttgcttcctggcctcagtgttctctgttcataaagtagggattataatgcctgtgatgaggattaagtaaggtaacatatgtaaagctccttggccagtgcctggcacaaatagggcctggaaccaatagtgtttgcttcattctctttcctcaactctcctcttctgcctattgagtgggtgattatcagaggctcctctgtgcacaccctgtcttctctgtcttatggccactaccttttcttttttgaacttttaagtcttttaaattaaaaaatcaattcaaccaccatttatttagcaccaattatgtcaaaggtgttgtggtagatagcatagcacataaaaatgaataaaacagtttctatccttaacaagattaaaatatatgtgagaaaaagatatatagatagcaagcaggatatgatgactgctttcccaatgtataaggaataccagatttggttggggagatgagcttgacatgccattattgtgcactttcatctagaccttatttagatagacaatagaatgtactgtaacttttttctagtatacataaaattgagtactctatagtctctcgtcactacagtaaaggaggagtgaaaaagtgtgcaatcaacaaactccaactttctcagttatatcattgggtggtggacactcccagaatcatgtattacatattttataaagatttgtggaaaatattttcattaagttcatcacatatttattcatattaagaactgccctaggctttaaatttttaatttccaatttggatgcataacagtagttttactttttgaaaatctggtattctttattttctgcctcacctttccataaggaggacagttaccaattttgcagtatttaataaggatggtatttttggtactgggatgtccagaggaaatctgtaacctacatactgagctcactgctgtcaccaaagctttctacctgtgtctgctgttgtatgctaactgggacattgttcccaggattccatgtacgattgtgggcattgtcacctgcacaagcacaagaatgcctggtcgggggtgaatggagctgatatccatctcacactgagtcaccaagtcctgtacttcagagattgacccttcccatacagggtacatttttctaatttgcaagaaaggtgccctaagagctagtggcttccctgattgctcccctaacatcatgtggttaaattttggtatctcagacaagtagaggctgcggatctgcagggtcaattggcttcagatttagtcaatttcttgttttttaggcagtgaataaatatgtggttcccctcccccccagtttttttcttaaaatgaagctcatcaaacaaatgtaccattctgaggtgtgttctcaagtcatatattataattcatttcactcaaagtatatgattaaagctcattcaaagccctaagagttgggaatgaaggaagaattgtaggatgttctgctgtgccacaagacttaatttataccatttattagtcttaccaagtacattgaaaggaaaaagttgttgggggccaggcacgatggcttacatctgtaatcccagcactttgggaggctgagtggggcggatcacttgaggtcaggaattcgagaccagcctggccaacatggtgaaaccccgccttattaaaaatacaaaaaattagccagctgcagtgacatgaacctataatcccagctattcaggaggctgaggcaggaggatcgcttgaacccaggaggtggaggttgcattgagctgagatcatgccattgcactccagcctgggcgatagagcgagactctggctcaaaaaaaaaaaaaaaagaaaagaaaaagaaaaacgaaaagaaaatgcttctgggacttttcaagtatgccttgctattcagacattctcagagattaaccccaaaagtgagtgattatctccctgagacccagggttagaaaaataacttcagaagtacaaaagttggattattgccctaatgtgagcccactttaaagcaactaccataaacaatctaaagcagagtctgcaactgtgttagccatggtttaaatggtgccaagctactatttcccatggcaagggaaatgttaaactgtgaaagaggcaacagcccataaacatctatatctgcgtacacagcacagtggccaccagccgcatgtggctattgagtgcttgaaatgtggcgagtccaaatagagatacgctggcagtataaaatacacactggatttcaaatacttaggaaaaaaaagtcaaacatctcaatatttttatattcattacatgttgaaatgataatattttggagatactgtattgaaaatattattgaaaataatttcatctgtttttttaatgtggttgctagaaaattttaaattacaaatgtcagctgcatttgtgatttgcattctgtttctattggacagcactgatctaggtatttcaagagaaaagaaggtggggaatgtgtatttggtttcttcatggtctgtgtctcccaggatacaatatcctgttccctctttcttagaggcatgggttgtctccccgctaaaaaacaaggccatacagtatcactgatgacatgctttttccactctgtggctattctgcagttcacttagtatttagattgttaacttttctatgtaatctttgccacagagtgtttgtatacattcttaataattttcttaggagaaatgacttagcttttgctgcagattgccaaactgcactctgggtataaccaatttgctcttaccagatgtgtatgcctagtttgtcattttccctctgacctgggatttttcactttttgtttttgttgttgttgttatctttgccaatttgatagtgtgtgttatctctattagaaaagggaacacacctaaatttcacaccctaacatgagctgctcagtgtaaaataacaggagaaaatgatgaaggacagcttatcctaacccactttggctaaaggtttgaattaatttgcagtctatgcagaagagtatcagactcagtgaccattccaaattatacttttaatgaatggtcctctttgtcagctgtgaagaccataagaaacaaataattaaaaatgcacagaatacctggcaggatgaatcctgtgggaaccaatccgtaaatgtgccctagacacaaagggaagctaagaacagttaacattacatgtagttttggaagtatataatgaagatcctggggaaaagagtccttctcgactgggaagtttttaattggcatgactatatgggatacagttacatcaggattgtaagtccaattagccaagattctacgaaaatctgttctgtgcttcctgaacttgagaacaaatgaaaagaaaacccaaacatactttagctttccttcttttcatttagcgagagcaggaacgagttggtcttatgaaattgattgtcactgttgtctccagcacattaacattttttacacacaacaatttgaacagttctctaggagtttgctgtcctgtaactgtcatgtctgggtttgctgcatggtgtaacagtaagagcatctcagcccattggtgaatcggatgctgccagacattgctttgccaccctccttctcccagctactccatattctgagtaggagcttgatgttcctgcaaatcattatacctttgcattttttcacttggttcattagtttgataataaaatacatttaaaaaatttccccctaaatgatgttttatgcattctctcatccccttttcaagtggtggataggtccaccacatgccatttctccaggaatcatttctctctctctgttgagcttgtgtgtacaaatcatattctttagattctaaacatatcatcctctttcttctgcagggttgattggaacagattttaatcctcattactttgcttttattatgtgatgagctgaagggttttgacctttttgtttctgagataaatatccctttttttttttcacatttcaggataaaatcttaggtatccattatagctttaagtgtttgtctcaaaaactaccgttttgggttgtgttttcccccagaatcacttcaagtctctactcatattagtatacatttaaaacttgtgatttaaacttagcctggaatggtgactaaagggttgaattttaggttgaactttttctgtttcatctccctaaagaagggggctgtgttgcattatttccttggctccatacattcctcctggctcgggtccattcttggctctggtaatgatctcttcccttcttagccaacagtttccttaacacacatagtcactggaagtggctactcaaagagcttcagtggaacctgactcagactcgttactgaggacctaccaaataacctgattttattttctggtttctttcaactgcagtgcagtggggaaagatgagtcatttgtcccctctgccttagtttccttccttgtagaacaggattaatggtaccgcctttgccaggttgccgcaggcttggatgagataatgtgtcaaatgtgacagtacttttaaaactttgtcatagaagtcaagtacttgtcatagctctctcctggtttttactctgactgcccacatattcattgctaaactcattagaaataacaaattctccttctgttagctcatatggttactcaaaaatattttgttgagcacctaaaatgcattactacatcttattctccttttctgcaaaatctccttacataatgttgtgtcagctaaatggaaatctttaagtactatagataaatgctctgtgaacattgatggaggatttcctcattagaaagaatgaaaatgttgatagaactgagttttcaaaataatcattgtcaaaaaaaggatttataaatatgggcatctcatgtctgtggtactagaataagtgctgtaccactcatgttttcatgcatttaaaatgaatgcactttttatctcttttttttttaagttcactagagttcatgctgaaatgttatggggcttcatctctctgaggtacttgttggttttagaaaaacgggtttgttatctcctgagtttccatcacaacatctctctgattcttctatgattgtttcttctgttttatgctcagccactagaaggaaatttgatttttcatttaatggacctagaagtgcttattactctccaccacccatcctgtacttcactttccccgttcctgtcttattggctccatcagtgaattgtgtggtttgggaagagcttggagttaggtctaggaaatgagcttcagcttcaagccattccctgccttccttctgagttaaggtgtttgtgagaggaaacaagcaggggcctggagcaattactgagcccagtgtaggcttgggtgttaaggaggtcattatcaccttcttctggatgtggtttggaacagggactggcctgtggaagggtcccaggctggcctggtgggggctgacccaggtaaaacaaaacaaatattttgataagttgagctctgagcagttaagtagtgggaaagggcacataagttttcttcaggactgtatcatttattgtacctccattctacaacacatactgtgttcctaacaagagaatgggaattattattattaggatcacaatatagatgatttataatacatatttctcaaataacacaggagagataatcatttcatatccctgcctttccctcaactcgatctcaaagaaagcccacctaccctttctgcccccacctccatcatcacccagcagcctctggggtgaggtctgcaaagagtgaactcacctccacctgggttgccttacgtcttgaatcccattttaatgccagagctggtacatttactctttaaagtataaaatagtttatacttattttatgtatgtgtgtgtatagacatatgcacatatgagtgtatgtgtatgtctgtataaacactcgtgtatgcatttatacacatataaagtatgttttatatatataaaacattatatatataaaatatatgtataaaaaacatactttatatatatatataaaaccatgtcatgtaaagaagctttctggttccatgctttgaccccatgtcttcagtgattttctagtatcactaggatctcagctccccttggaggattcactcctttttggctctgaggggtcttttgacagacctgtaaaatcctgcatggatgttcaggacccatttttaccctgaccatttaagcatacaaagttaagtaagccctgaacaaagcgggagaggaagcaggaagtcagggcagtggaggggttgtgttctgctaattcagcaggatagtcacaggaagtgtgaggaggcatcattgctgataacatgctcacttcagctgaatcccagagagaatgaggagaaaagctaatcagatgcctccccctgttgtttgattttttttttctcttatgtggatttttgtttgtggcatggtcaattcatacaagattttacaaaattgtattgggacgtttttgtcccagtttataacttgaaattaaaataaattgaatgctgtgaggtgtggtttttaaaaggtatctttgccgctattcttttactcagtaattctgtacatgtaatcattatatttactgacattcatcttgtatcaacaagaagtccagtcctctttcaaagcagggatatcaaagcctctatccccaacccaccatattttagtagtttcctagatttttagattttaaggaccagtaaactaaacaaaaataattagggttagggatccagcatagagtcaaaaagaacacaaactccaacaaccaccatcttttatcactctttcttaaaaagaaagaccatttcactatcaaaaaaattagaagtacataatcgaacttaattttttgacaaatccatggcacctatttttctgctgacacagtggtgatcatctttccccaggttagtttttgtgaaaccctgctctgcagcaccctccctgacccaggctagttctgctagaaaacttctagtgactgcaaacactcgactccagttcttggaaaggcctgctttatagtctttccttttctaggtaagcatcggtaagaacttcaactgttccttccttgtaggatgtgatttctagctctttgtttatggtgcttactctcttctgaaagagctcagaagaccaggttaaaggagatgtttagaataattgcattcaatgtagaaaacacttcatgaaaacaggctgtcttatttatttattcctccactcctttcttctgaatgtcaaatgtttattattttcaggcactatgctgaggcctcatatacgaggaggaaaacacacagtccaagggcacacacctaatggggatgacagccatgcagataatgtagcagtgtgctgattgctgcaccaagatgctgcgtggacaggatgccatgggcagagtgcagagacagcactcagctcagccagggaaggtcggaaaatgctagagaatgccattaaactgagtcttgcagaaagatgctaaatttccctggtgaaggaaaatcttaaagggcaggaaattaaggtggagcagggcaggacagggacctgtatagcgatatacaggcaagctggctggagttttattcatttgttaagactgctgtaacacagtaccacaacctgggtagcttaaaacaactaatagttactgtcttacggttgtggaggctagaaatccaaaattaaggtgtcagcagggccatgctccctttgaaacctgtgggggaacatgcttcgttacctcttccagctttggtagtttgtcagcaatccttagtaagttcctggcttgcaggaatctctccctccaatctctgcctccgttttcacgcagccttctccccatgtgtctctgttcacatctccctcttatgaggacaatagtcacactggattagggcctaccctgagagactcatcttaacttgactacatcttcaaagaccctgtttctaaataagatcaccttcagaggtcttggggcataggacttccacatatcttttgggggaacacagttcaacccataacagtgagtgttggagaatggtgagcagaaaggcccaagagcatagtgtctttctatgatcggctcattttttttttttcagtgcaacctatattttagttattctgggaacttgaacttgtgcttaatcaaaagcaaacaaacaaaaaaaaaaaacatattttcatgtgaacaagccaaggctttttctaaatttgtacagttgattttgcccctttggaacttatgtataagacctatttttccctagtgaatgttattttattgactttggctaagtattcattctagcctgttgaaataattggaagtgttaattctgtcatcttacattcaccatccccctgagctttgggacatttatatatttgataagtgtgccaccaatgacctgatttatgtcattgtttaaaatgtcttttacaagtgctggccaagaacagagctatatggcatatccccagatgcctcccttcgtgttcaccatgaccgctaaccaacagttgacaactcaatcactcgttcatccagttacccactcactcaagccacatttcatcttcccaggtttcttcatctgatgtatgagcaaataatgatttttttatttaactcaaatcagaatacattatgtaacattcctaagcagccctgattttctcaccactccccaaagtagaaatagcaaaagtttaatgttcttacagttctggaggttacaagtctaaaattaaggtgtcatgacttgctcttaaggactttgctagtacttgttcttttcataagtgtctctgaccttctatttactaatccaatctagaattttgcctcagatcaacattggtcttatctgcctttagtttctagaatctagtttttttgttttttaaggaatctgaatagcattttgccatcctatcaacagctctcctattatgcaaggtttctcaaaacaagattggtaaatgcttactgacaatcatatagataagaagcacttttagccctgatctccatacccagaccctacacttgccaactacaagcagaagaacatcattatctggaaaacagtggattcaagctctattgagggtgaggcatgtttaccttcatttgggatatggtaattgtgagaaactgatactaaagtaattttacagcatttggtgctctttatagttacgtgttttcatataaagataattcctctctgattttcttgagtttcaagattctgaatttttggagccgtactatcctacctccgcaatgattgctcatctttatctgcagtatctaaggacagggtagtttgcagacaaaccagtaagaaatcaatacggggggctatgtatccttttccatcagatccgctcttacagctgtaaccattgtcacaagtgacctttgagccaaacgtctaagtttagaaacgtcaactctgctggcaggctgtggtagcattcccttgcttatacagtccaagtgtgtcttttactagggatatgtttatatcctatccccaaattttttagagctgaagtgagtaaaatagatatcattttccttgtcagtctgttcttcagactggcttttcaaggtcacagggcagtcaggatttattacttgagaaaaggatggactacgtttgaaaatcaatatgctggtggagtgttttggatcaaagccagcgttagtgttcagtcgaagaaatgtccaatttgactcttgcctttttagcttgtatcagaatcaagagaaatttctaggtaattttgcacactgttttaatagcttcagataactctgttttgcttcagagaggatgtttacttttactgtctgtcatgctgttcttgttttgaatgaagcagtcatttatggttttcagtgatggagtttaatgcattcactttctacagattctgacacagttatctggttgtgtatgtgtgtgtaagatttccagttgtgtgatttactttaaaaggagtgacaaatttagagacacttgaaaaacagtttagaaacgaaagcttttctgggttttttgcacacgttccgccccaccccagccccttatagttttgtttccgtggtgttgggggcggggggagggtgctaatttttaattccattttaagttcctaaattgccttgcttccctcctgtgattttttgagctaaattggcataaactataaggtcatattcattttctaaggcaaaatgtatttcccttctcctcactgctgccaattccccacaccaaacactttttgggggaaaatcatattacatgtttatattttattcactcaaaccaatgtatgttgagaggttacaatatgaaaaaaaaaaaaactgtgctgaaaagttacaaaaaagttgtgtctctcttttctcaatattttgccacattggatcacattgatattagggtaagaaggtagtctaggtaaatgctctcaagtctcaagtaattagaagtgcccttaattgaagggtatgggagaaaagaataacacttattagtcattgaatattcattatatgtcaggcaccatagtggtcatttataacagtgctgtgagggagacattatcatacaactttacagatgaggatcctgaggccaggcaactaactacaccagagtcacagggctgcccattggccatatcagcacttgatatggtctctctggtggcaactctctcttctttccattataacattgtcttccttatgtttcagtaaagttaagtagtatataaacacaagggtgacactgtcaaagcaaagaaaatacattacaggttttggtgggagaggaagaaaatttaagaaataattattgtcagttcataaattcaattcagaaatagaaggccactttctatgatcaaattgcctttgctttaaaagttggacattcatcagtgtttgagacatttagggattcatttttatgatagataatatacattttacttgcaaaattctgggtttcattttcggcacatattattttcctctgacatgttagtactcgggagcactaatttgggtctggccatctgtgactacatccttaagtgctgtagtacagtgacttctggtaaaaatattgtcataagataatgtaaatgaccttttgtgtgcaatgtgctcttaaaagaccataaaataatgtaaagctacgttaccttgattgcagatcataatagacttgatactaaactataatagcaagtctgtgtaataaatcaaatgctttataatatgctcttttatttagaagagaggttatacatttttcatagtctatggcaaaaaaatgcatcttagcgatttttaatgagatagttttagtgttttatatgaattttttagtccaagttatacatacagtaaacagcatcaattgttaccttcatatactatttataatggattcacccaggcatgttggtaagacattaacaggaatgattctcaatttagtgagaaaaggttattagtctcaaaatctgggtagagatgaccagtttcatttgtactctcaaaggatgtgttgatctgaaaatttcaaagttatgaaaaatcaggtatgtagatgtctgtatcttctcttgaaaaaatgtgataactgtcccaatgcttctgtaattcagtcttcatcagctcacatgctgtaaggcagctaggctagctgagagttagaccacatgaggattgtctgaacttctgctaaatcacctcaaatctgcaggctttgcatctgtggctggagctgaaattgttttcctttccaggacagttcagaaaagtgaactttgtgattctttttccccatcttctaaattcacagagacaagccactggctttccattgcacagataccatggattatttttctcagatgtcaagttaagcatttaagacttcttcaaagaaatcctttgtctttaatctctcctgccctgtagagcctttccattcaccccctccgtctcgtcatccctcattgtaatttcttgaacttaagtgttattgccaaagtacaaaaagcaagaaaataaataaaatgtggcatctctctctgctaatcctggacaaaaattttcgttaatcttactaaaataattgctcttgtgatttcattctacagttccaaatcctccagtctcattctgttctctctgtccttttcttagaatgcagagtcctccaagacttttggagacttaagtttccataactcactacataggtttgcattagattctttattgtcctacagagcccacctagatttttgttttctccagtttttcttactcaacttgaccttccctctatgtttatgcctcctttatttagcatacatcatacagggtctcatatttttagttattttttagtattaaaagttttttacataccccaaaggactgtcctccttaatggtaggtgtggcatctgctgtatttttcacaggccttgaaagggcatactgtaaacatgctataaatatttttgagttgatttcttggtttgatctctcctttcttgactgtacttatctttcccgtaatcccttcaccttcagcgcctggttttcagttgtttctgacctttaggtctgcagtagcttttcttgccaagcattctcctttaaaccctggcttcaattccagctacatacaccaggaatcttttattcataaaggtacactcagccatataacacaagtggaaggggcagctatctaatgtaagagttaggccagaacaaccaaatgaaatggggaatatctttctatacccttaatttttgtgtcttggaagtagaaacattgaaaatcatcagggcaaaagaggtaaatgtcatataaaatttacttgattttgattgcctaataaatttttacatcttctatctcatctccaaataccactttacatgccaagtaaataaaggaaatataaccagctgaattattccaggtagtgagaattcagaataacatgggtaatgaccctttctactatttttaggcctcattctccaaaaaactttatttgctaaacagacgtaatgtatactttgtgttccttcccctatccaaccactgttgaaagagctaaagcaagttttaggaaatcccctttgtctgggaggccattgaaaaaacaaagcagccaaaaaagtgagttagaaaactgcattcatctgtgtgtacatgtgtgaggacgtgtattgtattttttcttttttcccagcaactccaaaataacaagagggggtttcctcaaatagatttgtagtcctcaaattcatttccctcaaatagataccttagttattccttttaagctttaaagccagtcctgccgaccccctcactgaggtatatgctctactgggcatgttattccaagatagaccaatgtcatgtatccagaaggtctttagtcaggtaacttcttcctgaatgtcatcagcatctgtcttaaggaccttagcaattacggagtccacccctcatctccttactcttttggagctgtgtgcagagtcaaactgggaattactttcaatctgtggcacagtctgtggttggtgacccaagtttccatagctgtcaacatgcttggcctttaaactccaaagcaaacattctacctcccatctttgctacttagttgtgtaaccttgaatacgtcccttactgactctgctcctgagtttcacatctacaaagtaggagtaatactccacctccccaaaagattaagaagattaaaataattggcgcatatatatgtgtgtgtgtgtgtgtgtgtgtgtgtgtgtatatatatatatatatatatatatacacacacacacacacatctcgcttagaatagtgcctggcatagagtaggagctgtatacctgtaagtaattacttttattattcccctgaattaactcacgaggtcataagttttctgatgttgatgttttatttttctcttctttttctcatttcaatcccctgtccctcctacttgctaattatggtcatatacataggcacagcgtcttttacgggatgtgtgaatccctgtttgtccttcaggagcagctattatgaaaactatcattctatatgcatgagcaacattctgccctttctcaaagttaaagtatcttttttgtttatacatatcacttttttttttactgttgttttaaacacacccattgtgttttcaggtttaataatattcataaaatattctaaaactagcacaagcactgcaaatgaccccatgtgccttaaatgaatttacaactgaaatgaccaatattaaaataacttaacaaccattgtcgccatctgttggtggtggttggagtggacgccactctccagagctttggcttataacctggactcttcaaaagctgcacgttccctagcacacaggaaaattgtgtgtgtgtgtgtgtgcacgcgcacgcatgcttgcacgcacacacatacgtttatacatttgtacgtgccagtggataaagtctataatgatatgcaccaataatcatatccaggacttcaggtgattttaatttttcaacctacttttctttgtcttctaagtgtacaataagcttgtgtttcttttgtaatataaattaccaaaaaggtagaatttaggagtaactaagtgatagaggcagaggagaaaattaagctttatatactaagtgcaaactgagatatacctacattttatattgtagcagatgaaagaggagatctaaatggaaagaaagaaatgagtaaaactgtggtgtaaactaaagaagttttagtaaattctaagtaaaaggttttattagccaagctcacttgggccaagaggtttgaacatgagcttttacctgttatcctctccctttgaaattcatattattatatagtcatgtctcttaattactcttcatctttttactgtcagagcttgctctggagtggattatctactctagcaaagaatattataatctgggtagctggggctgtggtctaacccagttactttgaagccagatgaaatccaaagaatcttcatagtcacagtttttttttttttttttttctttcatgaaattctacatcatgctgtttggtcgtgcactttcttagtgtccttagagtgtgaattccgccagtcaggagacctgtttctcctagtacatcatatgtccctattccgtaacagtgattttttttttaaacagggggtctcactctgtcacccaggctggagtgcagtgacgcagtcctggctcattgcaacctctgcctcccaggcccaagtgatcctcccacctcagcttcctaagtagctgggactacaggcgtgcaccaccacgtccagctaatttttgtattgtttgtcgagagggtgttttgccacattgcccaggctggtctcgatcttctaagctcaagcagtctgcacacctcagcctcccaaagtgctgggattacaggcgtgagccaccgtgcctggctgatgatttaaaaaaaaaaaaaaaattaagctacagataggagcaaggggaggtgaagatctggttgctttatgaatttgtacccagatgtctgttactcttacaggcattggtgattgacaacagaattagattaaatgttaactgtctataacagctccccctcacccctcactttaaatcttactgcaagtaaaatgagtagagagagatgatgactactgtgaaccctcccactccttatcccagtccctgaggtgccatttgatatatggctcctcctcatattctagatctggacctttcctggctcttttgtcatgacatcaaaaactactggttctatactgcattgccacaataagatatccaagttgcccactgaggagctaacttagctagggcctgacggatttcaagggttgcatcttctagttctggggtctgtattttaatgggagcctcttgtgctggaagtggtataattgagtggacagcccaaaagaagaatattttaggaaagggaagcccttcagcaccttaggtaaatccaaataagcagcttcctgtgccacttgtttgcagaaggccagtatgcagctgccccacagacagagtggaatccgtttctgatgttctgtgaaatcacagtctttcagtcttactccacaacttgcaaggaaaaccacaatagaaagtaaaactgataaatgtcagaaatcactctttttctactcaccatcctctgtcttgttatccctctttcaaccataagccacgtgtttatttcttatgtttaaaacaaatgagtaaaaaatgtcctgtgcttggaaaatgaatatttgagtaccgtacagaccttccattacccttcttcttccatactcagagggcattgtttctcaaaatcatttcattgataagttgccatgaaaatttactcatttgtgagctctgggatttcaggcaaggtgtaatgctcaaaacttgtatgagctttttgttttctcatatgcacaaatgggaataataacacctacctcataagattgttgtgaagttaattaaataaaagcatacatgcaaagtacctggcacagtgtctaggacataagtaggaagtcaacaaatgtaatgccctttctagtttcttagaaaatagccaactaaatagttgaagagattagtgatagtttcatggaaaagataatgtttgaacaagttcttcaagttcaagcatgggtagaataggtaatggagagatgtttaaaggggtatttaaggtaaattaatgcaacagacagggttgaaaagctggatgcagggagaactattatgtgttttttgcatgtgtctaggaacagtgaagggagaaagtaaagattggaaacatatcaaagacaaaatttggaagagttattgatcacctgggttcaggaattactgagttagtggtggcacgaggaccccgagcttggtaggagattgggagagtgagtgctagtgaatgaaaagagatatggagagagacagggaaagccatgtttgagataatattgaagatgagatttagaaagtcgtgggcttgatatttcactacttaaatatttcactggatatttaagaatcctaataaaatattaaggtatttaagtagaaagaggaagagagaaaaaccaaagctttggtgagttttaaaaaaaacacatacacacacaaggaagaactgagcagcatcagaggagattcattaattaaaaacatggcactgaatgaatttcctaagagaagaaacagttgaagaccaaatattaaacttgatgaaagtacttagttaaggagggagaagaggaagctgaatgggcaaagaacccctgaaagagggctgtgaaagatggaatgagatgggggagtacctgccacagagaagggaggtgcactggcagagcggactcatgccagatgtagcaaacaagctgagagagggtgtggcatggcttgcattcagcactactgagccttttctctttgcctacttcctcattcccctttctccatgcattttcctgtctttcccatcattaaatgttgaaagcagaactagaagtgtcgaaggccaaccctttaccttccttctcctaaatgagcctttcttctgtttggtttacaaaatgccctgaactctgagagcttgagcagtctcttaatcactgtgactctcaatctccttaccccaaattggagtcatacctaccgtccccccgcttttggaaaagtatgaaacagggatacagtctaaaagtgcttttgtcaaggacttgtacacacgagagagtcctggtgcctttgtccatttttcgtgttcctgtaaaggaatacttatgctaggtagtttgttaaaagaaaaggtttatttggttcgtagttctgccggttgtacaagaagcacagcatcagcgcttgctgcttgttgagggcctcaggaagcttccactcctggcagaaggcaaaggggagaaggtgtgtgcagagatcacatagagaaagaaaacagaggaggaggtaccaggctctttgcacaaccagttctcaccagaactaatagagcaagaactcactaccacaaggatggcaccaagctattcatgagggatccacccccacaacccagacacctctcattaagcctgatctccaacattgggagtttttgttttgttttgagacatggtctcactctgtcacccagactggagtgcagtgacgagatcatggctcactgcaacctctgcctcccaggctaaagcgaccctcccacctcagcctcctaagtagcagggacaataggccccgcaccaccatgcccagacaatttttgtgctttgggagggtagagacggggttttgccgtgttgcccagcctggtctcgaactctagggctcaagccatccgccggctttggccttccaaagtgctggtattacaggcatgagccaccatgctcagctgggaatcatattccaacatgagatttggatgggtgaaatattcaaacgataggagctggtaaatatcaagcatgtaacctaggtagatagatggttgctgaaaggttgtctttagatcacttatttttttctcatttgtagatttttatagattatttctttgtaagcctagtgatctgtgttaatattgttaaaatgctcagaatctcaacagggaattgaaggtgtttgtgcagcattatgcctcttagatgtaattgtcatttgaacctgaaattatctttactttcatgcctagttagtaatcatttgattacatgattacacagagtgaacataaggaagattaactgaaggagagaagtggctcaagccatttttttttcttctagataaatatatttcagcttgtttcagtgcataaaatacaagtgtgtaatattcacaatggtttaaaatgctacaaaatacttccatttcctaaaaattttaatatgctttttgtcctcaaaatcattcatgagaaaattaaagtagagcaaatgtggaatttttgaagtaaatgtctaggaaagtagactgtaaatgaggaaacgtgagactcagatgcatcgagtaagttaaatgcatttcccagagtcttactttgatttgatttgttttgttttgtttttgagatggagtcttgctctgtcgcccagggtggagtgcagtggtgcaatctcggctcactgcaatctccgcctccccggttcatgcgattctcctgtctcagcctcccaagtagctggtactacaggcatgcactaccatacccagctaatttttgtatttttagtagagacagggttttgccatgttggccaagctggtctcgaactcctggccacaagtgatccatccgcctcaccctcccaaagtgctgggattacaggtgtgagccaccgtgcccagccttactttgatttttaagaaacaattttaaaagttatctttcaaaactttttttcctcaatttttagaaggcaagcatagataacagtgcttttccttatagtatggccactatggagagagtgtggggttcggttcatatttacattatactgtcgcttcgttttcagtagcagtatgctaaattttaatgttcttaatttttcctatattccccagcatctatggcacataaaggaatttgaacatatttctcatagaaacttcataaaattaatgattaatccctgattaattcttatattcttcttcattatattcttgattgtccgtttcttagacacatgtgcatgcacacaaagtgagtttactgtataattattattactgagttacaagtggtgtaaataagtgtatttatgaacagttataaaagtcctcagtaaaaaggatctgtttgacaccattaagtgtgctaaacataaacatgcgcacacacctgcccttctgtggcgatatggagccttgcaatggtgtccacagaaccaaaatgaatagaataatgcaagcagctttccgctgttactatttcataaaagctgtatggatcataggacagtactttcctgttagaattctataaccttgcatttggctttgtattttaccactgatatactgttattagaagaaaatatttggtatagagcccacatcccatgtttctgtcctaagattgtcaggtaagtacttgatttcttcagagttgaacttcaaactgcaatcccacaattcaaacaagaggcctagccattccctttttttcagttttgagttcagaattctcatttcctgtctcttagtaaagaaaattttgtactctaaagtttgcagatgtttgaaaagaatgtgtgttctttggatttaggcattaataagggttccttataacttctttttctttcttttctttttttcctttttttttttttttttttttttagatatgggaaaatagtctccacaaaggcaattttggataagacaacgaacaaatgcaaaggtatgttttcttggctggttatttggtaaatgatagctttagaaaaatgatggaatttaaaacctgatctttggtttcaaaaccaccttcgttttattaaaaaccagatcttatatatcacccagtttctgtcttgcacagtgtcagcatattacttacatttgtccctggttgggttttggctacaaacccaacagcagctagcagtttgccagaattccagatttgacgccagtagagttaacatgcaaaatacgggttggcatttagcccttgcttttaaaaggggagtagagttagaaaatagcttttctttcctgagcctgaggagattagagctgcttactgaagaccattggactgtactaaagaactgaaaagattacatattgtgcaaattggctctattaattagaatagagtagttttaagcagtacttaattacatgtttcagtactcccaattgttctctgctgaatgcctgttgacaatattggcagcagggaggagacaaccattttcactgaccaaattgtaatagggaggggaggtcatgcgcccctttgaaatatgctgctgcattaatttgatgcactgaccttcagttttccatgtaattaggatgagctcatccagccccatgagctggaagaggaggcgtctacagtaggcagcactgatgctctgtggttctgacttttaatgatccagcatcttaacaataggcatgtgatttctaggaaaagggaagaatagagtcagctgactttgaatctaactactgaccccatgaattgaaataagttgacaggaataggcagagaaggcaaatctcctcgttaattagaccccagtttttcaagtagtggtgacggggcagtggcttagcacaatctgaaaaaggcagagaacataaatgaaccctatggtaggggcctctccttataagccaagcatttcctttaatctagacttgaagtggttcattgtatttctgtctcttcttcaaagtgcctaaatttaaaggagctattgtagcaaatagctaagctcatgtttaatcaacatggcacattaaggcaattttgccttgggacagtgaatagagcgtgctttatgtagagtggtacccaataaatattttaaatgaattaaactagagagagtcaaattatagactgaaatgcatatacttagtttccaaggttagtcttatttaacatttataaatgatttgggagagcagagacacagaaaaaaaatcttttggttttataaagaaaaatagactcttgcaggaataaaaataggaggctgatcaccaacatcactttgaaactagagagaaatcagagtagacaagtggttttatccataccctacctcctctctttttcttccccaccccaaaagaaatcttaatgtcggctcagtgtgttaaaaagcagagctgccctaatttaagtaaaagaaaggacccagaggttgaatgcttcaccacatccctgaactgaaaaccacactattttacactctgctccaaaagcaacctattccatagaagccaaaattcctcaaagtgctctacgtgatctagaaaaggtatgggtaaaaaataaactaatgctaaatctaacatgttgtcacaatacaaacccttaacagttggtaagggtccatagtagagagatttatggacttctaagggtaggactaattcagaacttattttagatacaagaagtctcctggagaccttcctttaaagtggtttttgggagacactgcttttgggtgtgtgggcagtaatagaaaccttccagggctctctgcttcacacaagcctcccagcaataggtgtcaacagatatctggtgggttgagacggtgggtgagtgagtgagtggagagggtaagagtgggtttataaaatcctagaagcaagaaaaaagtaatttcaggacaaatgagaagaaataacacttaactcatgataaagttagataacatgttacccaagataacttgacgtgataggtagatagataggcatatagatgactgattgataaatgaatataaataaataaatgcataaaagattatagaatattaatataaatgaaaggtacttgtgttatatactaattttttgaaattaagcagatcaaaggactttatatatgggaatgagagatcttagagggttacagaacattttttgccacaaaacatatttttggaacatgtattttcaagagaattaagctgaaggaaacattagaataacatgtacctaagttattaaattttaaaattcacaattcagttgctattttacatttcagtttctctcaaagtttagccaacaaaaggcatttataagccctccaatgctggtaaatatgtcagttcaggacaaaaagaaaagctcacaaaagattggttatgaaattgattgattcattatttatacttacagaagtgcatgtaagaccagaatacttatacacattagcaaaaatagtttcaggatgaattagactaacaggaaaaataagggtaaaagcaggcagctttaagttattaccaaatgtccctgtgtttcctgctggccaaggcaaaaatagaaaacatagctcgccccatgattcagtcatcacaatgtgagaggagagcaggagtaacataactattcctggtcctgaaacctgagaggaattctcctgggaagcctcagtgagaggatgccatgttatttagtgaaccctgccttcaaaaacgtctttacacctatttatataatcaaatccatagagtctgtataactcaaattgtatattgtcttctatttacttgaaagtaatacagatagacagcatgaaagagcacaaggttgcatacttaactattatgtttgtcttcagcaaatggttataaaacagccatagtgtggtaggcattgggaaaggccagaaaaggatgtaaacagttaactaaaatgcaggcattatggatttctctataagaaaataacagataacagaatgcaaatattacctgagttgatagtaacttcaaatacaataacatcaaaattgagatcttctgtttactgtaatttgttgacaatagcaaaattgaaggaaaaaacttaaatatccatcagtaaaagctgtatcatttcattgtagctgggttctcatttatgacctgctgaaactatatgagagagagagagtttgtgcatgtacatgcctgtgtgtgtatccacagagctttgttgcgtgttagcatggacaacagatgtctaaaaaaacatccaagatatgtttaaccttatttctaacctggtagttgagtatcattctttgttttacctagatcaacctcttccttttgctctccagcctggctatttctctactgtctaaatcaaattaagccttatttcagcccaattccaagtaatatataaggaagccgcttcttgtttcagctttaacattcatctctcctgaaacatctatttctgtagtcaatagtctgctccatctcattataacttatttcgttaccaggcaatatttttggtactaatactgcaaaactgactttgggctgtttctgagctttctgtttgactttattgatgttgattttgtcactagtatcatactatctaaattactactaatttagatagaaatattacttagtaatatttctgtaagtaaatgatagggctagctcctcttctaaacaaccttccaatgatgcttttcttttgcaaagtattcttattcatttacaattagtttgagttccatggaaggctctggtattttgcctggtaccgtttcgttagtctactaaatataacttgacccttttctcaataacttaagaattatcacagtgaaaagtctgtgattctctattttgatacggtgatactcatgggatctgttgagattcatgaggctgttagtgcttatgctgtgtaagtcctattctttgcatagtttttctcttttattgcttgttagtagttttgactgttagatgccattcatatacttactttgtagcagacctgccatcaccccagccccccttttcccctaattttctgcttttgacttgttgtggcctgggaagacagatgaccagctcattaaaaatgtttgtaaagctatggataaggaaactttgaaccagagcatctctaaggaggttatgtgtttgttttgttatgttttgtttttagactttagaacatgaactgccaaaacatattttaggtgtcttgaggcattttccccagctcttctttattttgaaggggtgtgatgagctgtattttaagaaaataaatatgatatctttaactgagtactaaactttagattattttatattgggggtgtctaatagttgtacttattcaaatttttaaaaatacaagtttatctacaaaataaacataatttttgtttctgtcatttgtaaactctgtaggatgtctccatctttcttaccgaatcattaaaatgctatttccctgaagttgattattttttttcttcctttttttttaaatttcttttttttaaacttggttggcaacttagatgtctcccccccaccagtaaatacaagacacgtaagatcttgaatagggaaacgctggttctttactcccccaactccctctgaaggcaggcttgtctgtctggtgatagacgacagggaagaagggcccaggaggccactggcctgcagctgttaacgcctgagctccctcaggacattttcatgtctcttgcccacaccagaaacaaagtagagctgttcttttacccttttacctaaccacagaataatggcttaaatactaagtgtgtttttgcatttcaggttatggttttgtcgactttgacagccctgcagcagctcaaaaagctgtgtctgccctgaaggccagtggggttcaagctcaaatggcaaaggtgagttgagagccagcaattgcttctctgttccacagctttggttgtgaagcccgacaggtctgctttttctatctgcatctgtaatctccccttcatcccactcagcacagcgccttctggacacttgtcctgtgcctccgcagcctccacagtcactattgtgcaaaggactgttccttgtaacttaatctatgaaggaggatttataaatatataaaatttacatagtaaattatgtaaccccataagtaaattgagaaatagcagcatattttctcaggtaatcaggtatttgtgagtctttaagatctgtactgttttttttttttttaaatttaaatgtcaatgcccagggaatgaatacacttctagacatgtttcaaaagataattatgtatagcatatagcatattctatttcaaaaatatatataactggcacatacattatacaaataataaaacaagtagttttaatgcacatgtgggctacagatgctatttttactgtgcaatagtgagacatttttaggtattgattattaatggtatataaatctactttttagtagttctataatgactttattcaaaatttatttctgatgaacttttagcatattttagatgagcaatattgttgaaaatttcttcaagtgagtaacttgcttgaatgttaggggattataaaatgggagaccatgtttcatgcttaatatatattttagcacagtacacatggatgttaattatgataaggtacattttttttttcttgaaaactttcatattatggtagtttccctctacggttttgacttagaatatcacagtttctggatgtaaatggagttgatcagccagtcattgtgtccttctctttgcattaggttcatcctgaaagttagtttaagatgctcagaccctcttccaaaagtaatgatgccttagatagacttgatggccttgaaaaagttggccttacatgatctaaatccctagttcaggtgcagtcataattctaaagctggagggaccttagattgtcttgtgcatctccccccaaccccactttcaaacgggcatggcctttttattaaaagagctaaggctcaacaaggagagtcacacttggaatgacatgcatctcttaagtgcttacattctataatacacattccattatgcaccaaacacatttaggagtctctgttgaataaactgatatttatgtcccagtctttattacccaaatgtaattttgcattacatcataatacctactgactacagtgcagttattaagacatctgtgtaattaattaaattttttaaaacctgagttcttcagttgctacagaaaatattttcaagcctgaaactcagcagtttgatcttttgagtattctttttaaaagagcaatacttttatattatctggcttcttcaagtaaagaggaaagtaacaagcctgaaactcagcagtttgatcttttgagtattctttttaaaagagcaatacttttatattatctggcttcttcaagtaaagaggaaagtaattttatactgtcttctgctacttttgaattgtagcacgtaattgttccctgagaagcatttacatacacataagaaggttcatagaagttaaaggactctggtaagcggataagttacctcccaggaccttaaggatgttgaaaaaccagtgtgaagctatagggtagagatgtactttgaatgaaagaatcaacataaagatttcagtaattagtaagaggaatcacctttctaagtagccgttgccatttaatatttttaaaactttgcattgagttggacttactttagattttcttaaactccagagtaagaagttaaaataaacagactatatatatatatatatatatatatagatagatagatagatagatagatttttttttttttttggagacagggtctcactctgtcacccaggctggagtgcagtggcacaatcttggcttactgcaacctctgcccctccaggttcaagcgattctcctgcctcagcctcctgagtagctgggattacaggcacatgccaccacacccggataatttttgtatttttagtagagacaggattttgccatgttggccaggctggtcttgaactcctgatctcaagtgatctgcccacctcagcctctcaaagtgctgggattacaggcatgaaccaccacacctggcctcatgtgagcaccatgattttcagattatttgtccatcgcgtagagattctctgtgacattattgaaagacggtgattatgaggttttaaatatgtttattatgactatgtgatacctatgttgcataatgatttgcagaatgtttaatctggttctgtaaacaatgggtaacccggcattgtataagcaggacttttagggcacactcggaaaacaacttacttctttcccccactgtccgttctattaataatgcactcactgaagctccttgcttttggataaaatccagggcaagtctcacgacttctgcagccactgtcgttatttcaagaagttccccaagcttctttcgtttcaggtgtttctggttgatatgtgtttggtagaatgcctcaatttttcatagccaaactccatgaagcgtacatatgtttcaatacattttcagtcagagtctcaagttacatagcaaatacagtttatagaatgtcagactcatatgtagatgtttttaaaactgctgagagtcaacataagggatgtgtgtcttggatattgctgatgctgagagacatcacagcctaaaaagcaattgttggctgacaaccgtattatttggtgatcaggcagcagtgtttccattccaacagaaccatttgttatatgtgtgcacacacatacagagacagatgtaatgatgagtgtatttagttacattttagggaattatagaaaaataggaaaataaaatagttacattttagaaaatttggttgaggattttgactgatgtgtaatacattataattttttcctgtttaacataatgtgaaataggctctcggttaacattttgatgctgaatttctgattttcaggaacagattatgatgttaagtgtgtgtgatgcctgtaatttaatactccagtactgtttatttgacaaaaattttgagtatcatgtagtgaatcttcagctgaagcttctcccttccctggattaggtctgctccaagtagcaagcttatagtgagatgagcaaatgattcatttctttcctatttccaaagcttgtgtttttctcactcttccttcagctcactagccatggcttcatttaacccctccagggatggtgtgctggaaaaggatgacctgacagtgaggtcatctgatgttgatttttctagccaggcagcatgctgatgttttctctcatggaatgctttggttttctgaggtctttaaccaactccatccccacctccctaaattgatctttctctcctatagctccttgaagtgaaagaatacatgtcctcaggttgacatggtcagctcctgataatctaatggtctatcttcagcccctttctgctggaatttcttcccctcgaagcagccttcttgggaggatctaacacaaccctgggccaactctacctgtgtggcccacatctgatctacctttgccagtcatccttaggagagagttacttcccagccatacttgtcagcctttcagcctttctccttgaagattcccttagattttaagttagacatctatctattgtatccattcaggttcctgagacacagatcgagctccctgagtggtcgccctctcttgcttgactgatggtgagaggaaagcaattcacatggtgagacttggaacgcttcagcgtttctctccccataaatgctcactctcagtctccccagtctcttagacataggaagtgagcagtcagttaagtgtcccaaaccagttctcagccagcgcctttcaggctgtctttaggtggtctgatttctcactctggaatgtgggagtgcctgacacccattgttttgtggtctccccttaaacagaattagaaagagttctattttagcaatctgttaagaatgtagaggcttcagttagagtggcccctgaacacttacctaggcaccattttcaatgcctgtaatattaagcagcatagaatattaactatacactgttttgaagaagcctttacaatgcatttattcaacactggactgggtatatattggcactatatgtcgtgtctacagcgctcttcaaatactagctttcccccaggttgaaaatgagcactgttcaaagacctctttagaaagcttgatactatacattggctaaggaaaaggaccccttcctccatcatctgtggcgaggaccagtactcaggttcagaggtgctggccagctgccaacattctgcatattgtgaatttctttaggtccctgtagaatgacttgagattcctagacctgatttcttttttatgatatcattatagttacaagaggtattttaaatgtcagtgggtttattgttctataccatagaaccatgagtttgagtatctagacttgacttagcccctttatgctgtctggataaaggagcacctgaaacacatctttcagggagatgatttttgttttgttttgttttgttttgttttgttttttgagaccagatctggctctgtcacccaggctggagtgcagtggggtgatatcggctcactgcaacctccgcctcccaggttcaagcgatccttccaccctcagcttcctgagtagctgggactacaggcacgcactaccacacctggctaatttttgtatttttttgcagagaccaggtttcgccatgttgcccaggctggtctcgcactcgtgagctcaagcaatccacctgcctaggattgtaagcatgagccaccacacccagtggggaaatgatttttaaaaggagtttaagtccagcccctgtgcttgggtgatagggagggtacccgtcactttccactctcctctaatgaactaatcaggaaaattcatattgccatatattaaagtctttcatctttatataatcagaaaaaaattaagggcaatcacttagaggatgggacagaaatataatattgtttgacatactgggtacctaagttgaaaaagaaccccacaaatattcaaaactaaattgcaaaactgcaaaatgagagcattagagaccagtggttggtttttattcttgttttaattttcagcgctttgtctggtacctgccatgtggcaggttttaagtgtttgttttgttgatgatcaaataaaataattgagaaaataacttttttccaagcttgggcagatattgagaattaagaaagggacagtttaaaattatatccatcaagtacactgatgaaacttaacctaatggccttgggccttttggaaaacctgtttatgttaaactaggcaaatgttacaaatgtgtacatctttcaaataaaagactcacattctataaaaggaaaagaaacgcagataacgagctacaaagacagaaaacgctaatggacattgtttatatctattagcaaagtggcttctgtaggcctttcatttcctcctatggcctgatgggggtcagcaaatcctcatatgttttttggctgttgggaagtttacactttttttttttttttttttttcaataaataggcagtcacacgagcaggaatataatcccccctctccatccagagcttcaccatgctctgagcagtttgcagtcacatgccagtgactggctatctgctggttgttgaacctattctgtacaagagaaaacagatgtctgctcttactgccaagtccccgttcttgcattttaggaaccattccacacgcacggggaggtttttgttaatttctttcggatgatgactgagtgctttacgctgtgcaggacttccgatcctggcttttctactcacgtgaacgttagtagctgtttatcactctgacggccaatgtgagatctagttttctacttgttatggaagcccttgaacccttccatgcctagggacaaaggaggcctgttgaccctatttttatgtttggtcacctataattgaaagaataagtgtttttttcacacatagcattgtaaataataaaccagttatggttgtcactgcttttaaagatactaaactatcctcatttcaagaaccaccaccagttatcacatgcattatatgtcttgttcacagtgaatgtgtggttataagaatgcatagacaacaactaaaaagaaagtaaaatttaaaaagaaaaaaaaaacacccgtgaaaagaagggattagaaaaaaaagaattcatggacactttgttattttgtggcatgtgctgccagcttggagtttctttccattcttttttttttttaaattactgcaactttgtggacaatgtttgtaagatatgttgaccgtttgaaaagaaacataaataacattagcgctaaaggtcatcccaaatgaaattaggtttttaaccgacagggtcgttgctattgaaaacaaatgcattcacatcataggaaatacttacctgcgttagtctactctatttcactatatcaaagagtgggttaagagcccagttctttctgggattctgatttatagcatttttaaatattatttcctcatcggtaaactttcaagttgaatcaagactttaaagcatgtgtaatatttttaataatattttaataacagaagcaactaaaacacagatttagtgcctacattgtcgatccccttctaaaaattcttcatacataacaaattctcctatgaacattcttaaaaagaaagtccactccatatatactccatatatatgtgtatacacacacacacacacacacacacgagagaaacaatcttgctcttgcccaggctggaatgcagtagcatgatcacaactcattacaaccttgaactcctgggcttaagcagtcctcctgcctcagcctcccaaatagctgggactacagatgggcaccactacatctcgctgacttttttttaagagatgaggtctcactgtgttgtctaggctggtctcaaactcttggtcccaaatgatcctcccaccttggcctatactgggattgcaagtgtgagccactgtgcctggcctcacaatattttgatatgtgtttcttctgtaacattttttataccatatctctgtccaaagagtgttttagtgccctttaattaaggggtccccatctttattaaaagatagaacctaaaatcaaaactaagatgggtttgatcatatcattcccctgcttccatgccgccaaaaccgccctatttttcaagatgtagctttcaaactgcagtttcttcttcctcctgtttccccgtcacctaccagtgtgcaatcatgtgttgcttaatgacggggatatattctggtgaatgcattgttaggtgattttgtcatcatgtgcacatcatagagtgtacttacacaaacccagatggtgtagcttgctgtacacctaggctatgtggtatagcctcttgctcttaggctactaacctgtacaacatcttactgtactgaatactgttagcagttataatacaatgataagtatttgtgtatctaaatatagaaaaggtacagtaaaaatatggtataaaagataaaaatggtgcacccttatagggcacttaccatgactggagcttagaggactggaagttgctctggatgagtcagtgagtgagtggtgagtgaatgggaaggcctaagacattacactgctgtagactttataaacactgtatacttagactacattaaatttattttaaaaaatttctttctggccaggcacagtggcctacacctttaatcccagcactttgggaggccaaggtgggtggatcacaaggtcaagagatcgagaccatcctggccaacatggtgaaactccatctctactaaaaatacaaaaattagctgggcgtggtagtacatgcctgtagtcccagctactcaggaggctgaggcaggagaatcgcttgaacccgggaggcagaagttgcagtgagctgagatcgcgccactgcactccatcctggcacagagcaagactccatctcaaaaaaagaaaaatttttgttcttcattaatgaatcagcttattgtaacttttttactttataaacctttaaatttaagtttttgacttttgtcaagtatgtgtgttttagcttaaaacacatacattatgcagctgtacaaaagtattttctttatacatttattctataagcattgttctattttaaaatctattatttattattttctaaacttttttataaaaaactaagacactaacacacacattagccagggctacacagtgtcaggatcatcaagacattaccaggtgataggaagttttcatctctattacaggaccaccatcgtatatgccatccgccattaactgaaatgtcattatgcagctcatgtgcgtaatatcacaagataagcatggcttatcttcctggagtgtcggtgttacttactggtattaggtcaaaaacattgtttctctattaaaataaacttagataggaagtagattgcaaaatttacatgacttttttttaaagataaaacacaagacttcaagaacattttgcagctctggcaagactaccttgccttttgcctacagttacataattattctccttgcttttagcactgcttaagtaggaaagctgaagcagtagtgactgacaaagtaaaatcaaactccttagatagccttttgcaagcctcttgacttctgcttgatctttgggtcccaagtcaatgccatgtcctctgaacaaagtatttcctttcccatctactcttgagttcagcttttccaagagtctaaaattttccctacccagaattgactattttatacggctttgttatttcttgttttcgttaaattacctgtttttactgttggtgatcatgactcaaaagtagtgtgaactttgccatagagcagaggacggaaatttaggcagatccctattggatgctagatgacttggtccagaatccttcatgtatctctaagttgaattattagcaataattaaattgaaataatagcttcctgcgcaatagtgtgcctgaaatggactcctaaaaataacagtggaggagaggtcagttatttttagaaacaccgcaaacaactgagagttgtggttccatgagggcatcctctccaactcagtagtgccatttccagatctgctaagaagggcttggtgggatcgtgtctggcctgcacagattgtccaagcttcagacactattttcaagagtccagggtgactttggtgttctgaggttctgagtactttaaaaggacttgagcaaagaaagtagctaataaaaataggtgtgttaacataaatatctcaccttctgttggaaattaatggacaacactctcttctgttttagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggtaagccttctgcccagtctttattatgtcaacaacaatagctttgccaagttatcttggaaaattaaaaatgactaagaagagacagtttcagctagggttatgggagcagttgcactgtgaacttaaattatgtgtaaataccagactgcatttttccagatcttttgcaagttcattagaattcatgaagctgagcacactaaatatttgggtccttatggaaaggaactatcacatgagcaaaagttctgaacgtgtgtgtgtccttagatcatcaggatgcttctaactttttaaaaataacagtcagtctcctaaattcaatagataaatcagtatgttttttcttattcgatggaaatttgattcatcaataaagtaaatgagttaggttttaaaatgaaatatgtaaaacattcagaaaagtaagacaaggacatgataactgtgtaaccaccacacagatatgacaaatactaacattttataatttctatttcagatttttttttttttttgtgagaaataaaacctaggccaggcatggtggctcatgcctgtaatcccagcattttgggaggccaggcgggcagagttcgaaacctacctggccggcgtggcgaaaccctgtctctactaaaaatacaaaaattaactgggcctggtggaaggcacctgtaatcccagctgcttgggaggctgagacatgagaatcgcttgaacctgggggatggaggttgcggtgagccgagatcacgccactgcactccagcctgggcaacagagcgagactgtcttaaaataaataaataaataaataaaatcttctaggggccgcatgcagtggttcacacctataatcccagcatttggggaggccaaggcggaaggattgcttgagcccaagagtttgagaccagcctgggcaacatagtgagaccctttctctacaaaaagtttaaaaattagccaggcatggtggcacatgcctatagtcccagctgcaggggaagctgaggcagaaggattgcttgagcccaggaattggaggatacagtgagccttgatcatgccagtgcactccagcctgggtgacagatctgtctttaaaaaaaaaaaaaaagtctaaaagtctagttatagctaaagtgccctcactccttccatctaattttttatctttttctccccagaaaaaaaacacttcagagtagtggttattttggtttctgatggaaaaatactaaatagaaagctctttgattttgatcagaattctaatctaaaagcccatgtataaaagctgatttttatatgatgcattaattagaaacttattaatactctgcaataacaaataatgtgtatatattttaaagtaatgactttgattttgtaggaagaatttctgagggtttgcttttatacacaaatgacaatcacatcttacctcagacctgttatatatcaacaaagcattattattatgttgttttatatagaagaaaattgagacaaaaaagggaacttttccattgttacctaactgccaaataatgaagcaggggctagtacttggttcatctggattttagttcattgctgtttctgtcaggccagttagttttatcataaaactaaaacatcctatgagtagtaagtcaccaaggccagcatctccagcatgtgctccacttgttaaaatgacgcaagtgagtcactgaatagctcagcatcattttgtcacctctgtgggtgttctgaaaacagatcaagtcgtatcatttctgtatccaaagagagaattcaattaaattacattgttttttgaaactatcactgtttgttaaaactaagatgtaactctctgagtagtccaggagtatagagtgtttttagtagattattcagtgttgcatccattaaagaaaaatgatttgaagtaatttaagttcccagcaatgtttctcagatactttcagccacctataggaattgactaagttgtaaagttagcctccagcctttactcctccaaagccaaggtgacaaagaaagtatatagttgacttcactaatttaattttaaacctgaagcaaatgtaagaagcatataaggcgcaccctctcactgatactggctgttatcatgactttttagtctgtcattttgtgaatttgtgaaagcaaagacaattttaaaatgactagtattttagcaagtagaaaataccctagtattttaaactgttgtatctgcaattcactattatggctaacaaagctattgtgtattgatttttcaattttacaacaattacaataaaattatccgtttgatatacttgatcttaaacactcagtagattcttgctttgcttcagaatatactctattgttatcagttgtcattttactatagaagtacaaaagcagcagttagataaaaggtagaatagaccctttatcatattcacatttttactaggtttcatttatatccaaaaaacctataagaatgtttatgcatgcaccgaacaagatgaaagttaagaaacctttaaatatttatgtattctatttttattataaataggatggaatcaacagaaaaatgtgaagctgttattggtcattttaatggaaaatttattaagacaccaccaggagtttctggtatgttgtttgtctgaaacttcatcagtagtcttctatatgatgtatgtttaactttagcacatgatgactcttcaatagaacaaaaacccctcatttcactctttaagatgcattttgttggatttagaaataagacttaaaaattcacctctccctaggcataggcattggatgtttaaatgttaatggaagcagtggtaaggagctgacttgtaaagcattgtgcaattcactcctcttttgatgcagcagccagcttctgaaccaccttatcaccatcctcagtgaacctcccttcatttgatcatatccgttgagcactgtggtacctttctatcccagcagtgcctagacctcagttcctatggcctttatgtccactccactttagccactttctcccatggttttacattgtgttgtcattaccaagaacaccacacttcatgggtttttcattccaatgtcacacttactctaactcccacaaaccctgatctgaaatacaaagggatccttctcttttcactgtttattcatcctcctttacctgtttctctttcctactaagtctggtctccatttttgagtgttaaaatcatttcttaagtggcattctcctttttcttgcaccccatcccttgttcacactgtcatgacagaatgctgaacctgaattaatcctgctgtaattcacgcacaccactcctgttatatccatgcagccaaagattggcactaccacaaattaaatgtcttcagcttaatcaattgctcagcaccaccagtcctcactcagcttccttacccttccctagcagcagttctcaatttccccagcctgctcagtcccctacctaaccccctccctaatctcaagtggatgacttcacttcctacttgatgaataaaattgaaatcaccagctagaagctccgtcagcttcctgctctctcccagcaaggggacctacacccacatccagtcttatcagtcccctttcttaaagtctcatgtacaagggtttcgaagctgtccttgaggtgccgtctcattgagacattgctctgccagtcattgccttgctctcctataatttcagtctctgtcttttgcttttgttcattttttttttcagcaaagccgagaaatttgattttcagttactaaaatagatatctagcaagactaattggtgacgaaatggggggaaacgtgcaaacaagtaacactaggaacaaaacttgtgaacataactacaatagacattttttaaatcacaggattcagtgaacaaaaactatgaattacttcatgccaaaaatattcaagaagatagccatttgtgtttgaaatcatttaagtctttacaatctagaaactaaactaagcactctggttccttacagcaccttctcatgtcaacatttaaaagtgtagtcttcacttccttacttcccatttatgcatcactctctccaatctgacattccctggtgtgtggttgaaattcctcttggtaaatgcgcaatattagttagctagacagccataacaaagtaccacaagctgagtggcttaaacaatagaaatttagtgtctcagggttctggaggccagaagtccaagatcaagatgtcagcagggttggttccttctacccagacacccaagccaggctatgagggatctgtttcaggcttctctccttggcttgtagatggctgtcttctccccgaatctcctcacagcaccttccctctttgtgtatctgtctctgtgcccagatttccctttcttaggaagaccgcagccatattggatgaaggcctaccccctcgccatgatcttactttaactttgatgaccttgtctctaagtaagatcacattctgagggctgggtgttaggaccccacacagttcaacctgtaactcttaattcctgattaccccatctggagaatttcccctctttttatcctgtgtctgtctgctgtatgtatttgggactgctggcccctcactcatccatgaagtgcgtcctcccttgactacttttgcacctgtctccgttttcttcccatcttgtgttaatcctttctcttttgtaaacttatttcttctatctgcttttaattgttagtgttgccttgaattccattttttggctcaggattctgataatttcatctactctcaaggttttaactactacttatattcatagtcattgactctcattcatctctcatcctggctgttccccagagtttcagactgcctgacctcagttaccttatattcatcctctccagaactacactagtcccccttacctcacttcccatctaattctgctcttcctcctgttttcctgctctcagttagtggaaccagtatctacccagactcccaagctagaaacccaggactggactcccctacctcccctgtgctttgtatctcacatacaaataatcattcaagtccccaaatttttctttctgattatttctagaatctaccttctccctccctttcttctgccactgcctagtttaatttctgatcatctctcatctgcaccattgcatcagccctatttcttcttacctctctaaggtattctccctgactgtagccagagagacttagataaaatatatacctatgtgtcactttattgttaaaaatcgaccccctctcagttagaaggaaagattgaggattcctggaatggcatggaaagccaaaggtgacaggagcccttgcctacttctgcagtcctgtctccctccatcctctgccttcctgcttatcctcctccaacattgaactacaaatggtattcccaacacagcgtgctgcatcatttttcttggctttctctcatggtttccaatgacccagatccctttggttccctttagcctggctgtctcttcctcagctttcaagactgtgttcagggcttgccttctccctgcaaggacctcctctgacccagttgggttatgctgtgtctgcagatcatcaccttgaggacacctccgtgtgtgctgtggcacttaacatgtttacatgtgtcagtcccactaaactagaagctccttgaaagtagaaactgtatcttcagctttttattttcatgcccaccacaacttttgagccatactatgcaacaacaaatatttggtggttttgaataaattttactacactgtaacaccaggccaataccatgttcttaacaagctaccatgtggggggaaattgaaatgtcttctgatctgatttgcagccagccactagcatgccacctgccagaaaggagaaagtttcaaaatttagaaaccacatcaccttgctttgagggggaggtaatgaaattgttaaaatggggaaaaagaaaaaaagccacatacaccctcctccatctttctcccctgtaattttagtcatcttatgtttagctggcataatgcatctgtaattctacttcccaatctgtatcccagatcagcaagtcttctttgagccttaggtccatgtcagctaaaagtcctactttccagcttctgcccaagcatgcccaagggttaaagttgaggtttcacttagtgttgggtacaggtctggagagggagcctttaactgctaccctggccacctgtttgttggagtgtcaagtgggttcaccatatcaagaagatttatcccaaatactcaggctgggagagcagacactggtgctcatatctgaatgggggaggagtctctaaagtgagcaactgccacagaatccacaagaattagaacagagtgccccatttgccaaaacacagatttttgccactttttctatgcaaaaatatgtacacactgaagttaatagattcagtgaattgaaccttattaaataacataaaaaaacaggtcaggcccaatcttgaaagcaagcacagaggcaatatagaatatttatcccagtttttcacatgagacacagccaagaaacattgaggtgttttgaagttagattcattccagccagaagtcatggaagagagcagtttctccaaggctgtgcacgtataactagtgtttagtatttattccgccgtagctccactgttttatctttagctagatgactgatgtttaccattagaaattcactttaattttctgtattcagttgcttttcatttcatagagaaactaatttgtatgtgcagttccacaggctacacctgatcttgtaatactaaaacctgagagcacactgcatctgtgactgtatctgaagttgaactgcttacatacacaaatttggagcataaaatataaaacctggaagtaattatttcaagaaactcaatctagtggaagagattcctttttttgttttttaagttagtattgttttcccatcaacatcagtagagttgaaaaaaaatggaaagagaaaataatgtttttaacttctgcccaagtaaagacaaaggagaaattttgtacgtgggagtcttctgtaaaccctaccctgtcagcctccggcattgagcacctgtgcccagctggcgttttcttgctcctacggtgtcagcctttgcacgagcagggccccacacattagtccctttgaagggactattccacctacttgtgaccacctattcatccacctacttgtgacctctttgcttttttaactcattcttgtgtgcaacaaggaaagtttgagaaggaaaaacatctaggacacttttgttttgatggtgtatcagtctaagataagatcttccctgttgaaggaatggtttgctaaattaataacaacaaaagctcttcagttccttgaatacagtagatctcagggtgtcacagatcaaggttagacagtctctttttttctctaaagaacttcgtggttttgtcattggtgttttctttgaagggggtttgcagactattggtcacatccattcaagggaaataaaagccctagatttccaaaccacatgtaaatgatcgtaggatcctcttcaccttcacagctagtaaagagtaatttcttccaagctgtgccaagttacaaatggagcacaagaaacagattagttccttttacattgagagcgttactgcaggggtacagtttttcagtcaagctgttcactttgttctgaattagcacttaattttgtgccattttgaatgtgtaatgatcttttgagtgtgtaagtcttggttgacaattagattgcatgttctttgggggcaggagctatgttttctttttaattttgtgctagactcagggaacttgtgcatcaccctaccaccagaagttaccaacaggtttctaagagcatttttcatgcagagctcttcccaagaattattgctaatttgagggcctttttggataccacctttttgcacaggaggttaaattgcctttaggcatgaatgttaaatgtataatgccagacttggaagcacactggcacagtgaattcagctttttccaaaacaagtccccagtagacttgaaaacccacaaagaatgtgaaagagttttcaacttctctagacttcttttttcttttttttttttttcttgtatacatggtgacttcagaattcttttgagtaccagtttgtgtattagatactgttctttctttatatcccctgaatggttactccatagcatcagtttctctgtggagggcatatgattattatcagaagaaccagataaaaaacaaaaatattgtcaggcaggggtcagttgaatgagcctccacttgaatgtttgcataatgtagtctcattgataggtagacataacatttcataaatacagtcagaagacggtttatttaatgatgcaagttgtttagctggcgtaagcagaattatctgggatgattcctgtcagaatacttggattcttgcatggctggcagtttgcccatgacattggagccaagtacagaaaagaaacccacgttagacacaattcccgaaagatactttctcaaaatgaacaaactgaacaatgaactcatcctagctgtgacactcttaaggaagtctctagatgactaagcaggaggaagtcagctatgcacatgagctgtcacttctacactgcctgccctcctgccaccatattctttccatacccgagtggcatggctgggtccctcatgccagccatgttccactctggcctggggcatggcacataataaagcacatggttacagttttgtaaaaatctaatgtaccacatcacaatttctagtgccgtctgctttctgaaatgctcttttaaaatcttgtgcttttgtgtctgatgtcactatattttaaaagaggctttatcttttcttatagcagatgtttctttaaatgtatattatagtttgttgggggaaaaaataattgcttatgtggcctttccttctgtctttccccacccagtcctgcattttttcctgaaatattggaggtggcttgtttgtattaagtcagatttacatggaatgtccccaaccagggtaaaagaacccatggcttcttcatgacacagctaggtgaattccatcgagtttttccacaaccacttaatacttgcttgataaaaattccattatgcagaaatagtatggtggcagttttctacacaatgaatgttagaaacagagatgggaagttttagttatctagaaccagtgtccaaattaggagacatgcctcaggcaaaaacactgaaacacatgatcatgattcagtgatttgtctaaaaatgctcttctaggaccttcctggaagagagtacagtctttgagaagactaatgcgtatggcatgtgagctggaactatcctagagctgagaacagctctggcgccctgactccctgcacaaacacctctccccctcgccaccaccaccacctctcaaagacaaaggctaactgtgtgttcagtgctgcaggagacagtatgatttcccatctcgctttctgaacctctccatgacattaatggagtgtgaataagtccctgtgtgctaagggcagggaatgcctgttagattctcagtgttgcactgttatcattctgccacatcgctcacagcttcatcttgtcacagaggagcctcaatgaagtgcatatgtgtctgctggcagactcccttcaaaggcttcagcttgttttacatctgctttctgtgttactctgacttttccaattggttatgtgtccagtggggcttgaaaaccgctcttgcccacatttcataactctgtgtgtatagtgatattatgagggcattgtcctatgccaggtagcagaaaagataatgtttagagggaaaattatgaatctagtaaaaggcctggagatttttcaaaggtttttattgcccattttgttcccttaatatttctcttaagcattgttaccctgtaaaaacagaaaattttggtagctctaggacaaaagaaatacttgaagacatgtggaatgtccctggtaccttcaggatgtgcagtcatatctccctcacccggtacataaaacagaactggatctgaactcacacagcatcatgagctgtacctttcaagggctatactcttaagaagaattgttgtcgtgacagcaaaagcgctggaacaggcctaggtggccagtggggcaagggcggtcttgcagatccagaattcaaattcattcctactgaggaggagaagactagtttttaaaaagtgacaggggcccacaacctgagatgtgccagtgttctagtccccacaccaggcttatggtgaggctgccttacaacaattatcaccatcgatcacacccagcctacagccagcctcacaaatcaacattttacaccctttcacgatcaggttctgccagtgaggagtaaatagtggagtaagattttattaaagcacaaggctcttgggtagaagttgtaggtgttattgtgtaacagttttctaaaagacattgaccagtaactttatccttaactataacttcaacatttcttcattctgtaagaagccaaggcagcaactctagccagctccttaaatctctcagattcaaatcccatggataacaggccagtccccaagtgtttagaccttctgaaccagaagtgtccctctcctgagaatttttcttcatttgaaaacaagaggaggagccataattcaaaagtttgagctccccctgttgccacagtagttaagaacactagctcttctaagcacttattatgttaactataacaatcttttgaagtaggcactattatcatccccatttcagagattatgagaccagagacattgaataactttcccggagtcactagctagtaaatacaaaagcagaattttaaacccttggagactaattatgagccagttagaatactggttagaataccaccatacagtacacccaccactatagcagttggcactggaattaaaaaagattaagatccacacacagatgttcctgcggtgttagttacaataataaactatgcaaataaaatactatgtcaccattaaacaaggtagagaaggacccacaacataaatggtagaagaaaaggacctatcattgcaaatgtgaaaaataaatggctctacatagacttagaaaagtagtaaatatagaaaattaaaagatgtttgttggagtcatgggaggtatggagtttttgttttgtatttaacatgactttaatattgtcaaatcattgttttactgataaacaactcttagttgatgggttgggaagtgaggtgaaggagaatttcaataagaagaaaactcaaacccagcaggagcaaagcatgactatatataatcaggtaacatgattgtaacatgacgatattacaaatgttactctcttctcaaactgggttggagatagaaacactacctaaggcacaggggaggaggagaaacctaaacagcctcgggaggaagaacgtccacagagaaaagctgtagctcttcctagtggttgaataggtcaacagaattcagttagaaaaggagagggctaaaacaggaaacgatgttgtgcccataaaaaatagataatatttattggatccttattgaaatgttttaaaagcagcagctagttccttgcattttgtgagttgaggagtgttgaaagtagccaacattatcagaaagaaagctaattacagttgctgagtggactagttttccacagtggatagggaagcttctatcaagggcagtttacattttacagtgttttgattaggataaaatacagcataactagaaagatggaagtttggaagtgacagtttctccacctgttaactgctgtcagcatctgacagggaaaagcacggagaagaccttcgttagaacctgctgaggaaaagatcagttctgttacaaactctagagagctccaagtccttccaagctgtttgataagtgaggaggacttgcagatctcatcatgagctacagtgcttactcagagcaggcattctagaagtgattttttagtacaaatatcaaagaaagacattggagcacaaatcactgtagagttaagtttcagaagatcggtaaggaaaatactcggtggagatgggcagcaagtcagcctgagccttatccatggagctcacagtctcaggaaggattgtcagtaccacaaaatcaagcttgtgtaagagaccatcccactctcaaagctctgttgagagcacactggagaatccagtgacatgattaccttagatggctcttaagagatgccggaaaatattagatcagtgtttgcattgcagtgttgcctggggcctttaacaaatgctcaaggtaacactgcagttgtcaagctgttggagatgcatgttcctgttggttctgatgaacaggaaaataactctttagttttgggtgatgagaatgagaatccctttacaaacccaaaagatcacaactaattaaggggaaatttaacctagaatgctctgcatatttggcaaaatcagttgatttaagggtaggttatatcatttttatagtactttaacacaggaatacatcttaaatcacaaatcatttgtcagaattatttgtaatcactgctttgcagaataaggtaaaaagttgctaatctggaaaagtaaccatgcatatagaagattgacagttacatattaatttttatattaatttggccaaacttacatatcactcaaagtcatatgactagtatttatggcacttccttttctgcatgtcagtcttccggtatctctcccttgtaaaaaacaattggagttcagctgaaaggtacgctctatagaacaagctactgtcacataggatctcctgattcttcaacctgtaacctgtatattcagctccaaaaggcaaactagggactaccgctggtttggtagaagccacaggagatgctggccaaatgaggatctctcattttgtaacacgctcacacacacttaaaaataagtgggtcatgacatcagtgtgttttgtttgtttttcctacccaaaaatctaacagatcatctaacccttgctcaacatcatggtaagaccacatatcaattacaataagtcaggcccttttgccaccctaaaatacctaaaaatttcttaaatcttgatgtaatttgctttcctagggcacatggacaatctttgtaatgaataaaacattaagaacttatagggagaagctgtttctaataatgtccttcaaataaatggaacagcaattgtcaaagaaatacagctgtttctgcatcaaaagtattttgcttctggttagcatttttattgaaaacaaatacctctaaaaacaatgctctgttccataaatgactaaatgggttttcatgagattaggtacactcttttctccattaaactgcaagccccagggaggcaaggaccctgttttatctaccactgtatccccagctcttgtgtacttggcacatagtggacattaagttaaaattttgatggttaaatagaccaaagagaattttaaagaggaaagctgttagaattttatattgcttcacatggaatattggggtactcccatttccctgaaacaagcagccagcaactatctcagaaatgtgtcatttttactggttataattcttaaaaagcttgttttcctaagatatgaaatgcctgccagtatacaaactgttgtaactacttccctttttgcttttagcggggaaaaaatagcttaatgacagcatagaatcatgtagtaaatataattcattttttgaaaggttcagctatatcctcttccatttgtttattttaaatgatctaattgcaaacatgtcatcactcccttgatgtttacctccttgttatgcatttttagcaggctttattgtcacctgagattttttttttctttgacaggctggagtctagatgaaggaaaatgtgttagaagcaccttatccacagatggggacacttggtcattcagcacatgttgagcttaggcaggcatcagggtctggctgcttacctgcttttattcacacctgcctgtttaggtggcctgcactgaacttctagaatgagtccaacctgatcatttactgtctctgaaagaaattatgctaatagagaaaaacggccagttgggatcacttgctgagccaagtaacttctttaaaaaaaacaaaaaaaaggttaaatttcagtctaggacctagttttcataaaccctctagataaaagcacctcgttttagagaagacccactatgtaccagcaccaccaaatttattatcttctctcttgctctacgagattatgtggagtcaacatcttacaacctcaaatgtcagtggataaacctctctagatctgggccaaggcttgctgatagtctcaccagacacctaacatttttgttcctgactcgtcatacccatagtccagttgtcattcagaagtgagttggcattccaacccatccctccagagtggttcacaccagggaaagaagaaaggagtgccaggcagcagcccagacagctcacccagaaggagttacagttgggctttttgttttcttttgttttgttttttggcagagaagtgttgaaagacactactgcttccaccctgtcattagtgggtgggtaatcatgaaataaaataagagatgaattaggataataagaggcacaggagaaaggagtaaattttccacaagtaatatttttctcttcgtggttatttaactttgaaacagaacttgaaagtagtaatcatggttctacagtagacaaaggacagaatgtgggaaccagacaggaaggtgtgattgcctttattacattaactagaaacacagaaaaatgcacaactttctggaatacactgctatttccattgcagaaaagcaaagaaaaggaaaagttactggtgccctattgtgctgtctgtagacttttttttttttttaactctaatgagtatatatctttgaaaatattctctacatcttctgcttttctgttttggcctcatggattctgtaagaagaatttatataaatgtataggtatatagtaatatatattataagtaatatagtaataatatacagatctatatatagtggtatatagatatatagtaaagcaatacccagttgtatgattaaaggcacagaaaaacctttaaatagggtggacaagtatttttagctttctcacaacagccatcttcactgacgtatcccaaaaataaacatatgagacctatttctattcattcactgatgcaaccaagatgtaataagcaactacaaagtccagacacttaggcactggggatacagtgatagacaaaacagacaatgttactgcccccatggggcgtatagcctagaaggggaaacagacaccaagcaagtaaacatactcaccaattgttacaaattgtgaataaaaatatatgtgcgagcagtgtagaggtggcttgttttctactgggagaagtgaagggtccctcttaggaattataatgggacgctaagggaccattttaagttgggggaggggaggatggcacaatcctattgaatttgaagattattttggtgacggtccagaggtggaattggagagggcccaaaaccaaaagaaatgtgtctactcttaagtgtgaaagtgaatcgaaagattcctttgcttcctcagaatagttatttaaatgttcagaaataataactagtatgtttttctgcactatgtttttcatcgtggacagttttacaaaggtctgagtaaactgcttttgccttaaagtgttgtatgaattttctaatagcgtgaacactattcctatttttgtaatacattttgtcatccacatacacgtatcattgtggtttcattttatttttctctgtttacttagcccccacagaacctttattgtgtaagtttgctgatggaggacagaaaaagagacagaacccaaacaaatacatccctaatggaagaccatggcatagagaaggagaggtgagacttgtaagtcctttcttgaaactttgcggggtgggggagggggtgtgatcttgaatgcccacatgaaaagtaacacaaaaaggcatcttgacttggctgcacacttctgaaataggtgccaggattaaatcttcctttcggtacattataattcaagtgatgccaaattaaaattcttttcattatatatggtgataacagagtgattctccagatggaccgataggtggtggaagcagctgtgtttaccagctagctacacatgaagtaaaagagcattctaaattgccataagaaaaacacaagtgatttgggtttgtttttggtttttttcagaaacagggtttctgtaggctaggcgcggtggctcacacctataatcctagcactttgggaggccaaggcaggcagatcacctgagatcaggagttagagatcagcctggccaacatggcgaaaccccgtctctactaaaaatacaaaaattagccctgcgtggtggtccatgcctgtaatcccagctacctgggaggctgaggcaggagaatcgctgcagcccgggaggcagaggctgcagtgttccaagatcatgccactgcactccagcctgggcaacagagcgagactccatctcaaaaaaaaaaaacaaaataaaaaaaaaaaaaaaagaaaggaagaaacatggtctctgttgcccaggctggagtccagtggtgtggttatagcctaccacaaccttgaactcctgtgctcaagcagtcctcccacctcagcctcctatgtagctgagacgacagggacatgccaccactcctggctaatttttaaaaatttttatttttttatttattttttatttttgagatggagtcttgctctgtcgctcaggctggagggcagtggcacgatctccgctcactgcaagctctgcctcctgggttcatgccattctcctgcctcagcctcccaagtagctgggactacaggcacccaccaccatgcgcggctaattttttgtatttttactagagatggggtttcaccgtgttagtcgggatggtctcaatctcctggcctcatgatccacccacctcagcctcccaaagtgctgggattacaggcgtgaaccatcgtgctcggcctaattttttaaaatttttatagagataggatctaactatgttgcccaggctagcatggtttcttagaggggtttatatttataatatttagaagttatcctaaatagtaatctaaatatttatatataaatagtacatttatcactgagttggggtttttttcacctctcttttgaatagttttttttttaattaaaactctcaatttcgtaataaaatgttggacgtccatttccctgtattgactttccatgaattattattttaaaaacaataacatattgatccaagaatgtctagggaaaatgttctagaatctgcactgtccaataacagccaccagccacaggtggctctctgagcacttgaaacgtagctagtatgctagagagattgattttttatgtagttttaaatagctgcatgtggcttatgactatcacatgggacagtgcaggtccagagattaattttcatatttatagtcattttgactaacagaaactcccaattttatcaaatgctactagactctaagtacaaattcccctccctcccctttttttttaagagacaggggtctccttctgttgcccaggctggagtgcagtgatgtaatcatagctaactacagcctcgaactcctgggcttcaaaaggatcttcccacctcagcctccccagcagctgggactacaggtgcacaccaccacacctggctaaaaatagaatttttaaatcatgcctttctagatgaatgtttatatttctttctctttcccataggctggaatgacacttacttacgacccaactacagctgctatacagaacgggtatgtcgttaaaataaatccataatggcttgagggaaaatgtgaaggtggaaaatatcagacatttgttccatgaattattctatttaaaggattacttaataaaggcttttgtgtttgttctagattttatccttcaccatacagtattgctacaaaccgaatgatcactcaaacttctattacaccctatattgcatctcctgtatctgcctaccaggtttgtacctttaggattcgtcagcagtataaccacttgcggaccatgaatctctgctacatttttatgtgtcttaaaattttgagcgtttatgaaatttgagtcaaatattatgcagcttggatacccaatttagtatgagctgctttgtatttggcagagcaatttatgtataggagaatgtaaagcaaaggaaaatgtttgtcagtggtcagtccttggaatcatagcattttggattggaatgaacccaaacacttccttcaccaaggggccctgcttttggacaccatgtgtcccaaaaattgaaacttaagataattgccgttagatataatacagaataggtgtgtacccttgcttttgtttattcttcagcaggaactgataaaagaacaagtataaacatggtaatacataaagatgtgtctctagtaggtagcattaagtgagcaatgcagctgacatttgaggtaaaaatataaaagcaaaaaggtgacttcctgtttaggttaagtgaggaggctttaccttaaaataaattcccaacttagcaacaaaaactcttgaaatgtcttgtatttcaagatttgatttgattttaatgcaaaggtagctcctgtccgccatgaacccagtagtgtacatgcatttctcctcctgtgtcagaaaacctctaacaggattacttcctggacccagataggaaccttataatggagttcagttgcagacatgtgggagcagagttcccttttgttgaccatcaggatcctgtgtgactaaatttttgtgtattcttgattttaaaacaattgaattagatgttgtagtcctaatttctggggttagaggactacaatatgtaatctaatagttgtgttattttaacttctataagcctcagtttcctcatctttaaaatggggataataatagtttctatctcataggcttgagagaattatgaaaaccaaatgagactgtataaagagcccagccaaggacctcacatatcattatcactcagttaatgttagctatgattattatcattaatatgcatgattaggtggctgataataagagtatattagttatacgtttaaataatgaattggccaacataagcaatgtcatataactaattctgcctaaaaacataaaaatggttttgaataacagaagtgattagatacgctaaaactgaggattggcattatcattcacagtctcctatgcttctaggctcttacagcctcctttccctgagttgtcactcgttttcttttcttttttctctctgggttcttatgttacttattctggtgcttcattctgctgggcgtagtattgactaatttaatgcctctttagttgttttggatttaggattcctatcctttctttgactgtataagactcagtgagatctgctctagtgcacttccctaattaacaattcatgtgtctgctatgaaaaggtagtctttcttaactgtctgaacttggaaacctctgtcatttatatgtcactgaaaataggggcaagtgtaagttattctcaggcaaatgaaaggttgtaagtattaatttgaatttatgttgctatagatattacagctattaacacatttctccaacacctctttttccctcttataatataaaaccagtgtgcatttggccacagaaccattttgtacaataaaaattaggagatctgtgtcagtaatagatttgatatagctaactagaaataacatattatttcagaggccttatttcctctcctgggcattctgtatttctctaagatacatatggaatttcattgcattgcctgacactcggtgccatagcctcaaagactgatttttaactacataagttcagggacctagtagggtcagtggatgagctttaagtgatctgtgactccttaagttgtttgcaaaatgttgcttgtgtgtgtgcaattaagtggggaaaaatgttctatttccctaattaggttttcagagggctccatgaccctaaagaggttaagaaccaatagtaaagagtttacaaaacattattattcccattttataattagaaaattgaggaatagaaattgacagcagctgatttgctgcttaagaaagaaaattagatgtcatagttccctaatcctgtaatgctataagctattagattattaagaccactgaagcatataaaaaatgggggcatctggcccaaattagggtctgtagggagttgtttgccttcccatcatatatccagtgagggccctgcactcatgttggagtgggcctttctccactaaaccaccataagcttatgcaattggatttgagaaattggcagctgcaagaaaccaccaaccccaatggggaaaggctacagtccagataactgaaatgttaacaaggcagaagcacttaactttggtctgccttaggtggcaaaggaaaccagagaaaacaagtatcggggctctgctatcaaggtaaatcgcaatacattcttcccccatgactcttccccatatcctctctgttgaacctctgaagttaacaataggggataaaatgcaggagggttttgttgttaagaattggaaactgaaacttaataaaattacttagactctggaaagctctgggcatcaagaaatgggctgatatgtttttctcttgagtggcagactacacatgctttctttcctgccacaaaacctgactctcacatctatttctcaattcagagggtctactgtgtggatgcccatttgactgtagatgtcaaaatctagttactgaagtttaatttccttaatctgaatttcagatttttattttctgcactaagtagaaattgttgaccacaatacaagatttctaaaattaatgtcctagatatgaaagagaaattgaatttggttttttgtattaaataagcacatactttaagggttagcttctaataagatgtgctggaattaatcgtcattcatctgtaattctaaagcacctagttcataccttgattgttaacacttttcactatttgagttgttgctgtgtttatctcccttgcatagatagtaaatttcttgagggtggggcccagtctgtttcgcctttttctctttgttgcctgatactcaacaattacttcttgagtgggcaaatagaaattgtttctaaataatcatttcatcctgttcagagtgaccagtttgccaagaattctaactgccttaatctttttaatcattgatagtattgtttccttgttttctttctgtagatttttaacatgattaaaaagagttctaaagaaataggtaagctttacaatgaaaatcaatatttctttcaaaatcctcccttttctaggtgcaaagtccttcgtggatgcaacctcaaccatatattctacagcaccctgtaagttttttatcttaatgactttgtgttttacaagtaagttatgtgtatattctctctaggttaaaaccatttgccaagggtggtataggatttgggaaattttaaacatggaatatgagaatgtacaatttcattataaaacttcttctcatccttataaaacaacttggtagaagatattaagttacattttctataagaacttaaaatatatcatatttgaggcagggcaccattttcttattcataccagctctttagagatcattcaaatgagaggctacatttttaatagtacttgggataaaaccgctctcattttttacattctgtttaatgcagatataaagttcaaaaccgagatgaagattttcatcagtgttacttggcctttctatggagattataaatactaaagtggtagcacattatttggtaaataacaaatgtgatttcttaatgacgtgagcattcatatatattacatttttttaaattgaatgagttatacttattatatagtgtatttcatgtgtttttcaaagacacataagatctagtttgtggaagaagggtttgaaaatttaaaaatacatatggagaacaaagttacaataaggctaaggatgtccaacacaatgaccctgcatgctcacatgagaaaatcacaaatttggctctaagctttctagtaactgatgcaaaatgggaatcctggtaagcaatacagttcacaatatgtgtaaaataaaaacagatttggttgcttagaaaaagaactgtattcttggccttatgttcagacagcaatttgtcttcggataccttttaaagtggatactgcgatgtaagaccatgtatatgaaatagcaatccagggataacaggttctgaatgagaaattgctgagatgacctttaagaagcagataaaacatgtttaggtgatgaaataggagaggcgcgctctgatatatgtatacgttttgtgtgatatatacacatacatatagatctatacatgtgcacatacatagacacatcttcaaacccacacttacctgtacatgtgtacataatatacatgcactgatccacacatgcccatagcaatctgtgtccctgatactccatgctaccctattttggaatgcttggaaatcagcttgctttgaatttgaggacttcctattacagatggtgccaatgaatgagaaaaaggagcaggaaactgctccaccatcttctaggcttctgagtcatttccgtgttaccacttgctttttgatgatgcatgttaaaaaaaaaatttctaacagaatgtattaatgacaaacattatctctgacacacatctatatctttttttctttttggcaacatttgagaaaaagactgcacgtatctgagcttaacatctttgaggagacattaggaatgtaagcagaaggttgctatctgaggattcattacctttccccacccagctttaaactgcctgatttacatcagaattaaagttcctgtacacctaactctgtcctagattgtctatctaattatcaataaataacagttgtatttaagggatgccaggtacagtgataacaaaacatacattagtagttacagagcgtgtcagaatacttgcattctcagataatgaggtgattgcaaaagtccaaaaataaagagttcattgaattttggtttatacaatcaatgtaaccatttaaaaaaatgatgataatgatagtttttcaacaagctaggtaaatggttagaatagaatgcaaagttaagagcaaaatcccaggatatgaagttgttgatgtgctctgattgaacctgtacagaaacacacagaggctatgatctggcagtagtaccctgacattgctaacagtggttgtattagactggctgagttagaagcaattgttttttttttccctcctattttcctaaatatatttaatttgattttaatgactaacattttttcaaattaaataaaagaatctggactcagattattaatcatatctgaattgccttccctcccaggcaccaaaatgtaacttaaagttctgagaaacactgagtgaatgaagaaatgtgctcttgatcctaacaacctgatcttgaaccagacgattatctggatagaacattgttaaacaaaatactatattgatcttattaaatataatacattgtttggtgactggagaaaacatcaactgccttttttttccagatttttttttaagaaagcgttttgtaaccctaggcaggcagtgataatcagtttgtttttcctatgatagctcctcctgctggactagcttgcttccagttactggaagtgaagggaaagggaaggagaagagggacactggctttaatacagggattgttgtgaagtgaatgccaagatatcatttcccctaacgctcttaaaaaactctcaggaagagcaatttagaagatttttaggaaactgtttatgatgccatttgcaagattgaggaaggttgtttttgcttcacattcttaaacaaactaaggtatttcctttgtaaaaagtaattacaggatcttaactcttgcctcagtttgtctaattttgctcctgtctccaactccccagggtgccgtgttaactccctcaatggagcacaccatgtcactacagcccgcatcaatgatcagccctctggcccagcagatgagtcatctgtcactaggcagcaccggaacagtaggtggcaaataattatcatgtgtctctgtaaacagaggagggtaaattaatgcagcctgtatcttccctatcaaatgacagcctctatgataacagattatgtctaatcccctctcttccccccacatgaccttccataaagtaaatactcagctatttcttaattaattgatgaactgaaagtctattctctgggtatctctcctttacgagaatatagcacccacacgtgaccacatctagccttttatgactagtgtcatctatataactagtaccactgtccctgtggcagtgtcatgaagcgaaagacgaaggtaatacaagatggtaaaagcagggaattatttctcgcttatttcttcttttatggagtttgggagtattgaatcatggtcttaatattgaaatatttcaccaaagtccaggggactcctttgggtaatgaggttgagctggcaccagatcagcttccagatttgatgcttagcattttgctggtaagatggctaaaggattttaatttagcctctattctatagtggcttaaaagaacaaagggtggtgcgttttccccttatacactcaaaacctacagctgtttcttgtgaaggctaagccagggccacacatatccaatgagactgactagaaatttctcctgcctttgggaaaggatgactgtcagtgtcagaaaagccaggctctgctgcctaatctgcagtgacctgttagaggtctaataagtcttacccctgtgggctctacctgtagaaacaatactaggtactagtttagggggctgctagaaaataatgaggtcctttgaggagagatcttctaaaatcacacattagtgatactgaattattgagagtgacaaacttttttatcttcacccataataaactttttttatcttcactttgttagcaaatccaaagaaatgtggaatttttagtttagcagattcaaaaagtagaaaacagtttaccttccatatgacatatttatatgcactatttaagctttgaggtgtagcccatttaaatttcttctttgagatttccaaatacattatatccatctcacaatccccccacgtactccaaattttgcatggtttaccattgcccattctgacctcattcttctttctagtacatgcctgcaacgtcagctatgcaaggagcctacttgccacagtatgcacatatgcagacgacagcggttcctgttgaggttggtagagaccatccagtgaccattctggctataagtagtttcagaaatgggtaaattaaatagaactcagaaaaatctaccagacgtcaaatatttgcataaagaattgcgtttagccagatgtggtgggtcatgcctgtaagtccaacactttggaaggctgaggagggaggattgcttatggtcaggagttagagaccagcctgggcaacatagtgagatcccatctctacaaaaaataaaattgtttgaaaattggccagacatggtgacatggacctgtagtcccagctactcaggagtatgaggcaggaagaacccttgagccctggagtttgcaactacagtgagctatgatcatgacaaattagggtaacaacatccaggccacacctcttaagactcccagaaatattttctaagcctatagtgcctttcatacccctcggacgttctgtcttgtctctcataaaatgatactacagacataataagataaatctggagtttgcagtcccagtactaaagatcgtatcaatgataattaataatgacgaaaagaaatcagttgtagttaagatacttagtggaaaagagaaagctgttttgaaactgctacagggatgaagaagaagctatagctgtttttacagaggctgttagtatggctagataactgttcttgttatggaagatactgatatgaaagaaagaagtctagcatttgaattatggttagagagaaaacgtggcattttcctgcaaagtatccttaaaatttcaaggaaatgtatcaatccagttgatcttgcccactaggcagatcccaaaggttccaattccaggaaaggatcataggactctggcctgttggtggaggtggtggtggtggtggtgatagtagtagcagtagtagtagtagtaggtgttggtggtggtggtggtggtggtggtggtggtagtagtattttacttctgtttgtgcaattactgacaaccacagttaccagagcctacaattccttacctgcaatctgaaacccaaaaagaaatctgaaaataaaaattatctttgtaactactttagcataaaacctgacctatggcaaaactcaacctgaattgagatgagacaaaatcttgatcccacttaactgtgctgcttcatggcttccagtgtagaactattaatatgtttgcttatgaggtgcagccctagaccctactggaggcattaaatgatatacagcatatgcataccacatttcagattataaaatctgaaaatactgaattccaaatcacatctgtccccaggggataagagggtaagagatttgtttgatatgctgtagcttgataagaataggaaagtcataaacatttggatgggaggtgctttgggtctgttagacatgccagctgcttagggaaatgattaaccttgaaagctctacatgacgtgaagaaatttactttaaagagtaactgtttttaaggcactgttggattcagtcaggcctaagtagcagagctgaggttttttcactaacatgtctcatccattctgctttgtttgttgtaggaggcaagtggtcaacagcaggtggctgtcgagacgtctaatgaccattctccatatacctttcaacctaataagtaactgtgaggtatgagggaaaggtcttcataactggggggctcaaatcaagcacaatctatagggctttttttaaaatcagaatggtgattgggataactcggattttatcatactgctttaatcgtggccaaggcatctagtcttgttgaaatattaaaatcagtgattttatgaatttaagattaatcattttgtctaaagagaatgctttatactgaagccaaatgtatactctccccactaaaaagaaaaaaataaaaatctgtaacatcagagaacaccaagaaccaaaattgttctataatacaagtatcctatatcatattactttaatactcagaaactggaggacctatagcataagatgttgctcaatctagcattacaagtttagcaacatcttgattatgaatttagataaatgtcaatatccttagattgaaagattatattcccaactctcacttgaaccacaaatttcaaaacttttcactttaccatgcagactgtaataaaatagctgtgtagaacttagaataccctggtttctgcattgccctggtgatatagaataccttggtttctggattgccctggtgataacatgtatttttgatttcataaagtcactctttagagacccaaatgaatttggctctaaattagaaaagaaagtattttgcaagtcctggatgtgacaggcattgaaagtaaccatcagttccagagtctgcatttatcagtctaccatcagtgatgagcataacctttttcaaacacatatctctttaaaacaagaaacagattacaaagctctgtagtgtttcacaccaaatctacaaaagcatttgtcttttatttttctcttccagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggctttttt

SEQ ID NO: 36477 - DNA, 48449 bp, Homo sapiens
cagaagcaggggggaatcctgaatcgagctgagagggcttccccggttctcctgggaaccccatcggccccctgccagcacacacctgagcaggtaggaccatgcacaccccttcccaattctttggccgcctttgaccccggcctctgcttctgatctagccatttccttctcgccagttctggctttccccatccctcctctcccgtcgctcactgtagtcctgggaggtgggagcctgggaacagtggggtgtctgaaagctcagagccctctgcaccctccagcacccttcctgcatttctcctgaggcagttcccgttctctagataagagtggggagtagggggaaggtctgcccaggccccacgcccttgcaccctcctttgcggtattgcctaataccccttcccccacctcacctagactggagaattggcaagtgctgaggtaacagagagaggagagagccagagagggacctgagctttcccaagggatttctttcttgcttcctcacccaaagagctcaggactttgcccctactccctacacaccttgtaggggaactaatgtccccttccaggttcatctcacacttgggtggctaaaggctttgctagagggtagtggaggttgtgagcattttggtgagcttttcctctaggaaagttctttcagcttagagcccccatccatgtcaacatttcaacacctgctgcagaagccccccgaccccacctgtgtgtgtgtgtgtgtagggacaatgtggttgtaagatctagaagctttggatagaggtggctgcatgcattgaaggggagggataccagagtgtggcccaggccagaacaggctcagtccagatggctagggaagggggtgtggaccagattgaggaggtcacccagccttgccagctccctgagcttcttggctttcagaatctcaggctcctggtgtttctctagagctacaaggtccccaagcttctgccccgctacaggctctctgggagagggctagatggcacctactgtttacagtggcttatttttctctcctgtggtgggcagacaggccctgctctctgaagatctagggcgtgtcattctggtttggtgggtttacaggaagggtgtacaccttgtctgacttaccatgtgtgagtgtgtgtcttgcttctgggggtagtagactggggaggggggtgatagaagagactggtcacactgagggaactcctctagcaatcaatgtatgataggaatgggtggcatgtccccatctggtagctctgtctaggtgtggggtgtgctctgcattcttccatggctccccgggtcccctaaaggttggttttagaggacagggtggataatgaattggcttcagacttcgttctggtcttgatccaacaaggaaagtagagattctgactgtgagcagtgaactaggaatcagaggcctgaactggagacttagactggttacttaactatatgtgtttatataggtcttcccctttgctaagccttagtttctccatttgtaaaaatggctatcagtagcaagcagggacattgccactaaaaccacagagacaatgtatcgtaaagctcactgcaaacggtagtaatggctgggggaatctaggatggaatcctcttcctaaatctaggtcaatctctccgcctttagttttcttcccccatcctttgcccatctgggggatggaggaactaggcagggctattgccccggttactgcagaattcccctaatgcaggttgtagctgttaccagagcacctgtggtcacagagtacagatctctccaccaggcatttcttcctctggggccccatacttgctcccctgagccatgtctccaccttccttctgccatccctgcttggcgtccttgtctctctctcccctgcccagtggcctccttgtctggctcactgggcaggagccctaatcggattcgacagctgagatatgtgtggcggctaagagcaggcaggagggaagccagtgggaggatggtatgaggactgcccctggcactgccccggcctcccaagcaccaccttgggcctgctgatttcttacttggcttggccccaaggaaggggtgccagaggaagctcaggaatgaacaggctggggtctggagactaggagaggaggaaacacaccaaggtcctcaggacctggttgatattcgatgaccttaatgtcagtgtcactgactctgacaaggaggaaaggacagcgatgagccaggctgacccccgccaccccattcccatagccccactttcttctctcttcttgttcagaaatgtttcactttgcctcatctagcccctttggccagtaggtcacatctgggagcttctgggggtgccacatgtctgcctcaatctgggctgtttcctcccctccaagatatttcactgtctctgggctgggcgccaggactcctgggtttccctgcctgtggtgcagggctcccctgcagggctccagagagtcgcttagctggtttccttcctcctttgtggggagggccttcccctagggctgggaggtgtcaggaatcccaggtgggacaggggtgggggcacagtagcctctggcactgtagcaccccagcttctccctcctagcctctgactcagcttgggggcagcacatgcccagcctggcaggcatggcctattcttgcctccaggcttctctctttacagaagcctacatctcctgctctcattttttagtttttttccccatgatatctgcaggtggctagtgaaatccctggttttggggagcaagggactaacataattgaggctggggcactattttgtcttccctccagttgggccaggatgaaggagactgtcacaaacttccccaagccaattccttctgccctcaaaagaccagtcagtggagccaggccctgccctttgggtgcccacaatgtggttggcactgatttgtcagaaattgggaaggtttccctctagaccgcttgcctcctttctcctcctcccgcagggtaggggcagctctgtgattgcaggcacttatgggcaggcctccccctaggaaaggggtgtgggatgcccccaggatggccaagttggcgctagccccaggctggagtgctggacatgattctgacctgggagttagtgggggtaaggcagggcatgggcctccctgcccccctcatttcctgctctttgggcagctgtgggcgagaaaggctgcagggactatttttagttggtcagtcccctggcaggagggacgtgcagaaaagcacggggcaggcagaggggctggccaaggtgagggtaagcaggcaggcagaggagtgaggaagggccagaggggcagaagacagcaaggaggcatggggagcaggggcaggaccttacccagaggggcatgacccaggtagatgggccgggctggactgggtggaagagtcctggcaccctacagggttttctttatccagctggactcagagctggaaggggttttagaggctacctaggcaatcccttccccttgcagagaaggaaactgaggcctagagagaacactcaatcagtcattggctgtgttgagacctgaacccaggccctccctttgcaccatttttctgttgtcatggttcctcaccacagctcagtgtgcttcccttccctactgcagcaaggaggaccacgagccaggcacacctggtccattttcccatctgcttttttgtgcagggtctctgaaaatcccagcttggtttgtttataagtctccatgtggaaagagtctgtgtccaggctagaaggaggtcagagttgggtttgtttgggtggcctgtggccactggtgtgaatggagctgctggacaggctccagcaggctcacaggctggtgagctgtggggctaggagacaccttacagaagggacgtccagactccccagagccctttgtgagccctcctcctgccctgcccaggacctgtgggtcatggtggttgtttgcccatctccccaacaaaagaagggagcagggctgaggagtggggagattactactggcttctgatcgctagtcagaaggaggccccctctgaggcctggaggcagggaaagttggggcaagttggggtgtgtatggggagaaaactcaatggagaattgtggtccctcagaattcagtctgctttctgtcttctgcctcaggctctccccacaggccaccatgctgcacagctgcagggggaaccattccatagactatgatgtgaatggcaccccctggggttgttcaaggccctgcctgtgtagccacacgtggtgcatctgtctcccaccttcttccttcaaattagttcagacccacctggaaggaggtgttccagacaggccttaatccaacaccctctcccctaccctgcctcatgccactcaacatctcctattcctctgctgcccacccccaacgcaccaagcaagtcatggtgcaccaccaattgtggttcagaagcccctccccttctctctacgcagtttctgtgtctcttgggggctgatttatcataccccccatcaagcctactgcagtgtgtgagaaatcaatagtgcaaatggattgaggctgtttagcctgtcaactctccttgggccccaccaactcttctgggacttgcggagttgctcagtccccttctggctcaacatacacatatttagtggttgtagccagagcactgagcacaggaattattctttctgttggtctctgtctcattctctctcatatactaggctggtcttaacatgacaaatactcttgaacatttattttctagcttgggtggacgggcttaaagggcagtaggctgccagccagaggtagggagggaggcaggtgggtgagggatatggcgggtggaggggtggggtgggggtggggacgagctggggaagggattgggtgacagcccaccccatcagctctggtaactcaatccctgcaccccaccctcccaatttccctcctgctcaacaacttcagcagctgctggcagaagcaaggctggcagaagtgtgtttgagtgcatgtgtatatgaggggagagggtgagaggggctgtgggggcagggagtgctgccaggacatgttaaaggagactcacagcctgggtacaacttgggtggcaggaggaggtggggcaggtgggagagtgggtggtgagtgatgggcaggctgcagtgggggcagggcagcacaggggtctcacaaaacttgttggcactggagcggggcctggtgtggtgggggtgggcagtggtgagggggcaggggctggcacagacattgctggccccagaatgctgaggcccattctttgccagggggcgcatgtaaccatggagggacagtctgcccctgtctgcaatccttgggctgtgcctgctgggcatcacagtcttggtggtgactaagtcacttctgtcctggggctggcaaggtgccaggctcagctcttctcggtaggtgagtcactgccctggcatctcccccggatgcagctgagtcacccagccatgcctgctaggcaggtgggcaccaggcttgtggtgggggtggagggctatgtgtgcagcccccagtgtcttctctgatctctctctggcatgtcctggccccacccataaacctgcagagccaggcaaggatggcgcttctcccttgtgatccactaaggggtgaaggaaaaggtagcagggcacagagtggagtcatacatgtttgatttggagtaagtaggggaggaaagagttgaggagggaacattgattgggttatatgtatatatatatatatatatatgcttatatgtgtatatatatatatatatatatatatatatatatatatatacacacacacacacacacacacacgtatatatttatttattttaacaaaaaagacacagggtcttgctatgttgcccagacaggtcttgaactcctggagtcaagcaactcctggcgtcccatcttggcctcccaaagtgctagaattaaaggtgtgagccaccatacctggcctgggtttgaatcccagccctgccattgacaagctgtatgacgttgaggaaggcaattttctttttgagcctcagttttttcatctctacaatggcaacaggagcctgccccttcaggactgtgagaatcaaatggagtgggactattaaggtacttgtgggaggagctccttttgggatgagctaggaggcttgggaggggaagaggagtcagctggagctggttccaacaaactcccgcaccatggtcttggagggccaattgcttctcatcatctcttcggagtatcacttaatgctgttcttcaggagtttccacaggctgtgagaagacagccttgttgtactagaagtgtgggccctcctagggtgtctcagagctatattttatctcttttgactactgagaactgccactggccctggtacctgtccagactctcttccttcacttcctctagtttgaagagggatggggctcagactcctcccccagcctatctcctgtgtgcagggaaacagtaggccccaaggagtgtccttcttagagtgaggcgccccgagcctgtggcttttctctctctgctagtttcctgctgctccctgggtacccttctctcctcctgcatcagagtccctggtgggagggggtggtggaagccctgttatgagcccagcatagctggagttcaactgctgctgcagattgaagactcctggtcccccacctggggacctctcctgccttctgcagtcaagcttgggtagggctgggccttggacaggtggtactggtttccctggacaggaaggaaatgccccaaagatgtgcatgctttgtgtttgtacacacgggtgctggtcttgtttgagtgtctgacccctgcggggggtgggtttgtgtgtatgaatttcttccctcatccacacatggggctacttctgtgtctgtgcagaagtgtgccccaccctctgcttcatgcccttgtctgtgcacaaatgtgtttggatgtacttgttcatgcgtggatgtgcatacatgcgtcggggatgtacacatccctgccctgaatgtgcacgtggaaatgcatttgtaccaggatgcctgaccctatgatggcaggtgtacctgaaggtcgtcccacttgggaggcagtgtagctgtgtgcatgcatgcttgcattcttgtgtccatgagccttcccctccagcctcaaggaaggaagacaggtaggatctaggttgggaggtgtccgtgggcactaggggcgggctggcgctgactccagtcctgggctggttctcacctgggcagagctccctgctgttggcggggctcaggctggaaggcccttgggggagcgcggctggggggtaaggggttaagcggtggcgtccacatctgggagccattggcgcattcctgccggctgagcgcatgtttgcggatgaatctggacaggacagggcgggaggggctgggcgggaggttcgcaccggcggacggaaatccagacgggagcgggagacagctccggcccagcaggcgggaaggggcctggggaagcgcggcccagcactgctggggcagtttcccgtgcgccggccctcagggcaaagggtcccgccatcctggcttgtcctaccttaccatggctcttgggctaaagccagggacaatcagatacttcaattctagacccggctctgcaaccggtgcgactgtgcacaaaacccagtgcctgctcttggactctctttccttgtttgtaaagcggggtccgtcggaccagtgggtttgagagctctgccaccgggtcaggctgagagtctcctcactgggctggaggcctgggagtgcagcacttccccttccagtgggaagttctgtgggggcacttgtggccacttctctgcctgggaacagggcgagaggggagtattctaagcaattctgcttccccctaagcccgccagtggactgctagcgatggggacaggatcctcccaaacagagctgcaggctgggaggggggtcatgactgtattggggactgggggtctctcagatggagggtgattcagatcctgtccagctggaacatgaaaaagagctttcctggcttctccagacttgttcgggagagagaagcttgagtgtgagtctttgagcacggaggggtgctcctgggcgcccctactggaagatccaaaagtcttgccctttgaggagaagagtactttaagggggctgggagggttgggttgagccagggttcctaggacccactggagctgcagaggtgtttggggaaagaagagatatacttgcgggagatctactcctggactctttttttttttttctttttcttgcagctgagataattaagatccagggaagggaagtgacttggtcaaggtcacacagctctcagttccagctggtccctagaagaggattataattataggattcaggggcttgacagctagggcaggagtcaccgcactcacttccatattacgccgccgcctcacttctcagatttaggtgtgggtgtgtgtgtggttggggggaaaggagtgtaggataccacacgctgcggtcttctccaccgagcgctattttcattctttccgcagaacctcaccccgttcttgctctgaatcttcggttctgggtctgagggagggattctcccggattcccacggtccagtcttcaactaggagtggctcctttaagactcgcccttcccgaggtctattaaggagaggcgggggcgggcgtgagcctgtagatccgcccctgactggtgattggtcggtgggcgggcaggggcgggcctgagggacagggcctccccctacctctgctccgtaccctccgccccttcagtctggggctccgggtaaagtttcagcctccgcacgtgactcgctatggccgctgccatcgccccgcgcccctgagccgcggccccctggacggctcctctcccgggaccccgcaccctgatgccgagcagcaccagggcgccgggttagggcagacgctgtgctcgctggcaccccgaacgggttgcttcccccgctgcgaggtaattcctcccctggggattttggggagcccctggttcccgcaggcgtcggggccccatgtcctgccccagattggtgctgcgggaggggactgggtaccgggaggcttccgacgggaacccggggtttcctgggcttcccaactcgctgccgccgtgtccagggtgggggagccccgtctgtgagtctgcctgcgccgtgtcttcgcgcgcagccttgaggcgtctggggccgtctgctgcgcgtgtcccccgcgctcgagctgttgcagaaccgccgctgggaacttctgttctttttctctttaatgataagcaaaacaaaaagacttgaattcaaacctgtttggggagagatcggatgctcaacggactagccccctctctttttccctcctgttatctgagctgccctgtggtttggggagaatcagccagggggcccactcccaccagagggagccggccgggggccgggccggttcagctggtgtcccccgtggagtgaggggaaccgtcagaattgggtgcgggagccaatgcagtatgtgtgtaggggtgttcctgggtcttgtgccaccatggggtgtgggaactttttggggtgaggggaagacggaatagactgacttgtcgactttgctctgctgagggtgtctgggacctggtgccacccacgaggcttggaagctgctggccagatgtgtgtgtgagcctgttgtggggttggggggacggctgggaaatgagcttggctatgtcccctcatctcctctctgggcactggcctattgtcaggctgctccttgcgaaaggaaagacaggcctccagtgtgctagggtggggatggggaccaactaacccggaaaccagacagaagagctccccagccttggagatgtttctgcaccctccatcctgtcttggatcagatgcccagtgtgatggcctggaagggtacctcctgccccctctggctctgtcttctgtaaccaggttgccttctgtctgatggctgtgtgcacatatgtgtatgtagatattcttggaaaggattgtttctgagaacaccccccgacccccccaccccctgctgcttaccccaaggatcacttctgcccctgacactccccctcctcagtttcctggccaagacattctgggatgtctcttatacccttctctggttgcagtcttcatagggcaagattgttttgggggaagtggttctgtaaggaccttccaggtcttgctaggaaattggacctcaggccccaaactctcctacagggctccatgaagaggctgtgccggggaagccccgggttggagtgggggtggcttggagccttggggcttcccctggagggggccggggggggcgggtagagatgaggctgggggaaggaacaagagaaaaaatatttggagttggttgtatgatgcttcttcctggaggaataagagggggtggttgtggagtcagggagtttgtggctgtgaaaaatggtatgctggagggagctgggacatcagtactgcctgggagtctggaccatgtggtgtcctgaaagagaggtcaggagggtcagactggagtagcctcttgggagctgaggatcttggatttgcaaggattttgagggtgtgattgagtgtatatgaggtgtcactgcaggggtttcaccatcagactggcgacggtggcacagatgcagtggcagttctgagaagatcctggggttgaaatggcttaatcctggccacatcctccttcctatagcccctaaatctctatcccttcagtctgaccctaaatgcaccggctgccaccctgggacacctttttagtccccttcctactcccaaccttgaggcagcctggcaggaagccagctgtgggcagccccatcctgatcacccatgtgcctcccccgctgggcacagtcacccacacatgccatgacgtggttcctgccaccccatctaagtatgggggagaggacattgtctgagtggcccctcaggtctgttttggggacattcacccagaccccagctaatgcgcgccccttcccctaaaccatttagtcttggaagctgactctgccctctgggaccttttcttccaggccactccttgctcagactccagtctcaggtgggatggtcctcagaaccgtgtgatgtgacggtggggcctgtcccaaaatacaaaccccaatgcccagtttccagtcctcttggaagcatgggcaggacaggacttaggctaggctggaggggtggtttcttttgacctctgtggggtctattaatatttgggagcactgcctgggatctggggtgataggcatctggggatggtaatcctgtccctgcgacaaataagcggggtaatctccgcttgctcagtacccacacccatcttgtgtcggtagttttgggagtgtgggaagctggcagggcccctggcaagatgaccagtgttgtcttgacttactgggttttgggaaaggagtatggcaactgataccccggctcccagggctttggctgaacattctctctgacgcctgctgtctttcctccctctactcccctctccaccctctggctgctgtctggagcccacacagtttgtggggggatgcacggtggggggcagggcctggatctccgtgtgtgtccagggagtattctgggaattggcaggattggctgagggtgtcttggtgtccccgcagggtgggcggcatgtggggacctagtgtgagaatgtgtcagcgttggtgtgtctgtccccagtctggctcgggtgtgggtgtctcgggtgtgggtgtctcttgcttcgtctggatcttgcctcccgctccagtcccgccctcccctcgctcccccctagctgggaccgcctgcttgctttccctctctccccacaactggagcctcccttgcctgttcctggaatttggagaggaggaggaggaggaagaggcaggcagacagacctcccacactctagcccgcccacctggcatcatggggaaatgaaataggtgctatggaactacattttccctggcttccctagaccctccagcacacatcatgagggccaggggccagctcttatggaaaggccatgggctgtccatccctctggccagtgacacctccttctacttaacatcctgccccaaagggcccctgctggacctccaggcaccactgtcagcctggggagccggtggggggattaggctgctgccaggctggcccgcacctgttgccaaccccagccctataactggagcttgctagggagggggctgcagaatgacaggtgtaatttctgcagctaggcaactccacccccccaactggatatgcctttcccttctgccggaacaagggaagacttccccttcgccactccaagtgtcaacctgatcttatggatgatgcccctgtcctgcctgatgacccccacccccatccctggctgcagagctgggctgccctccttcaagttttcagagctgtgctgccctggcagggctaggggtgtgggggtgtgtagatgggggtggttctctgttaatgttttaattgcctaaaaactgggagctcagctctgggccagtggggagtctgggtctggctggccgcccggtttgggctaaatatagtctgggacatctgcagagaaggggaggggggtggagggaggttccattcccccaccttcagccaaggtgccctcgtctgggcgggcaccttggagcagtgagggggattcctcaagcacaaaaggcaggggagaagtggcagggaagaggtggcaggggagaggtggcaggggctaggcacagttgggaccttgcttgcctggaggccagtagatgccggagatgaacctggaggctcaggacagggcaagagtggggcacgccggggctgggtcctctggctgttccctctccccacagagttacttgaggtcaggcagtctccatgtgtcactgtaccccgcaggcagtgtcaccgtgacccactcgctgtgtgtctgtgtgtacacacctaccttggagtggctttatcccggccctccccccggagcctctgtcccctgggtcctaccgcaggtcctcagccctccttccctctgtccctcgccctacagtgaaaccttcagcccaggaatcgagacttgagaaggggaagctgcggtggggagttctctgatctccagtcacggcaggaagtggaaaagaggggggttaagggggggacccatgagtggcaggcagggagggagagccctgtcagtcctgtgacccactgtgcagatcaaggaggggttggcccccttcctagtggtcccccttccctccagctccaggtaggagaaacctgggggacagctgattccccagggggtgcaaacaatcttcatcacccccccaacactaagaaaaaaaatgtcttcctgtcacgtggctgtcacttcctgtcccactgtggttcctgggatgtttgttgttggttgccatggtgatgtctgccgtgggcactacccctggttcttgtggggaaggagctacccctccccaccaggctgggggggtacttgggggacttgactagggggtcctttcaggctgagtgtgtgtggtctctgatgccccagattccccaggaccccccagacttctgtctgtggggaggagtcactgccacctactcagactgagtgctggggagactgtgaccgcatctggctgtgcctgaccgtggctgtgactttgtgagtctgactgattttgcagcccttgtcccctctggccggggttcctctcgctcatagagatgcccattcagggaacctctgtgctccctatctgtcctcatatacagttctggagcctgctcccatcctgtgttctgatggaaaccaccttccccagggagtttctgtggcttcctggactccaggctggagtgtcaaggggctgtggggcagggtcctaggttgcatgtgtttggggctggggaggtgggggctctgcagactatgccttcccctgcacacacagcctgcacccgcttctcccttgtctggcaggcgctcttctctaaggggaaggccatggggatctgtgacctattatccctatccacctgtgggcttccctgttcagctggggatggtgaggggaagagattccccctagttctagccccaactgagtaggcgggtgtggagtaggaagttgcttgggggggggtcaatgggtcggagggggggtatggggcagggcacagtctgactcaggcctggtctggggtcagagccaaaaggatatcctgaggcaggacttggtgggggggtgtattcctggattccctgcagcgtgggtccccagggtgggatgctgagagggggctggtaccatctagtcctgctggcagtttgccctgggactcagaatatggcatacgcagggttgggctgagctgaggggaggggtgagggctgctgcagcctatctccccaccctggccctgcctgtatctctgtaagctgtccccccattgtgagagagctgtgcttcctgcttggtagcatggaggggaggtagtggtgagggggcagctgccaaggtgtgagggtggggaaagccccgtgccaggctggatgtgaggtcggtggtttccaagctagggggtccccttttgtctgtgcccctttggtccctcacccaacagagctgcctgcgtatggtccacacatttctgtggtctggctgtggcctcagtaggctcatctcttcctcttcccattttttttttccttccctgtgggttggtccctcttcttgaggcctgaattaccccctgccctttcacctactcgttgcttggagtagggaggcttcagttctggttctacgtggacctctcagacaccctgggcttcagaggtcctgaccatgtcccccgggggatctggggtatggcccctggggatggaggagttgggagcacagccctgaccagcagagacccccacttcctcctcctagaacctggactgccccgagcttggattgtccagtcaccctttctgcctggtatccagtcactggtgagattatggcgtgtgggggtcctgcagctctgtgtagctggggaaaaaccctgggctgagtggagtacaagctgtggagacattggacctattcttttgggacaaggcactgtgtcttgaggcaatgggcagtggtagcacccggaagtgagacactaggcttcctccttcccctaactcccaagaggacatgcttatggcctgcactgactagggcagattttcaaaccagtcctagctctagcaaggctggcctggggttctgtggggttggtggggaagaggcaccctccagctatcccagccaccctcaggtgatccttctccagccctcctagggaagcctcttttaaaatgaggctgggctggccgggcgtggtggctcacgcctgtaatcccagcactttgggaggccgaggcgggcagatcaccgtgtcaggagtttgagaccagcctggtgaacatggtgaaaccccatctctactaaaaatacaaaaattagctgggcgtggtggcaggtgcctgtaaccccagctactagggaggatgaggcaggagaatcgcttgaacccgggaggcggaggttgcagtgagccgagattgcgccattgcactccagcatgtgtgacagggtgagactccatctcaaaaataaataaataaataaataaataaataaataaataaataaataaaaagaggctgggctaacctggcttcctgcagcccagaccctggtgaacagacaggaaacagaggacccgagtggccggattgtaggcttgccagggaggagaggggtgagagccttggccagaggggacccttgaaaaagcggggagtagtcatcactgctccccaacccctgtctgcagatatgaggggcgctggggaggggagaggttgtggctttgtatgtatgggagtgtgttttcctggaaagtttctaaatggttctagttttgaatctactctgttctgccctgcttggccagctcctggcgggacaggggtccaaaggcggcagggctttgtttctgccagggctagagtccctcctgcccaagttgagcttgagctctgggtgtcatttgcatatgattcactaactgtctagaatgcttaggaaacccccagtctccccttcttttaagctccccaatacttttccccttctctcagcccctctgagactgcctgacctctatttcttgggaaccgttgttttgggggagactggagaacagagagaatgaatgaggaagagaggttggggccagtcccggctgagtttggggtcccctgctcttctgtcctgagtataagggaggaaatggtctatttctcttccccttctcccctccctaaatccaaaggtttcccttttttggtttgtgaaatgaaagaagggaatttgggaatgggttgtggtcaggcctccacccacaccccgaatatccctttccccacatccctctcctccatccgagggaagcagaccctgggaaatgggtaattctccctcctggccccgtcaacagatgttgccctgggtggggtgaggcaagggaaagcaggccgactgctgaggggcaccaaggtggtggcaagaggcatggggatggagggctccagttgcccgggcctcccctgtgccaagctctggtctgggtgctttccaggacttcctgtctgaaatcgcacagctcgttgttgaggtaggcagttcacaggcgagtaaacagatgcttagagaggttaagtgacttgcgtaaggtcacccagagtggcagagctgagatttgacccttccgacttctggttctttctcccatcttcgtggctcagaaagctctcacctttttctctaggtgtgtgactctggggtgtaacgcgtgggcagctagggatgctgatgctggagaagggatcctggcaccttctgagggtgagagcggccccagtgggcaggagtgtggggctggttgcaggtgctctagccccctacccctttttctgctgtgcttaggctaggctccatatattggaggtgtgggcctgtggttttctctctctcaggggagggtgcccgtgggcagtggaggtggctggcatagggtggaggttggatgtgggtagtttgttttccctctctttggtactggtttcgattctctgccgaggccttctccacccctggggtgtagggggctggggcccaggtgtctctctgagggtcatagcttctgatggaccttctgaggcagagtctgtgcccttttgggcccaccctggtcatccctacccttgcccatccctgttctctggtctttctggcccttggcctatttctgtgacctttagccctcctgcggctcaaggccctccccagggagctgagtaaatttgcactgaaatttgcaggcagagctgggttaggctttttggaggctctgataggggtctggggaggccttccagccttgccctgtagtgtgtgtgggtggtgggctgggggtgaggtgggggtagtggggattgaagtttgattcaatttcaaactccactggggcagagttgaggtggctgtggttttctcttctctgggagcaagggtgggttccagagggtccaggctggactgactaaactggcctcccgacccccaaaggctgggtcaggatgcctgagatctggagtgatggctttctgggcctcagcgtgggttacagaggcctcactttgggttagctgccccttgggcctcaccttgagagaggcaggcctctgtggatgtgaattcacctgagtgtttgtggacctggtgcatgggctgggcccacagggaggacctcagagcatcttctggcagaagcagcaggtacaagggccaccctggctgtgtgaggttcggagaatgtacagtttgggagactgtggggctgtggttgtgtctttggggagctgtgtactggggcccatgcatgcagtttctgagctgtgttcattgtgtggtggagcccaggtgtggagagatggtatctccaggttccttctcctcacatgcatgcctgcacacacacaggctggggctgcaggcgtgctcttgcccacccagatgttttctgtagacctgcatgcatgagtttgtatgtgtatttgtgtgtgagggtccaactgtaggaactgatgaggttctgccagcctcttcttcccttgcatggctcccccagctccagttcccgttgtgtggggccccacaggagttgggagggggccagggcggcaactggtccagtgggtggggcccctgttcctctgacatcagccctctcagcctaggagggaattggcaggggcctggggtaggaagggagctctttattcaggagtgaggagagaggccctatgattgtcataatgagtaacagtaaaaatcgtggttattagcaaggtccagattttactcctggggcagcctcccctccctagcccagtacctgtcccctcccaccctctctccctcagttccacacaggctggctggctcagctgggccagaattcctggcctcttccacagtggccttggcaggaactcccccttcccaggcctggtcttcaaccaaatgctggccatgtgcttgtcccctggactccagatttgaggctagagtctggagttcagagcttggaacctagtgtagcctgagcttggggtggagtggcaaggtatagggggtgttggaaatggacagtccttattttgagtctctgtggccctgtttcttttctttctttcctcttctttttaaaacagctttattgagatataattcacataccataaaatttacccattaaagtgtacaattcagtggttttagtatattcagagttgtgcaactaccaccacaatcaattttagaacactttcatcaccccagaaagagcccccatacccagcaacagtcacttcccatattcctcaaatccacgccccagctcctggtaaccacaagtctgctttctgtctctataaatgtgcctatcctggatatttcatataaatggaatcctacaatacatggtctttgtaaccggtataatgttttcaaggaatatccatatcatagtatcagtacttcattctttttttggcagaataatgttccattgtagggacatacaacattttatttattcgtcagttgatggacttttgggttgattccactttttgactattaggaataacgctgctgtgaatgttcatgtataagtctttctgtggacttacgttgtcatatctcttgggtagatacctaggagtagaattgctgggtcatatgccatcgctgtgtttaaccttttgaggaactgccaaactgttttccaaaacagctattctattttacattcccaccagcaatatatgaggattccaatttctccacatcctcgccagtacttgttattatctgtctttcttattagagctagcctagtgggtatgaagtggtatctcattgtgctttttttttttttgagatggagtctcactctgttgcccaggctgaagtgcagtgacacaatctcggctcactgcctcccaggttcaagcaattctcgtgcatcagcctcctgagtagctgggattacaggcatgtgccaccacgcctggataacttttgtatttgtgtgtgtgtttttttttttttggagacggagtcttgctctgttacccatgctggagtgcaatggtgtgatctcagctcactgcaacctccacctccctggttcaagcgattctcctgcctcagcctcccaagtagctgggattacaggcacctgccaccatgcgcagctaattttttagtagatttttgtattttttagtagagatggggtttcggcatgttggtcaggctggtctcaaactcctgacctcaggtgatccacctgcctcagcctcccaaagtgctgggattataggtgtgagccaccgcacccaactgactttcgtatttttagtagagacaggattttgccatgttggccaggctggtcttgaactcctgacttaggtgatctacctgccttagcctcccaaagtggtgggattacaggcgtgagccaccgcccccagcctcattgtgcttttgattggccatgtttctttttgtctgtctcttttcttttgtctttcatatatgtatttttcatatataaatacatgcatatgtatttatatataacctgtacccaaaatggatttgaaacatcctcttgtcctcgtatggatatgttcttcgtgttctctctctttgctcttgttgctgcctatctgtctcactgtgttatggaatctctgggttcatctctgtctctgtctctaccccatggtattatctgtgcatatcctctggtgccagctgttcaaacagggtgtggatctgtattcacactggtgaagggggcatctggcctttcatcttctgcccacctcccaccccagttcatgtgttttgcttctgcagacagaagtatgtgggtgaaccttgagatcaatctctccttcattgcctgggggtaggaggcttcctgggcggtccttgccctcctacacatcgcctacccctggaccatccatgctgttaagcattggaggtgatacctaggagtccttggttcccattttcctattagtgtgtacgtaaatgggcctcctcccagggcctgtgggacaaacccgtctggggtgctggggcttggatctgggggggaagtggtgtaagaggggccccctggcttaggagtcatttttctgagaagtgccaatgctttagggaagcggcttttcctccccctccctcttcccccccagcacacgttctctgcatcttgacctcaggtaaccctcactgggggaaggagggccagctgcccgtttctgctgcagtgatcccttgaggtggcactgtggaccctttcccctcaggactgtgggtgagaggccctccaaggttctgggctctgtccctgtctccccagcctggctgtgctatctgccacccccagcagtgtctgggccctgcttccaggtcatctctgccagccaggcatggtgccagctgtctgctcagctgggtgccacgggaaaatctccggcagcccaggttggggagctccacggggaatgcctgtgtgcctgttcttcagtgcccactcacctgtctttcttttttctgcagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccagtaagtctgggtgtgggggctggggtgggaagggactgtggagggtggcaggcctcagagcttgggctctgggcacgtctgttctgctgtgagtggaaggcacggtgagcgacaaggtcttctccagttggggtgaccatcatttgaggtcttaaaaatgaaagccctatggcctataggctgatcatggtggttgtgtttgaagttgggggtggcagagggggagatgaaaccatgctgttctggcctgcagtggccctcgcacccctcttctgtgctctgctgttggggccttataaatagctccaaggactggacacacaggttggaggtgggtaaacaaacctcttgacatttgatggaaatggcagctctacctagagtgagagcagcacaccacctacgccccacccccactcagtgcctctgagggaaagggcttgaaggagcagaccgaggaaggctggctggaaccccacctctccccctgccagctccacccccggccatgctaggatgtgcttccctttgtggggaggatgagagggaggggcccacggtctagctgggtggatagggtgagtgtcccaggaggggacacttggcctggactctggcctcggacgcatgcatggtcttggcagggcctgtgttttccttgcctccaccctctgccatggaggtcacttgttggctgggcaggggtctcagtacccttcgccggctggccgagccaggtagtgggaggtggcggcagctctggccagctggcagagtccagggctggggcctgccaggccgcttacagtaactctggcccccagggcccagctgggcgccaggccagggctggggggaggagggagccggggcctggcctgggacgggagagggtggaagcagcagaatgggccatgggctgctggctggccggctggtcagctgctgacctgggaaacgtgtccccacctctcctggccagcagggactgcacaccttgccctgtgcacccaccacccctctcacggctgctggcaagctgcctggcaccactgccctatgtgcctggctgggctgggtcagtgcccccttctcagtgtgggggcagcgctctctccccggagccagggagtctctttgtccctggggcaggccctggctgggcgcctcactgcccgcactggctgggtgcccaccaccaccactgcttcctggatcgcctcctctggcttagctgtggccccctccctcccaggctccaccagccaccaggagcagggactctatgtctgtgtttctttgtgttccccgccctttatgccctggggccagggggcaggcaggtgctgcctcagtttctcctgccaccccttatcaaaccttcatcttctgtttctgctgtctcttctctccacctcatataggagtatgggatggatggagtctggggactctgattctggtctggtcctatagtctgtgttagtgatggggagaggccagcctctggggtttggggctactagggaatgcattggtgtatctttgtagaatattcactgcatttaaagggactgtgatttacattctggacttggatcactggaactagaagactgtctgcttcctgacagggtagggttttatttttatttatttatttatttttttgagacagagtcttgctctgtcaccgaggctggagtgcagtggtgcgatctcggctcactgcaacttccgccttccggaatcaagcaactcttccgcttcggcctcccatgtagctgggactacaggcgtacgccaccatgcccggctacttttggtatttttagtagagacgggatttctccatattggccagggtggtcttgaactcctgacctcatgatccgcccgccttggcctcccaaagtgctaggattataggcatgagccaacgcgcctggccatttttatgttttaagacagggtcttcctctgttgcccaggctggagtgcagtggcaccatcttggcttaatgcagtctcggcctcccagcgattctcatgcctcatcccgagtagctgtgattacaggtgcgtgtcaccacacctagctaattttttttgtatttttagtagagatggggttttgccatgttggccaggccagtcttggactcctggcctcaagtcatctgcccgcctcagcctcccaaagtgttgggattacaggcatgagccactgtgcctggctttctttcttttttttttttctcatagggtctcactctgtctcccaggctggagtgcagtggcatgatcatagctcagtgcaggcttgaactcttgggctcaaggcgttctactgcctcagcctctcgagtagctgggactacaggtgcgtgccaccacaccaggctgattttttgatttttcatagagacaaggtctcaccatgttgcccaggctggtctcaaactcctgagctcaagcagtcctcctatcttggcctcccaaagtgctggagatatgggcatgtaccactgcacccagctcagggtaggatttttgacgggggaggagttagggacctgcgacctggtgcctgtggacaacttgtcctaacccaggtgatggcaacagagttcccagacactctgtccatctggagcctgggctcattggagggttggaggtgggggctggggcctggccccatccttgcccatcctggccagagggagcaaatgctttgccttcccctcccctcaatgttgcaagcttcttcctctttcttagaggtgggtggggaaggcttcccatcctggtaaccttctccccaaatgtgggtggggtgcccacatttcaggcaagtgtagccttcttcggctttctccacccaggttaggcaatgcccccttcctgccccctccctctgtgagccttttggtttccctgcccctcccctctccctagtaaacaacaacaacttctctccctgcccagacccttagcttctgagcttctcactgaccttcctcttctctgggacaaggtgtggccatgggtctgagggagcctggcatctccctccttctgcagagccagggctgcctggtggacagagctcctgagctctgagtaggaaagcatggcagataaaattatcacatgcctggcctcagagatggaggcagtttagccttccctgcttgcctggccttagggctggtgctgagggtgaggcagttcccaggagaggtggcaatccatggtcctccattcctgcaggagcagtggtatgccccagtctgcccataccctttttgtaggaattcttgctgatgaggcttcctactcccattccccatccaacaaaggtgttgggtccctcctccccctcatccctttccccaggtggggaggaggcagcacattaggtggcctgggtgcgcccttcagagacctagtagcctatgggaccaacagaaaccctctccaggtcactgtggggagggctgtgtatttgttctgctacagccagggtgggagccctagagatggtccggcgattctccccgccccctaaactggcccctggggcttggtctctgaagactggtgtttactgtggaggtctcagattctgtgtgcactacgggtcagggctgtgtgtgttttgggggtggggtcacggttgggtgtgtgttgggaaggggattaatgacttgtgtgtattgggtgagagggttagagagctgagtgtgttttgggggaattaaatccagagctaaggagggagagtcagcctgtctgtgtgttggtgttggggctgggagggggagtgacttagggcacagagtgtttaaagaggagtggtctttcgtttgggttcttaacctttcttggctggaggggagaactgatctgcctttttttgttcaccctgggaattccatgggcaaaggggtctgactgggggctgtggagtaggcatttagtgctgagtttaaaacttggacactgggctgggcgtggtgactcatgcctgtaatcccagcactttggcaggccaaggcgggcggatgacctgaggtcaggagtttgagaccagcctggccaacatggtgaaaccccatctctactaaaaatacaaaaattaggcaggcgaggtggcacgtgtctgtaatcccagctactcgggaggctgaggctagagaatcgcttgaacccaggaggcagaggttgcagtaaaccgagatcatgccactgcactccagcctgggggatagagcgagcctctgtctccgaaaaaaaaagataataaaataaaacttaagacactggctgcgtgcagtggcgcctgcctgtaatcccagcacttttggaggctgaggtagggacttcagcccaggaatttgagacaagcctggacaacatagtgagaccctgcctctaccaaagagaagaaattagccaggtgtggtagcgtgtgcctatagtctcagctactcgggaggctgaggtgggaggattgcatgagcctgagaggttgaggctgcagtgagctatgatcacgccactgcactccagcctggtgggtgacagagcaagaccctgtctcaaaaacaacaacaacttggacatttatgtcacatacaacttgctgataacctctctgagcatgtttcttttttgttgttgtttgttttgagacggagtcctgctctgtcgcccaggctggagtacagtggtgcaatctctcagctcactgaaaccctctgcctccaggttcaagcgattctcttgccacagcctcctgagtagctgggattacaggcgcccgccactatgctggactaatttttttgtatttttagtagagatggggttcctccttattaggctggtcttgaactcctgacctcaggtgatccgcccacctcggcatcccaaagtgctgggattacaggtgtgagccactgcacctggccaaagacatttattcatttatttatttatttgttttagacagagtctagctctgttagccaggctggagtgcagtggcacgatcttggctcaccgcaacctctgcctcccaggttcaagccattctcctgtagcctcccaagtagctgggactacagatgcatgccaccatgcccggctaattttttgtatttttagtggagatggagtttcaccatgttagccaggatggtctcgatctcctgacctcccaatccgcctgcctcggcctcccaaagtgctgggattacaggcatgagccaccgcgcccggcttgttgttatttttttgttttgtttttgagacggagtctcattctgtcacccgggctggagtgcagtggctcgatctcggttcactgcaacctttgcctcccgggctcaagcgattctcctgcctcagcctcccaagtagctgggactacaggcgtgtgccgctacgcccagctaatttttgtatttttagtagaggtggggtttcaccatgttggttggccaggatggtctccatctcttgaccttgtgatccgcccgcctcggcctcctaaagtgctgggattacaggcatcagccactgtgcctggccgtgacccagaccctttgtaggtgggagctggagagaatgggatgctaacatctatagagcacctactgtgtgtcaggggctttgtctgtgttttacaaattttaatccctgcaatcctggaagagggacattatccccacttacacagaggacacagtgctgggggaggttaaagtactgcagaatcatgactgtaggattgtaaagctgggctgttttccaccatctacataggcagctttgagagtggattgtggggcacactcttgggtgtgggaagtgtggggggtggggcttagtgctgactgaaacccccttccccactgtagaggccctttctctgccttagaacctacctttccccggtagggggtgtagggaaggcccaagccataccccctcctctctgttttggatcctgaaggctggagagaaagaaagataaggggcctgggccagatctccatcctgtcctggaagctgtggatacaatctgttcacaccatccccacccccaaatctgcccgctgtagcccacgggagtttgcagaactcagcgggcaccctccccccgatctccagacactgaaggaacagaatgtaaaagccacagttcttattcttaatttgtttcaatttgtggatggaggcaaagaagttgcaagccatcaacagaggagccggggatgggagccccaaaagggtggctgcatgtttgcttcgtgtgcctagagactggggaatgcccgagggtctgggtgagccccagcagaaggcagaaaggaggaggttgtgtccttcccttcttcctatcctctgccacttcctcgctgttgcagtctgtgcatactgcctccttccctgcttcccactctttccctggacaataggagggacagcccaggcggagggacagcccaggcagagggacagcccaggtggagggagtgctgcctagcaatgcctttcttggagtccgaaatgtagagtcagacaaaagaacatgacatggagtttttaatgaaaatggggtccctcaccttttatctcccagcaaggataatgcacaggttccctctggacaagatcccagcatagacgcggggagggaactcagggaaggaagcccgtcttccttttaggtgggtcagggccgaggtattgtgtctaccccatgccaagggatgtgttgcttatggggctgtaccagtgcaggcctgcctgccctttgagggagtagtgtctgtgggaagaggaagtggtttccatctctaagtcattttggggcagtgccttcttcctcctcctcctctgtggagttggggcacagcgagggattgggcctcccagggttgactggaggccactcaacctttggctgtcagaaatagaggtgctcccctccccattttgacttctgggttgctggaaacctcaaccagcccacagaccaagggccttccatgggcaggagtcttaaaggacagttcttcctgtgtggccttgggcaggtcacccaagctctctccaaatctgtttcctcctccttaaagcaagacttctggctgggcacggtggctcacacctataatcccagctactcgggaggctgaggcaggagaatcacttgaacccggaggtggaggttgtagtgagccgagatcgcgccattgcactccagcccgggtaacagagcaagacttggactcaaaaaaaaaaaaaaaaaaaaagcgtgggcacggtggctcatgcctgtaatcccagcactttgggaggccgaggtgggaggattgcttgagctcaggagttcaagaccagccttggcaagatagcgaaatagcgaaaccccatctctacagaatataccaaaattagctgggcatgctggtgcacacctgtaatcccagctacttgggaggctgaggcatgagaattgcttgaatccgggaggtggaggctgcagtgggctgagatcacaccactgcactctagcctgggtgacagaacgagactctgtctcaaataaataaataaaaataaaaaaatagagcaaaacttctaatctctccttggctgggcgagttgccgttaggccacggtcgcctgcttcctgctgaggcccttggtgagtttcacgtacccagcaaggctgtgatagtgaggggcagggtagagctgggtactgtcttgggggatggtgccactctatactgggagccagtgtccacctggcactgggcctcatgatttcctgtttgttgtcccctccagatggggttggggacaggagggggccctgcctggcacaagtgggggccagtttggcctgcacctgctgagggcttactaaacgcaaagccctgagaaggagctgagggagggataaggctgagcaggatggggccccaggcctgcagacagctgccgctggaggccccccagccccagctgcgggccagagccttccttgtttcccacttctcccactgccccaggacactgtgttctgctctgacctgccccatgaccttgctgttgcccagaacgggcctcttgccctagcttctcctctccagctccggaaatcctatctatccttcaaggaacatcttgaatgccgcctcttcccagaaatcttcacagatgttcccccttgcttgccacactctgcctccctacttagaatgcctgtgggtccttatttattttttaacaacactcatctcgctacccagaagttgcttctcccctgttcctgccatgagctgtaaccatttgggacatcttttcctgaccacaaggtctttgatggcagggacagagtctcaggtcccttagcgccttgcagctgtgagcgcagagccttgctccatcatttgaaagatcccgaaggcatggaagcactctgtcctcttcgccattagtctcatccactgtcaagatttgcatacctgcccccagaccccagcattccatctgtagccctgactgcacttcagggccccacatccacctgtccagcagcccagtggacttctctgctttgcagtctcaggaacttcactgatgcgtaagtcacacacaagtctctttgctacctcttttcccataccccttacccccacccccccacgttatttgtacctttaaaatgtttattgaatccaccttcctctgtccatcagcacttccagtttcctaggccaagccacccttgtctgatgcctggactgctgcagtagcttttacctggtctctcttgccctcctataatccattcttcacacaactactggaaagatctttttacactgtaaatctgatctttcctttgcttggaacctttctatggcttttccttgcatttaggataaaatccaaaagccttactgaggcctataagcccccctggtctggcctgagcccacctctctagcctggtcttgtgtaccttttccttttgaattttgtgccccatgattctagccttctgccagttccttcaatgaactcatcaactgctgtaaccccagggcctttgcacagactcgccctttaactggaactacactcctttctactctttgcctgattaacttacaaactttctcttatggtaggtctgttttatttgagttcttccctaatttagttaaacctaaattaggtacctatgttaattcttcagagcataatagcatttatctcagtttgcaattgtgtgtgcatacagtgattatttgcttaatggctgttgctccctaaggtctacaagggcaggttccccagggtgtccacatagaaggtgctcagaaaaataccttgaattggcctagcttggtaagaacatgggctttggcagcaggaagttcaaatacctgctctactctttattattagtaatgtgatcttggacaacccacatagccttgctgagacctgttttatttgtaaaacatctcttggagttgctgtgaggataaaatgacaacatatataaagagccaggcttcttctagaagaatgtccttgggtagcatgtacatttccatccttccttttagagagtgggggtaataggataccccctcctccaggggtatcccctctttctagggacctacccaagctaggcctttcttccagtgaaacgtgcatcccgagggcttctaggatgaagtagtccactggaaggcaccagctcttccttttatctctccagagctggacagtgcaccaggggccggtactggttccccagctaggagacaccttgggcggggctttgctcgccggaagcacgcagagcgtggggaggagggccccctctgcctgtgtttgtgccaacagcacccgcgctgccgcgtcgggttccggcggccggagtcacacatgatgtcacagacaatgacacaagccggtgtctcattccgacacagcgtccgagctgcacaatgtcacacccgggtgccaaacacttggccccgcgcgacccggccctacgcctcctgccgccgctctccgcgtctccgggggaggtggcccggttcggccgggcagggggctggcgggcgagccccgcgggcgggctggcgagcgggtgatgtcacgggcagcggtgggtgggtcactcggaggtgaggcgccgccaggcgagttcagcgagagttcagccgcattgcattaggcaaatgaggcccggcctgggtgggggtgtgtgttaaggggaggacaccgggaccacccccctcttccccgccccaccacctcctccaccacggcttcgctcggccagggactgaccaaaccttgggggagcctgggagccggaactggtacaagggaggacgcccgcccctcttccgtccttgtcccctcgcagccccctcctctccctgtactcggcgtccctctgtactctgtgtactcctcatctggagcctttcccccttcctgcttctctcctctcctcccccttcccaggctgcccccacttgcctgtccacatgccgcctctccctctcggttccctgcgtttctcccgctgcagccggacgcgccgggaatgggttaagccaggggcggtgcctggacggggcggggcggtggaaagggggtggtgcccggaggggagggggcgcgcagagctggggtgggggggccgtggcgcgtaccaccagagaccgagcgagtcgccagctgcccctggcctggcgggggcggaaccgcgcgggatccccacccccacccggaatcctcgccacggagaatccctggagaagccccggatccccggctgggaggaggaagtgctcgttgacccccagccccgcgctgatcccgcccccggcctgcggacttggggagccgctgtactctgcctcggacgccacgagactctagacgggagtcccctcgaggtgaagccgctgagttcccgggccccgccaggcttccctgggagagccgacggaccccccctcccagcacacacaacttccctgcttttcaccgggactggcggagcggccggcggacttagacgcggggacttcagggcagggggcgccccctgcccgggtcaccagtcggggcgaggggacgtctcctctcccccagctgctctgctcggatggcgccgccggctgagtgacgggggcggcgcgcaggacttcccagctcggacctcttgccttcgaggggaaagatgtacgagagtgtagaagtggggggtcccacccctaatcccttcctagtggtggatttttataaccagaaccgggcctgtttgctcccagagaaggggctccccgccccgggtccgtactccaccccgctccggactccgctttggaatggctcaaaccactgtacgtaccggcctctcagtctgctgttgtagggggtgggagtgggcggtagggcttccactactactcgggggtgagagtcccggggtgtagtggaggtcctgtctctacctttcacttaacccgtgttgcccttgctggacaattgaaccctcccggccgcaccctccccccagtaaccctaagtgcaatttgtgttagattagggctgaggaactttgagagttccttctttcaagcaacattccttcatctcttgtttcacttcttccaggagaaatgaagcccaagccccttgcccccagtttatatcttcttgcctggaatccaacagcttcacagcaggctggagggtggggtaaaggtcctgtctgtgtgggtttgtctgctcccgggggaaggcccccccgccagatcccacttgccaaagcccgagggagagccccttcctgtgcgacagctgctgcccccagcccttgctcttgcgtcattagagtgggtgtcaggggagcactcagtgtctttggtattgacagtggggtgtggcagaaaggggcaacttcatcagacacccgtctgccatcctaaccttccatcttggcaaggggcactgggtccttatggggttgttgtcctggccccagacacttggctgtcatctttgaggctttcatccccaggagtggaggggagaagctgctctggtgagaagaatccctctccccctaatcctaatccggtttgttctctggggaatgagtttgtttttgtgggtctggggctgctctggaaatgaggactgcatcccttcccagctccgccaccgagtccttttgttaccctgacttcacttggggatagggccaggtcctgggctgtgccttcctaagaggggcactgatgagaatcctagcatcctggcagcctggtcactttctctccttgttgccccctgcctgggtgcaggctcctctgggaggaagggctctgtgcacactcaggagctcggagcaccagggtgtacacctgggcattttcctgcgcagctgtgaggcagtgtacactgggtgggcgggagcaggcgcaagggggttattgttagatggctcaggtttcttcccctcctgggctttgggctctttgctggaggggaagctcttccgtggaggatctcccaccttcctggacctgctgcctccctcctgcctgccagggaggaggggtggagtgggtctcgggggggccctggcagattggagaaggttgaagggcaaaggacttaccccacccctcttgctgggagaagagagacctgagatggacagacagcccacctctgccctcccagagccacttctatcccagcttttcctattgtcctgcccccgaccatttcctctagggccgaatctgctgtgtggctgtagacacaagagggaaggtatcacccttgactttggaagaagagagagtgagaggatgactctaggaccctttttctcattctcccagtgctggagcaagacccccctcccctagggggatagttggagcagggctgccagagtcaccccttccactgccttggccaccttctccagagggctggagagaagctgggatctgagaccttggtctccagcccctgtctcttcttagcccatggggacagctcagctcttcctggcccagaactggagagggaggaggatcacagagagtaggacaggcagtgtattggtgagcccttcccctaaaccactggacatggggaagtggagacctgtccccacatccattctggggtggggtagtagacctagaggcctgggtttccagttcccgtagtctgagcgtgggtgtgcatatataagtgagtgaggtgtcagtggactcgggtcctgaggctgtgaggttgggagtgatgggggtctgggggcttgccttgaggcacaggaaggacccggagtctgagggtggcaactagactcagtctagaatatgtggggccaatgccaccaccttggaagggtccccttgggtgtgtggaagtccgctggtgactggagctgcctccagccccctcttggggaattctccactctcccctttactgccactgaaggtgggaagagcaggttggctctgggaggaggtggcctgggttctgcagggccctagggacattgcctccctccccagagccctcatttcggtgcattagaggacaaggggggtgcacaggatgtggctccccatctgtctcccaccaatctccgccactcacacctccgcccgctcccagacgtccaagaatgtgaagcacgtggatgcccgtagttgggggagggggagacgcttatcaggcggccgctgggctaggggccttcttccgctgccgcggtacacccagagctacccccgcctctccccgggaggaggaaggacggtacagagggccctacgccccctccccaaccatccccaggggctgcgaggggagctgcggaggagcgggcgccagctggattgggaggggagccgctggccgggggcccggctgatttcctgctgatctcctccaggaaaccggccccttgtgcgagcctgcgaacggctcgggggcgtggggaatccggagtggagcgctctgcgccgcccgccctgccaggatggggagcgagggaggggcaccctggcagcgtcggcgggaggggacgcctggcttcctgggtcagttccagtcctctgttgggcgctggaactttgagctgagaaggtgtggtccttctctagcccgagtccttctgcaggaagaggagagattggtgggctgggcctctggggagggaggttagcagggatgggccaggcccgggcagtccctcccccgttggtgtccctccccactccacctgtgtgtgcagggagttatggccgtgtcctaactcttgcagaggctgtgaggattccggagttccccacacctccggccttggtccttgtacctcacctccttggactgctggctggaggcctggggaggtggggcatcgagctctgggttcaaagggcagagcagggaaacctcagagctgggttacctgggtgacaggtggggatgtgctggaggtagggggcaggctatgttacagcctccaaggcagtcaagctgccgttgggtgggctaaaaggaggccttgcccagcctaaactgtagtccttgcctctggtcatctctcccattctgccaaaaaataattttaaaaagcacattctctcagttccgtaaacaccctctgttggactttgctttagctccatgtttttatggctttttgccctctagtctgtcccaggccttagagctgtttacctctcatcctggtatcccccatgactccccataccctagctcccctcgtgacatcccgctctgtacccccaaagctccctcagtcctttctccctctccagtctggttcattttagaagtggggccttgggagaggcggggcccagggcaaacggtggattaggaggggtggggaggtcagtgccttcttcctctgcttgtcggaatgctgaccaagattctaggccatggtccccccaaccctccacatacccccttgcccttgatctcccctccccccaccagtctggattgtctattgttactgcttttacgtcttggaaaaagttagcacaacaaagggctgctttgtggctcaccccctctgcctcctggcctcacccaggccccccaaccccgcccccccagcagctgttctcaggcctctcagcctgtctgatttgcttgtctggcctggggagaatgaggtgggagaaaaccaggccagggcagttggtgttggagtgaagagcagacggcggtggggaggtcaggagagaatctgctgggctggggatggtgtgggcatcaactgtcccattgctgcaggctggtcttggggcagggaaggggatggggggccatagcagtgctggtcagccaggctggcctgggaagtggtgcccaggcactactaagagccaggaaagccctgccaaggttgttggcctagttccctgtcatcagccgcctagcagcccccactgtgtctgcaggtaaggggggagggtggtagcacatagtcagcccctggtgttcccatgcttccttcctctgtgccccaattttagggccatgtgatttggggctatgtgactcatgtctgtaaggtgcttgggccaggagctgtgggcacctttaaatgccagccagtctcatgtgccggagtttggggtagggctaggtaggattgtggaatatgggaggaggcagggatctgtctacctagggaggcatcctcatccatccttggccctggacaagagaacttgaacgttggtaggggcctcaggacgatgctgcgtggccccttgggaatctgggattgtcctggtcatagttcttatcttgcacccaacacccttagctgcccaggctttggacatggatagcccctacccaacccagccctgttctgcctacagtgatgggcatggagccagacactggggaggatttggccagtgagggctgcccctgctgtctgggtcacccctcctggctgccctcttggagctgaataacagaaggggaggggttagtaacccggacatagtattgaggccagacagacagagcattgatgggaacagaccccctttgtcatgccatctctccccagatggggggtacccagaataatgggcttttggggccctggggactcttctccctgtattcagggtatctccccctatctcagggagacacctcctactgtgcccagcatttgtgactcttctttgcaccccctgccttgggtccctggccctgggattgtttgggtggaggaggggcagtggctgctggcagaatggggtggaggggggagcggaagcagagggggcgggggagtggccggctttgaatatcctgttgaccccagtttcctctgcccccagcttatgtcctcttccctccctcctcttcaagcgttaactccttcctaactcggggggagaacggggccaggccgcccaggggcaagagctttagaatcagggtgacccccacccctactccccaagcacagtcacggcacacatacaaatgtgatggtttatcattgtatctttgtggttttgaaggtgggggtcctaggagtccagaggagtgatggggtgctggaggcttcattggcagcctcctgccctgagtctggctggggagtcccagttttcttaagacttgaatcctgccagcagtggtgaggctgggagaggctcttaggagggacggtgaggcagggtggagcttggtactaaggatggcgacctaggtctctaactgcccctcccctcttctctctctagccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaaggtgagttgaaggggtcattgggaaggacagcttgatgaggtcaatgggatgtccccacttctgtgtcctgggagtgtgcagttggggggtgtccctgaagttgctgctcttctttctctgtggaagttggcagcaagcagggacacctaccacagtttccccacaggtcctcccccataaatgtgcagggctccctcaaaccagaggtcccctcctgcctcagctcctttccctgtctctatcctccagctggcagggcgtacgcctgctctgccaccgctgcccaggttgccatggtgagctggctgccgactggctcttggctggggacccaggaggcctcccccggcggccctgcctgaacctcaccatggcagcctggcaggaggcagttaggagcaggcaccctgccttagcttccccttcaggtgcccgggctgtgggctccccagtgtctggctggatttccccatcctcacgttaggtgccagggtgcaggtatacctggtccttagcagccctgcgcccggcttctcctcctttccctggggcctgagcctctgtgtgcgtttcttcctccagagattggggctcagaatcttcacagctttgggccttgcagctctgggctgctcttcagcctggagtagctatccccagatgtgggacggaggtcaagggcaaagcacaaggactcaggctgtgtgtctgcctgtcctgtctggttgttcctggtctgttcttcctctgtccgcctgtccctctggtcagcctgtatgtggagcccctggccagcctgggtctgtgtctgtgatgggtcggtgcacacctgtcttggtgaactcacatctttctgccttgctcctgagtgcatgtgtgtgttcgcctccatttctctggccagcccgtgtatctgcctcctggcctcttcgggcttgtcttcttttcctgtgttctgagttcaggggtgtgggttccagatccctggctgttgcccagttagccccatgtcttcctatttctgactcaccagcagccctgaggtcttttccctggaagggaggagtcaggtgtgtgctgtgggttgggggaagactcctgcccatcctgcagtgttgaggcaggtactgggattctcctgaggaggatccttttaggtgaatcattctccccagcttttctggcctgctcaggtaggcgatgggcaaacgcttgggggcagcagctggcctggccctcctcccctagactgagaccgtagccaggcactgctcccactgtgggtgtggacaacctgactccctcccctccatacccagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtgtgagtgccatagggcaggggccgagtcccgcctcagttggggtctcagatgctcctaaagaccaagggagcagggctctgtggatgtttgtgcacatgcatgaacacgcatgccgtggtgtgcgggctcacggttgaggatggtttgtgtgtagctgcaaggacctgtttgcgagtctggctggctgtgtgtccacgggcaggtctgtgctccgggaccgtgtatgtgtaaccattcctgtttctgcacgtctggctgtgtgtgcttgcgtatgtgtgtgtgtgtgcatgctccaggatggctttcttccaggccgtgcttggttttggggtggggctcagaggcataggcagtcccttctgattgtgagtcttaggggaggggcttgaattctgaggggtgcttggctggacttatgtgtgtatgggggggtggaagggctggcacaaggatccaaaagccattgtctagttaagcctgggattcagagttggaagaaagaattgggacttctcagatcccagaggaaacggggtttccactttgggctcagctgaggcctgatggagggagggagggaaaggctggacagggagaccctcttgtgttgaatcatgggtgttgccatggtgaccggtgattgatgatgtcagagataaatgacgctgacagacgcctccttgtctgcgtggccgttgccatggagcctgagccttgggggatgggatgggggagggggctgcaggaccccctagccctttgtggggagggcagtggggagggggcacgggtgagatggttctgactgttgcacgaagagccccagacaggaatggaggggactggagtgtcctgccacaggaggctgggggtgccttgtcctgagcccaggaagtggctcctgctgcaagagtgggtgacaactcaagacccacaagcctggaacccttcgcttaagggctgtcacctcctcctctctgtttgtgccaccttctgctcttttcatggcagaaggaccagggaggggaccccttctccctcccaccgccaactccccttctccctcccaccgccaactccccctctcccggctgctctgtgccccggagctgagcagctgccatttcaatagaattaaagcttccgaatgataaacgtcttgtcacagctgcaattttctcttcccaaattatccccccactctccctctccctctcccttctctcccctgcactttattgaatttgcagaatcgacatgagtgatctccaaattatgccagctacccccacctcgctaccccctccctgagcccctcccccaccctcccttcctcccgcgtcagcagccaccaccaccagccctgtgagtgattgtgtgtctggataatcggctggtaacgaccccatcgcttctttaaagccgagtggtgtgtgcggctcagcgcccctggtgatttgtcagctccccagctaatgggccaagagattctccccgccaggtcccccactctcaggctggggagccctactccccacttgccccaggagctgctcagagccagtcccaagggacccccagggagactgcagctgggagggctgggtgagtggaggcgggagaaggaccttcctggggaaagaggaggcagagcacctaggagggcaccgtcgcctggagtgtgagctggagtagacgcgtgggggatagcatgcggctggctatggggtggggtggggggtgtgtgcagggccacagctgtgctcatggggcttctggggcagaacttgatgtgtgggttgggtgggcatggagggctggagtgcgtggcaatgccttgcctgcccgtgaacgcgtgctgtgtgcgcgtgcttacaagcctgggtgacctcctcagcagctggcagctctctgtcaggctgggggtggacgaggccctgagcagcctgcagctgccctcttaaccccctctgccctccacagctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacggtatggctttcccccggcctgcagggtgggatttgcccagggccacagggccaggatgggcccctctcaggcaccccttcttgtgccaggcaagatctctgcgtccttcccttcccctctcttctccctcctcctgctgcctcttcccaaggagctcccaggaagtgaaggctgggtagagggcaggcctgtgggggctggagccaggctgagaaggggtgccatggagaagaaggccctcactctccctcctcccccagaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctggtgagggtctgcaccctggcccccaggcactgcccctgtgtcctgggtagatgtccttccagccagacagccaccctcctaaatgtctgtctgcaatcaacctgtccaaatgcccaccgcccaaatgtctgcccttcctctccccatatgtccacctgtccactcgtctccctgtccactcagccacctagcagccagatgtgcaggagctcacctgttcacccatacacatatccagccacccagccatccatccatttagccagtaataaagattcacgtaggagccaggtgcagtggctcatacctgtaatcccagcactttgggaggccgagcgaggcaggaggatcacttgaggctggaagttcaagaccaccctgggcaacatagtgagaccttatttctgcaaaaaactaaaaagattcacctaggatcctctggccagtgttcgagctgggtgtcaggaacccagcggtgaatgcaccaccatcccctctcttgaaaaccttccatgtgaggcaagagataagtcaacagaggttgcaaaactgtgatcaatgcttcctggagattgggggagggcttgtgactgcttgggcctgaaggatgatgtctcagaggaggtgacatctaggggtttgtagagggggaggtgagagggtagccctaactcaggagcaggaagtgaaagacttgctgctgtgaggccatgctgagctcaggggactgccgggcactcggtgaggtgagcccgagggtagactgggctggaggctggatgcagggggtgggggcaggaagaggtggtgggaactgccaaagcctaggctggagggagcactctccttcctgctgtccctgacaagggctcggtccacctgttccctcttggtcacctccagggtggggaacctgggatttgacgagactgtcatttctttttatgtttttcttttttgagatggagtttcactcttgtcacccaggctggagtgcagtagtatgatcttggctcactgcagcctgcaactgctgcctcccgggttcaagcgattctcctgcctcagcctcctgagtagctgggattacaggcacccgccaccacacccggctaatttttgtatttttgtagagacggggtttcaccatgttggccaggccggtctcgaactcctgacctcaggtgatcctcccgcgtgagccggcagactgtcatttctccatgggcacctctgaatgttgaggcgggtgatgggtgggaggtttagattgtgctgcctgcaggggctcccatccccatgccgtggatgcaggaggtgccgtctgggttcctgcaaccacattcaagccaatacacatttactgagcgcttgttgtgtacctcatcctgggagctgtaggcagcagcccagtgttccttagctcctagaaattctaggtcccctctacattctttgcatgtaggcaggatgacctggacctgcactatccagtacagtagctgctcaccacatgtgactctttaaatttaaattaattaaaattaaactcaattcagttcctcagttgcattagccacatttcaagtactcagtagacgcatgtggctggtggctgaggtatggatggtgcagacgtagaacctttccatcattgtagaaaattctatcagacagcattgctccggccacctgccaggtggtcctccgggagtgctggtgcggagtgctggtgccgagtgctcagagtgggttcgggttcagtccctgaacccaagcatcctctgcacccagatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggaggtgggcagggggcctgggtctgggggctgggctgggacgggggtgcagccctggagtctcttccagggagctctttcaggccacctctgttaggtatctctagagggcagggtctggtctgcaactacacagcaagggggccatgtggggcctggactcctgttcccgatttctgggcaacaccccttctagggaggttaagagtgagggtttgagggtcggaccaaccagggtcacctcctggccgatgcatgaccctgagcaggttgctgaacttctctgggcctccgtttctgtacagtgggggcggtaacggtctctagctcatgaagttgatgggaggattacggtggtaacagatactgtgcaggtgcccagagcgagctccagtgcttgttagttgctattttattgttgtgatttctgccatttcatctggtttccagaataacaggggggagtgggagcctgcctgggaaccctctccctgcttgaggatggcactgcccatttggggtcccatcccactaactgggctcagggagggtttggggcaccccctcaccctcagctcccgttgctcccttttaagggcctctgtaccctgcggcagcagagaccccatgccctgccctgtgtggggaggcgcctgcgagctgccctcctccatggcctgggcaggcacgccccccggtggccgaggctgggggtgcagctgtgttcccagctgctcagggggtggttctgcttcctcagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggtgaggctcacagacctggaggggtaccggcccccgacacctggcccaggcccccacatccaagccagcaccccatgtctttgtgccaggacaatacgacacctgtccccatctgtgtctaggctgaggtcccctagtgactccactttgccgaggtggcccgcctgtgtcacctttgtgtggtagttcagatcgtggctctggaaccagacacgtgggtgtgtgtccttgtgtgggtcactcaacagctcctagctacagtttcccttccgagggcggggataacattcgtgtttacagaggggtcgggatgatccctagcacacagcacaggggaaggaagggcttggcgtctagcccaggccggcagtctggccctggagccggagttcgggaccactttgccccattgccaccagcctctggacctgggggcttaagagagctggctcgtgtcaaagaactgaatcccaagaaagatgctaatatcagcagtattgatcttcccacctcgagccaggcttgctggggctgggggtgggagggctggcccagcgtgctgacctctgccccctcctttcctgcaggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattct

SEQ ID NO: 36478 - DNA, 1899 bp, Homo sapiens
ccgaggctataagagggcgcacaagtggcgcggcgcaggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcagcttcgcgtccccgggccgcttgttccccggggcgcccccgacggccgcggccggcagcatgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggcgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcggaagggggctccgagggggcgcagcctcaaaccctgcctttcctttacttttacttttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgcca

SEQ ID NO: 36479 - DNA, 60467 bp, Homo sapiens
gtgagttacgccactatggcggacggggcaccccggccccagctttaccgcagcgtctcgttcaagctgctggagcgctggagcggcggccccgggctgagggaggaggacacggacacccccggcttgaggcgacgcgcctcgtgccggccgaccacggctgcccggggccagccctctcggcgcgtgtccaagctggcgtctgggcccctggccgcccccgcgcagccgcgcccgctccgcagcctctcgccgtcggttcgccagctctcccggcgcttcgacgcgccgcgtctggacgacggctccgctgggacccgagacggaggcgtcttacccgcggccgcggaagaagcggccgagggcccagcgcgaggagcctggcccagcgtcaccgagatgcgcaagctcttcggcggtcctggctccaggaggcccagcgccgactctgaatccccaggaacgcccagccccgacggtgccgcgtgggagcctccggctcgggagtcgcggcagccaccgacgccaccccctcggacatgcttccccctggcgggtctgcgttcggcgcggcccctgaccgggccggagaccgaagggaggctgcgccggccgcagcagcaacaggagcgggcgcagcgtccagcggatggtttacattcttggcatatcttctcccaaccgcaggccggggcccgggcctcctgctcctcctcctccatcgccgcctcctatcctgtcagccgcagtcgtgctgccagctccagcgaggaggaagaggagggcccgccgcagctgcctggagcccagagtccggcctaccacggcggccactcctcgggcagtgacgacgaccgagacggtgagggcggccaccgctggggagggaggcccgggctcaggcctggaagctccctattggatcaggactgcaggcctgacagtgatgggttaaatctaagcagcatgaactcagcaggggtttctgggagccctgagcccccaacatctccaagagcccctagagaagaaggactccgggagtggggtagtggctctccgccctgcgtcccaggtccccaggagggacttcggcctatgtctgactctgtgggaggagctttccgtgtggccaaggtgagctttccctcgtacctggccagccccgcaggctcccgcggtagcagccgttattccagcacggagaccctcaaggacgacgacctatggtctagtaggggttctgggggctggggcgtgtaccgctcccctagctttggagctggggaagggctcctgcggtcccaggctcgaacccgtgccaaaggacctggaggcacctctagggcattgagggatggaggatttgagcctgaaaagagtcgacagcggaagtccctgtcaaatccagatatcgcctcagagaccctgacgcttctcagtttcctgcgctcagacctttcagagctgagggtccgaaaacctggtgggagctccggggaccgtggaagcaaccccctagatggcagagactcaccatccgcaggtggccctgtggggcaacttgaacccatacccatcccagccccagcatcacctggcacgcgccccacactcaaggacttgacagccactctgcggagagcaaagtcattcacctgctctgagaagcccatggcccgccgcctgccccgcaccagtgctctgaagtccagctcctccgagctcctgctcacaggccctggtgccgaggaggatccgctgcccctcatcgtccaggaccaatatgtgcaggaggcccgccaggtttttgagaagatccagcgcatgggtgcccaacaagatgatggaagcgatgccccccctggaagccctgactgggcaggggatgtgacccgagggcagcggtcccaggaggagctctcaggccctgagtccagtctgacagatgaaggcattggggcagaccctgagcctcctgttgcagcattttgcggcctgggtaccacagggatgtggcgacctctttcctcatcctcggcccagacgaaccaccatggccctgggactgaggacagtctgggcgggtgggccctggtgtcgcctgagacccctcccacaccaggtgccctccgccgacgacgcaaagtcccaccttcaggttctggtgggagcgaattgagcaatggggaggcaggggaggcctacaggtccctgagtgacccaattcctcagcgccaccgggctgccacctctgaagagcctactgggttctctgtggacagcaacctcctgggctcactgagccccaagacagggctccctgccacctcagccatggatgagggcttgaccagtggtcacagtgactggtctgtgggcagtgaagagagcaagggatatcaggaggttattcagagcatagttcaggggcctggcaccctggggcgtgtggtggacgacaggattgctggcaaagcccccaagaagaaatccctgagtgaccccagccgccgtggggagctggctgggcctggattcgagggccctggaggggagcccatccgagaagttgagcccatgctgcctccatccagcagcgagcccatccttgtagagcagcgggcagagccagaagaacctggtgccaccaggagccgggcacagtctgaaagggccctacctgaggctctgcctccccctgccactgcccaccgaaactttcaccttgaccccaagctggctgacattctgtccccgaggctaatccgccgaggctccaagaagcgcccagctcggagtagtcaccaggagcttcggagagacgagggcagtcaggaccagactggcagcctgtctcgggcccggccctcctccagacacgttcgccatgccagtgtgcccgccacatttatgcctattgtggtgcctgagccaccaacttctgttggtccccctgtggctgtgccagaacccataggcttccctacccgagcccatcccacgttgcaggcaccatcgctcgaggacgtcaccaagcagtacatgctgaacctgcactccggtgaggtccctgccccagtgccagtggacatgccctgcttgcctctggctgcaccgccctctgctgaggccaagccccctgaggcagctcggcctgcagatgagcctacccctgccagcaagtgctgcagcaagccacaggtggtgagtcctttgtaggggccttcagattggggccaaagaagggccatgggcaccgacttcggttggagccttttgcattgtattcactggtcaggtgcccaggtgccaagggtgcttttctggtcctggaagtgcctgtgcagttttaagagttgttaatgacacagggctcctgtctactcaggccctgtagaagcttcagttttctgctggtgctaatggcaaagggtcttgtctgctccaggtgttctgggtggtaattacaaaggattcttatcttgtcctttggatgtttctcagggactggttttggaaatccctgtgtggttctttgttggagggatgagtgtgatggcacccagcgcaggctcagtcctttctctgaggcttgctactctgttggccagacccttgataggatgtttggctcaggggccacagttgacatgggtttgcccttcttcgtgtggctttcctgtgacaggtcagaatatagatgtgttcctgggcctgggagaattggggaggtacaaggctttactttatggaggagcagagggggctcagggttctaactgcagttctgttcttgctgtgtgacattggcctttctctgtgacttaatctccccaatcaggggagataggtggacaaactagtgcctatgtttccatccagctggtactgtgcagatttgggggagcctgcggttttgagttggggactcttggggcctgagttctgccagagcctcctcagatgaaaaaagcttctagatgggggcttctaggggaggatagaggcagggagggggctgcagaggctgggcagccagggccctttagagaggtcaggagtggttctgggccccatattcagggctgcctctatgggtctggggggtcggttcttgttcccccatcctgtctgcttgcatcttttccccactctacccccttcttggtgactctgagatgcaccccgtttctgccagacccccagccctgggggctcactctccctgagacccctccttctaccttctggcttcagctatccctggagtttaggctgtggattcagatgggatccagatggcatatgccctggcatctgggttgggagctagattccaggctgtggattctgagctgagctcagcgatggccagtggttacttcaactgtggcctgcgctcccactgcgctccctgactgtgtgagaagcctggaaattataaaccctggactgattcagtcactccctttcccagcactctcatggcccctctgaactccctttctctttgtttctctctccttgtctccagttacccctggtcctggctctggggtttctcatggaggctgcagagagagcaggcagggagtggggagcggggcgttttgaacctgtccttccttctgagtcccagtgagggcagctccggtgcccctgaactccagtgccagttctgaaggtgggggaggggaggaagacagcaggtccagttcttgtcaggggtctcctccccagcctcctttcccatatatcttttctgggagccttgaaggctcaaatgggggagaggacaggagtaaaccaagggactcagggagactgaaggtgggttgggggtgcttctaagagaaggctttgagacccagagaggaggtgggagtttacagaacttctcctgccccacctcccttcacattctcctctaccccccacccctttctggagctctgaggcgggacagatctgccataacatgggcttctccctgccacgaacagaggccttctctgatctccaagcttttgcccactccaggcctctcacttttccaggcccagcttgatgtccccttagggggaggtaactggtgagtctgtcattagaagagcagggtgtgagccttgctcttctgatccctgtgtggcctaggatccatcatatccctgctctgtgcctcacttcccccttccataaaatgggggtaatggcctctgcctggcaggctgtctcttgtggtgaatgggtggtgtgatcatttcctctctggtagcaggaaagaagaaaaatggaggctgcactgcccagctgcttctcagccaccaggcttggcttgtgaacacagggctgggtcctcgggggcctcagtataacctggtggactgcagtagcctctgagaacatccatcatcctccaatttcccacaccctcataaagcctggaagttctcccatctgctagcttgaacccctcctgctgtccccttccttctggctcccagaatatggggagcagctgtccaccccctcctggtggcctctgttgaggagacaatgttcccttgtttcaagcctgaggctccagtcatgctccctgggccgtgggtggagatggcgtggtatggactccagaataagcagagacgagaggagctgtcattctttgcttctggcagtccctggggactaaggggatgccccccgccccccaggctgtagggagtccttcaccctcaggtccacattcgtgctctgtgtggtgttgcccccattgccgggaagtgggaggcctggggccaggcctggctcagcctttgactcactcagacctggacagagtcatctttgtctctcagttttcccatctgtacagtgggaggttagactgcctggtctgtgaggctcagaaggagggagtcagcctgcagggggtgtcaagtgaaatgggaggagccagcggtgtggctggaggggagagaaaggcagctgtctgcaatagctgcatgaacccaggagaacagggagtaacagtagctcatgggtcatttattccaggaatgcctgtctgtgtgccgggaggtgaggaggcagagctgtcaggcctccctgccccgcccctcccacactcttgttacctccactgaggcccactgtagcctggttggtcaacaactcttcctgtgagggagagcttcccccgccccagcctcaaagtgcagagtcttgcagtcccaccttctgccctcaggtccctgatacccgtttgacacatgccacaactgtagcccacagcagggggtgacttgtctctcagcatcataggcagatgaactcacgaaattttaacatactgaaatagcagtaacaatgacgaacatttatcaagtgcttgctatgtgccagacactatctgtttcattcttcaactgtgaaagctgtggatatcttacagtgcagacttagagtcgaagactgttggattcaccctgaatcctagcatatcagtgtcttagaggtgaggggtcccaaggagattggcctgccatctgagtagcggggacaagtcagcagacagttgggagtgtcacctccacatccccaacagcctgaacactttcatagtggttatttaattcaccagggcctggggttgggatgggaagaactttgagacccagaaagggagaatgctaggtctaaggtcacacagcaagggcgggcagaaccaggcccatgcaccaggaccctggccttgttcctctccactcagaccccctccctacccagccagctccctgccttgctgatgaaggtctggcaacagctcttctagtcacccttctttctccccttttggcggggaacctgcgggggtggaggttctctccttcccctccttggctctttgtgtgatttttccatggaaactggttctggggggaaaggaggaggtgattaggacacttggaattctgagcggtaccaaatatctataattaaatgtcttgtcacccagcaggagggggtgagatgagggaggacaggcagaagggcagcccctttcctctgtttattcctcacatctcctcccaactccttcctaagggcctgggctcttggggggaacactgtccaggaatgagtcctccccagcgaggaagggttgggggatggactagagttgagtctgacattttccagccccacgtttctgggaccagctgggtttgggaggcggagaggctgctgctaatcctgtccccagccccctctccccgtgtagggacttacccctcctgcttccctcccaccctcccatctgtgatctttcaggctacacattgctgccccaaagcagggtggaggcacccccaggcttcctgggagccgaggcacacagagtgtaggatctagaagccaactcgaaggggcttaggatgttgagggactagcctggaaactggccgagggacttcctagaagaggctctgcctaagcttgagcttgaacactgagcaagagggagaggctctatgaagagggcacagcatgagcagaggctaggagatggaaagaaatatggcaggttgtgtgcagtaaaagtttgtttcagagactcaggtggcctttgatagggtaatgcattcatccattaaacaaatactgtctgagcaataagacatgtcaggccttctaggcctgggaatacagcagcaaacaaaacaaaagcctgtccttgtggagcttccagactagggaggaggcctgtctgtaaatggagatattctgtgtcagggagtggtagggtccgagaaaaaaataaagcaggataagggagtagagaatgacagggtggggtactttagatcaagagatcaggaatgcctgtctgaggaggtgacatttgagcagaagcctggaggaagtgagggagcaggtcaggtggctgagggaaacagcattctgggcagagaggaacagcagatgcaaaggcactgaggtggttgagaaacagtcaagagaactgtatggatggagcagagaagtagaagatcagaggtgggttagggtgaggaagatcatgtaggccaataggaggacttcagcacatactcaaagtgagatggggcaggtgctgttggaaggttctgagtggaatagtggcctggtctgacttaagcattcacaggtctgctctggctgctccatgtggatagattgcaaggggccaggtggaggctgtgaggccagtcagaaggctgctggaataatctggacaagagatgatggtggcttgggcccaggcagagatggtggagtggtgggtttctgctgcagccccaggggctcctcaagggcctggaccccaatgttcaaggtgaacacagagctacaacttctcacatggctgggcagtgtgtgaggggtcacttagggtggggaggtggagtttgaaaagtccccagggtggactgggctttgcgctacactggccaccccctgcagacccacattggcttggctgaaaggctaggagagtggagccgccacagggtcccagtgaggcaggtgacagggccatatcccactggtgtctcctctgcagccaccatgacacccatttagctccagcgtgcatgtctcctgggacagggagctcatgcctccccctaccccccaaggtagccccatccctcccatctgatcctccagctacgtgggcattgccatggctccaatagtccaataaagaagcaggctcagagtgggcagggtctgcccaaggccccaaagcttgagtatgggatttggctcccagtgtcctgactcccagaccgtacattggtcccacagagttcccactaagcagagttggcagggatggcggtagcagggtgggggaagggggagccaatgtttcccagaaaggcttgaagccctggcgtacttactgggaaatgtgcccaggcagcctggcgccttgctggcaagccctgaaatgggggccctgggtcccctgggaagcaggagcctattggagctgatgtctccccatgggagttgattccccccatgatgtcctccctctaattctcagctcccagggtctctggggcattctgggggttgggagagacagacacagaggaaaactgtcaggctgctgggctctgtgcagtgagtgaacctcagcccatgagatgcaggggtttggggccccaaccacagtgcctgagcccctggagggacttccaggacccaaccctccagtagctctagggttcactagggacagcctggtgtctgtactaggagtcaggagatcagctttgcctcaccaccttcctgctgtgaggccttcaataagttccatcccccttcagagccacagagctgtccatgctcttgggcaccaggataaacctcctcccagggctgttgggaaaggacccagttctaaggaggatctcggttgcagaatgaagtgctggcaggcagggacccaccatcccactaggctgctgagaaggcaggttcagagtggtgccgggactcaggcctgggtctacccgctacgtgctttccccaccatcgcctcctgctctaggatcccccccacccccagatagggtctttttccacacttgtggcaggctgtggtgctcactgtggggcctgtccagaagtgtgatgttgcagctgacgggacagtaaacctttatctgggccgggcgtggtggctcacccctgtaatcccagcactttgggaggctgaggtgagaggattgcttgagcccaggggttcgagaccagcctgagcaacacagggagaccttgcctctactaaaaataaaaaacaggtgtggtggcacagacctgtggtcccgctactcgagaggctgaggtgggaggatggcttgagcccaggaggttgaggctgcagtgagctgtgattgcccaacagcactttagcctgggcgacagagtgagaccttgtctcagaacaaaaagcaagaaccaaacaaacaaaacttcctatggtttctttccagtggagcttgaagaagccgccaggcaggaacagggtgagaggggagggcagagcacacccgaggtgggaagacctgtgctgattgcagaggtctaggtggtgtattagtgtcctgttgctgcagtagcaaactacacacatctagtggttgaaaacaacacagatctcctactctccagtctggagatcaaaagtctgaagggtttcactgggctaagatccaggtgctgacaggcctgcccgcctctggcggccctggagagatcaacgcctctgcctttaccatcctctcctggctgccagcactccttggcctgtggccccttcccccatcttccccagcatcttcaaatctcttgctcaccccgtacctccttcctccgtctttttttttttttttttgagacagagtcttgctttgttgccaggctggagtacagtggcacgatctcagctcactgcaacctccacttcccgggttcaagcaattctcctgcctcagcctcccaagtagctgggactacaggcatgcgccaccacatccagctaatttttgtatttttagtagagacggggtttcaccatgttggccaggatggtctcgatttcttgacctcgtgatccgcctgcctcgacctcccaaagtgctggaattacaggcgtgagccactgcgcccggcctccttcctccttctttaagaacccttgtgattcattgtgttcttaaagcctacctgataatttgataatcttcccatctcagaatccttaattacacctgcaaagtccctgttattatgtaaggtgacatattcacaggttctggggattagcatgaggatgtaatgccagggccattattctttctactgcacagataggcaaaggaccaggctgttggttcctgatattcagagtccccagctggtgctggtcccggggcagaaccttcgaactcaggcccactgcatttaacttgctatttctttccatgttcatttgtcattcattcatttagcagtcaatcattgagctccgtgttgggcagtggggacacacggggaaaacttggacaccatccctccttgccaggagctttcaccaaggatcctagcctcctgaggtgggtgaggtccagaggcaggcagagcccaggcctggtggggcaggggcagaagtgccaatgtgttcctggggccaggcctggcttccagaggtggcaggccatagttttgctgactagaagtgggatgaggccgctcccaagaagggcaattgataggagagtttaaatccagggcaaggagggaaggtgggcacctagggagggggtgggagtcacgtctctgccaggctgccccatctgagggcagaactgagagcccagcggcagaaggaaagaaaccccatgttctgggagctccatgtgggaattggtggcattggtgctgtctgaccagaggaactgtcaggtcccttcatccctgagaggcctagggaggcttcagggaggtggcatgtggagggtaaagggtgctgtccagaatgctgtctccccgcacgctggctttcagacccaggcaagcacttacctactcccccgaggctgtagtcgatgggggcagtatcccctcactccacagaggattattgttaagattattttgtttttcggccgggcgctgtgtctcatgcctgtaatcccagcactttgagaggccgaggcgggcggatcacaaggtcaggagttcaagactcagcctggccaatatggtgaaaccctgtctccactaaaaaaaaaaaaaaattagcagggcgtagtcctagctactcaggaggctgaggtaagagaattgcttgaaccctgggaggcggaggttgcagtgagccgagattgcactactgcactccacactccagcctgggtgacagagcgagactccgtctcaaaaaaaaaaaaaaaaaaaaaagatgatgatgattttttttttttttttgaggcagggtctcactctctcaaccaggctagggtgcagtgggtcaatcatggctcactgcagccttgacttcctggactcaagcaatccctcccacctcaacttcccaatgagctgggaccacaggcatgcgccatcatgcctggctaattttttttacttttagtagaggcaaagtctcactatgttgcccaggctggtcttgaactcctgagctcaagtaatcttcccgccttggcctcccaaagtgctgggatgatggacatgagccaccgcacccagcctactgctgagattaagtgaaagcatgccaagagggcttggcacacagtaagtgctcaagaaatgttacctcctcccctcatgactgagatgctaaggttttatgattctaagattcttggctgctgggcacctctttccagccgtgaagcagaagacaaagctctagacaggaaggcaggttggggcctggctacagtacccacatagtcagtggctccgagcctggttctctggaggtggggaggagggagaaaccggggctggaggctgagccacatgcccactgtccttgctccactcaccagctcttctccttttgttaccaccagccccaccctgtgacatgtccaggatagctcagcccacacggggaggagagcagaggcaaagccctctctgcatcaaagctgcccctcactggaagcggcctgtgaagtggggctcagtgagtctgagtgtctgtatgcctggtgggctttgggttcagactgataagggttaaaatcacaactgactctgaccccttgccgggtgatattaacaagtcattggatcccaactctgagccttagtttactgctctgtaaaatgggggcactaaggcgttattatgagggccaaagagagaatgcttgtggagcgctcagccctgggcgctggctccagacagctctcagaaatgtggccacttagtgtatgcttttgagattgtcattctcagagtctagaatcctgtggtttcaagatgaaggattctgggttcttttccaagagtccagacctcttttttatttgtgattttgagattgtgacttcttggttctgacatcctgtgatcctgagactctggggtctggagaggtgcagcaggtcgggggccagtgggaaggcagtgggggcagtgtgatggaggggccagccgagggagcaagcacaaggttggtgtctgtttcctgtttattggttcccagggggtgagcaggccctgctcccgcacagcgctgtggagcaggaagcggggaggcagagttcctggctgccagccagccccacagccgggcctccagggactgctgggaccccactccccaacctcctggacaaacattcagtcctttcccaggacagggcactggaggttaaggagcagatgtggaagggaaggggtggatagatggggagggacgccttcccccaataaaggtcccgatagctccatctttcttagctgcctgaatcactgaggtctcactctgggtttcttggtatcccccgcctttccctgtctccctgggatggggcctggtgatgagatgtccaacttctgggcaggccagaagggcaggaggaggaagaaaagggccagggcctttaatgccagaactgtctacctggaaagactcttagaaaccagccatgttttctagccttcctcacccctgcatcattcagatggggaagctgaggcccagcaaggggccttgcccaaggccacacagtagtggactagagccagaaatcccccccatgcatctcaccattgctccagcctcacactgtaaggggtcactgagagttcttgagaagtgcagtgacgtggttcacctggcattttagggaacttgtctgagccagggcaggaaagggaagcccctgtatgtgtctgaggccaagaggggcagggaggtctcagtttgaccagagcacctggggagaggctctgtgtgggcaggaaccaggttgaaagcctcaagtgccgagttaaatggcctgagcagaggggctcccctctgccagctcccctctccctttctgggagaggaagggctgggagcactgccagctttgcacatcacagtatcctctggttgtgaggtgatgatctgacatgagggtgcgggaacatgagtagcctgagcttaggtagcagaggatgtggagctggcgaggggagaactgactgggaagacaatttggaggcagaatctgggaattcgaatttaggttcaggggttatatcagaaacagggttgggggagcgggactcacttcttgtctcggcagaaatttcctctgcattctgaaagagtgaggtggctgtgagccctgcctctgtgcccagcaagcctcctgtctgacctcaaaccctctgctccagtggaagtgccctgcctctcaggggggtccctgaagagccccagagctccaggccacacctgcagtctggccctcctgggagaggcctaatggagggagcatggaagggaatgaaagagcaggcttgggctgccttgctggctctaacctaagacaagtccctctgccttggtttccccatctgtgaagtgggagtcctccagagtccagcagagctctagaatatgcaggcttttgggaactgagggagagggactggtaggtccacaggcaggcatccttgccagcagccctcgtggtgggtcctgtagtcagagacaaagaaccttgtgatatttgtaccctagatcctgagaccagtgctattctgtggccccgcagccctggaggccttcctgaagaagaggagagccgcgctttagggagaggagtgcctcacactgggggcctgagcggaaagcctgcttccctgtcagatgcctgagcgccctcccagctcctgccgctcctgggcccctcctcccctctggcctggacccgccacttccaggcttctccccaaggccagcgggggcgttgcctggggcgggtgaggaatttccgagggaatggctaaattcagccccagctaaaaatagtcccgggcctggccccaaggctggtggaggaataggagaagggtgggcccggcctgccccatctcatcacctggacgtggtgcctgggcagtggagggtctctgctggtcccctgggcatctgtgtctttgttccagccactcgcaccaggacttcctctcatggaggctccctgctttcttctctccttctgtcctctgtccttctccctgttctcctccctgggtcttgctcctcttcctgtctctcatctcctctgaccatctgtgtcaccctgcctccctttagagagccagacagagacccctggccagggactggtcttaggaaaacggccgtgtagggcagagtccccctcagcttcccagcccaggtgtcaggaaccgcctctgtcccaggatacacagtgattgcagctcctctctgcttcggaggtaacagacctctaaggctctgggatgtggagatgtgggtgggagcccccagtttgccccgtgacccaatgcttgattctggtcgggtggatccacccatgccaagccctcctgttcctggcacgaggtggagcctgggtacacgtttattaaataaataatgtgggggaggcaggaggaggacagctgagccctgccctgggggagcgcccaggctcctctcagctccccttaccacccatgcctatgcctagccctatgttgctgctgtcctggggaccaggcaggtggaagctggcagatgggcaaagggtgccgtcccgagtcggcactgattgggggtgggatgggaagcagacacaggcccagagaaggtgagggtgcttagctcaggtcacagagcccagaaagagagaggtggtattcaaaccaggatagtctcactgggttggagttcagacccagatggtctggctccagaacccgtgcttaggcccctggctttcaggactgcctgagttgggggcagtgccatcatcaaggtgggcacagaaagaaagggtggattttgctttggacatagtgatcctactggattcacagtccatggtctgagtcccaggaaccagcacatagtagttgctcagtaaatattagttgaatggctcagttgcacttgagaggcccttggggagtgggaggaggtgacaggcacagaaggaatgagtgtttcctccctttatgggcccagggacccttctcttggtgctggaaagcagctgaggtgggtgctgggctttctgctggcggagagaactcagcccaggagtttgggaaggtggagagatgggccacgggcaggtgaaggggagacaggcaggccaggcagtgcagtgcagtcccgtttgcagtatctggaaagcagatctcttgggccatggccggcgtgactcaaatggagacaaaaaaaccttccatatttggacaaagagcccagagaggcccagacccgcagccagcccaaacctcccccacccccagcctcctgccctgtctccctctgggcccctagccctgagtcctgtcccatgagttgaactcttgggcctcagtcatcaggtcgcttcctgtgtggccaggcctgggctgtgggtgctggggaagaaatttcgttccagggctgggccctgtgcttgggctggagatgtagagaggagccctgctggagcctgcgggctggaggggagcacactgaaaccaacagttcccacactgtggggtaagctgacagcaaacccccacccatctcaacacaggcaaagcttgaggagcatcgcatataggcattgtacacacacactctctctctctctctcactttctcacttttcaatccccagcagatttccatacccacaaagacatctgtacagatatcaggagtgaggaccgagcctgagaccttccctggagcaagctttgatgacagcaaagttggagtagattggggcagccagatgtcaacaagtaacataaacaggcattatccatctggagagatgtgaacagagcaatttgctcctgtaccaccctctgagtgtccagcaaggggcggggctgggcagtggatgccagagcctggtgagtggggagagggcctaggccgcttcctgcctgggagcagaccttgctcccatgggacagcccagccatttgactgagaaccggggtgttcactgtcattggtggattgactgagccctgactgcacagatgcttctaccttttctaactagtcttggataattaacgctgaaataagctctgagtggcgggttgggggaacccaggggaacctttaaaattcaattgcactgtggcccactggtgcctgtatgtgcagggttagcatgggggccgcagggtgaaggagaaggggttcctgacccaagaagccccatctgagaactgggggtcgaaggaggccaagaagggtgagggcagggaaggctaacttagggcagtggctggaatcttgaaggactagccagaccttgacaggcagaaatgagccaaggcccttcagggagagagaactgcaaaggtagaggcctgtgatggagaagccctggtgtgtctggggtaccatgaaagctccctggttctggagaggtcaggtgggccccgggagttcctaaaggccaggcctaaaagcctggacttgatcccagagtggtaatttccaagctcacggctgtaatcccagcactttgggaggccgaggttgggaggccgaggagggcggatcacctgaggtcaggagttcaagaccagcctggtcaacatggtaaaaccacatctctactagaaatacaaaaattagctgggcctggtggcatacgcctgtaattccagctactcgggaggctgaggcaggagaatcgcttgaacccaggaggtagaggttgcagtgcaccgagattgcacattgcactccaacctgggcaaccaagagtgaaactccgtctcaaaaaattaaaaaataaataaatgaataaaaataaaaatagtggaaccttttcttctagaggaatcttgacacagaagtataaagcaggctgatctcattgatttaagtgaaagtagggtcatgtctgccccctggaccacatctcacgccatgtatttccatggagctttcaggactcagtcaggaaatctctgttgtggaaagagggaagccctccctgatgggaggcgttagagtgagacaagcctctcccttcagtgtctctgcaggctcagaagggcaaccagccaggctccctgggcaggggtaaactctgttgggggccaggtctccagacgcagccaggatgatggagcataccacccatccttggtgctcctatgagcaggcagcacctcccacccggggcctggagctggctgggccccacttgatcagaaggacaaactgttggagtggtgggaaaatcctgcctgccccctgctgacacctggaaggacacaggccctttgagggaggtaggagctggcaaccagctacgctcccagaatgtgcaccctgtctcagcccagctcagtcacactgacagtggacaggcaggagcacattctctagaggtccaggaatcgtcctgactcctgtaggatgagtgaattaggttagaatcaggaaggaattccccagagtttgtagtgtgtaaaaggaagagtatgaacaagtgttggcaggagaaagactgagctctgaggctggcaggtctgaggcccttcaggacctaggccttgccccgcttagtagaccagcctgcctggtccaccatacagcctaagctcccacttctttggccacgaaaaatgtagaatgagtaggaagttgccaaacatagacataggaagccacacctggcagagagaccagcatgtgcaaagggcccagggtgtaacaatgcgatgggttggaggaactactgtggccagaacatgatgcagccagaccgtggtaaaggtggggaaatttgatgctggtgagtcagcaagggccaggtcattgagactctcgggggacaagtacttgatcttacattcagctgggttagtgtaatggttagaacagactgaagccagatggctttcttcaaatcctgctcttcctcttagttttgtggatagtcctgggtaattattcattggaaaagctgagtactcacgtgttagtacttagtccctctgtggctcagtttatgtacctgtaaaatggggatgatgatgatggcacctattatagggttatggtgagaatttgatgtgattatgtctgtggtggctgggctggaccacagaccactggggatcagtgggaagccgtaaaacaagttggaagggagggagggaagtgacctagctggctgaggaagagccccagggatggagagaagaggatggggtcactgagagtagcccaggtaatcctctttggtagggggatgagctgagctccctgagggaggcttggagttccccacgggcagctgtccaaaggaaaagagtggggctatgcaggagggatgggactctgcaggctgggggctctgccggagttttgctagcagaaatccccaccttgctttaaagttgcccatcactgactctggagcagctggtctgtgttccttgccatacagatgggggcccagagaggggcagggttgccagagtcacccagtgacttctgaccccaggaccttcctccaggctggggactcactttgaagctcaaagcccagccctgaggtcgctctacccaaggcaggggttgagcgtttggcttgaaggaggaattggacagttctaccccagtctgaatgtgatttgggcagggagggcttcctggaggaacaccacatgtgagactggaactgtcccagaggagaccaatgtggaaacagaagagggaaagcaaagacaaaggctccaaacttggggctccaaggcagtgccccctgttctctggtgcagtcttcattcagtgggaacctcgtcctctgtatgtaggctgggaacacaggtggtgccccagctatgaggaggcacagactgagacaggaacatcaggcctgtgtcaccagggcagggtccgggctggggcagagatactccgaggccaggggagcccagaaggtctaggagagagagtcatggagggagcctagagaggcaggatggagaaggaagaagaggggtgcaaaggctgttcagagatgagacgtgaggctggagtgggcagcaggggcctgattgcaaggtgaattttttaaattaaatttatatatttaatattttgaatagatgatatattcacatggttaggaaaaatccaaaaggataaaaagtctccttcccacctggctgcctatttcctaccctgcctgaccccaggccacccagctagtagtgtctttgtgaatccttttatctgcaaacaccagcaaattcatcatctgttcccttcctgcacacagatggtagcacaccgctttgccccttgctcgttacacttaatgtcatttgcaggtcttgccttatcagtattttgagagctttcatatatatatatatatatatatatatatatatatatatatatatatatatattttttttttttttttgtattttgggtttttgttttttttttttgagacggagtctcattctgtcacccacgctggagtgcagtggtgcgatctcagctcactgcaacctctgcctcccaggttcaagcaattcttgtgcctcagcctcccgagtagcttggattacaggtatgcaccaccacgcccagctaatttttgtatttttagtagagatgggagttcaccatgttggcctcgctggccttgaactcctgacttcaggcgatccgcctgcctcagcctcccaaagtgctgggattacaggcgtgagccaccgcatctggcctcatattcttttttgtactgcatggtgtcccattttgcagaataccaaactatgcaaccacatattaacaggtatttaggttttttcagtcttttgctgttacaaactgctgcagtgaacaagcttgtttgtaggtcatttcttaggagtgctaggatacagggtaaatgtgattctcattttgctgctgtccatgggggtctgccatcagcagtaggttagaggcccatttccccacaatctcaccaactcagacctttgggtatcttcccaatctgataggtctcagtgtattttaatttgtatttatcttataatgagtaaggttgagcatctttttctatctccaagagacatatggattcccgtttctgtgaatgcttcatatcctttgtctatttttctgttgggttgttggccttttgtttttatcagtttctaggaaccttttaaatattagggaagttagttctttgtctggcatatgagttgcaaatatttttttcctgatttgtcacttgacttttgactttgtttatatttttactatgcagaaggttttgttgttatgtgttctactttatcaagcttttattttattgcttctggatttggagtcatagttagaaaggcctttcccactccaagattataaagtaattctctcatattttttctctgctattttcagttttcttgttttattttacatttaattccttgatcggtttggaatttatcctggtgtgtagtatgagttatgactgcaactcttttttttctggatggttggttttaaggtgaggaatgacttggtcagaatctttctagggtgggtgtgaaggtcagctgaggggatcgaggctgtggctgtggaggggcaggggcagagggatgaacagaagggcctggagtggcaccagataacttgctgggccctggaaggtggcataacattcccaaattccttgtctgtactgtgtgactttgggcaagccccatcccctctctgggcctagattatcatagctggaagaggccctggacatcgccctggctgtcctggaggtggaggcagagagtaagactgtggagctagcgcccactcaggcttggcccaagaagatggagggctggcagcagaattcactgtgttcctggagtgggcaggcaggaaggaggagaggggcaggcacccatttaaaaatgcccactgcagcctggcacagcaggtgggggtgggggcaggccctctgccagccctctggatccaggaaggccaggggtttctaggggtgggcacattacctgctgtctcagcactgtgggcccagctattaccattcttggggatcctcttctccctaccgtgaggcaggcacccttgtcctctcctttagaaaaatagagaagccagagtggacagaccacatcccccagaacctagtcctgccactaccctggacttgctgtgtgaccttggattgagtccctgttccctggggtccctatccatcaaagggagcactggccttgtcctggctgtgtcccatacccctagcccttacccatgtctcgatttggattagaggtagagagatcttaaggcccatgcctctctctccctcttttacagatggggaaactgaggccatggaggggaccctggacccctgccctgcattgctcttcttggctttcctgggcccctggaccttcctccctggccccagcgtagcctataccacctcccctcccccactcctgggccccagtggtcaaattccagggctgtcattgccatggcaacagccagttcacagggcccctcctctggggttctccaccagtcctgttgtccagggaggaggcagaaagggcctcccacccctgggggcctggagggttgggcgagggggagtgggggggtgcggggggaggaggtcagactcagctggcttctcatttgttttccaaaggagaaaatggaaaaggcacaaagtgctgccaacaaatgctactctgttgtcctggagagagagagggatagaggtggtcacctgggctggggacaagagagccacctggaaaacctctcccagctctcacctggagaatcaccccacagaagcatcagagcccaaaggatttttgaatgggaggtggaggaaatttcttcctgaggtgactgctgtccatttctaaggccacccagagactgaggggtccagcccagcatggctttttctcaagcagacatgcccatagtgaaaggagctaccatggccccatgggagggggagcttgtcagccctgcggatatgccagcgagggctgccagggaggcctgccatggaaggagggtgcttaagccaaccactgacccctgaggggacctgccctctgagattctggttattcataacagccaatatttgttgaactcatgctttgttctgggcactgtgggaagtaagccctctatattctctactttatagatggggaaactgaggcacagatgtggtcttctggaggtcgggaagccatcagtggagagtggtctctggctctacccctctacccacctttgtccagggcccctgcccactgttaatgttctggtatatttccctccaggctttttctccgtgtgtgtgtgtgtgtgtgtgtgtgtgtgtgtgtgtgtgtgtgtgtgtgtgtgtgtgtattttaaataacattgagatggtgcagaatgtatgcttcttgcttctttcatttgatgttatacccaaatacttctccatagcatttcaaagatttcagtaagtgcatgaatctctgggctttcctgtggttggaccttgaggttgtcgccagttttccctgctgtggaaaaggctgagtgggcgagtgggcgtcctcatgctgggagcctgggctgctcccggggtcactcccttaggctagaacatgctcctctctccgggttcctagataatcccacacctcttccttctggggttcctggggggcgggaatcctgtctgcttgagagaccttgagcaaggtacttaacttttgagcaaggtccttaactatgcctcatcatcttcctctgtaaaacagggtaataatagggcctacccaggaggcttattgtgaggttaaaataatacctgcagagcgcttagtaagcagcgcagaggaatccctcaggagatcttctcctcctggtttatgcttttgctctcttcctgtcctcaggcccaacgaggttgtgtaatttgctcacagtcccacagcaggtcagtgccggcactgagatttgggccctggccccaccaacctctttgtcttgagaacctaagcacacatgacttctcactgagccttgctttacccacggaagagctcatgaaattaggccctggaagtgttttgtaaactctaaggtactgggtggttccacttattgccaataataatgacaagactagaaagaccctgagttttaaaggccgaaactctagaagttcagaggaggggagtgggcaggtctgtgctaccagaaagactttctggcggtggtggccttgtcctgggcctcaggagagtataccctgggtttggctcaggctgaccttcagctgtgaatcttatccactgcgcacacttgtgcacatgcacgcgcgcgcgcactcacacgtaactatcgctgtccaggcattagggctggtcaccattggtggataaattcagtaaggcctaaaagcccaagctgctgttggtcagccagaggcagagaccacttcttccagaggctagggtggagggataattgaacgggcatggtcactgcccctggacatcctgaccaccctatgcttgcctggtgtgatgggagggggcttccctcggctctgggttatgccagagtccccaggggcagggctggagtgaccgactgatgggtagaacttactctcccctcagagtgtcacccgggtcctggaacagggtgggagtaggggaggtaggggccacagtgcaacccagctggttgggcctctctggacaagctacagtgggagagctccagaggcctggtctggtctggttctagctcagctgactgtctgccaccctgggggtcatgagacatttcctctttgagcctctgtgcccatatatcaaatgcgtagaaatggtcccttctctgcctccctccttcaagagaggattgaacatggacattctaaactaatcagtgcacattaattacactgatacttgctttcattcatcctcaaattcacaaatgtgaactgagcacttaactgtgggtcagtctctgttgtaggcatggaagctgctggaacaaggcagaagtgcaccctcccttttggagctcacagactttgttatatgtcccttagtacctgggcagcttgcctgagtgcaagcctgacatatagtaggtctttcaatatgccaaaaaggaggctgctgattggggaattagcaccaggcagtttggtcagtgccctggtctatagcagggataggtcagggagggtggaggacttaaaagaaacttccaggaagaggcagagcataaaagttagatggcgtttaaacagggccaagagcaaggagggcagcccaggcagaggagcagtctacacaaagatggagaggtggggaggagactggggttggacagtggtgaagagaccagcctggctagaggagaggctgggaggtcacacacgtaggctgctgggggctgattgcacttcaggcttccctaggtctctggtggcatgaatagaatttctggcactatggtaagtggggaagacagcctcttttggctgtggggcttcaagagcccccaggatttatcttcagccgaggcaggctctggccccctccttcctgcctcagctccttggggctctggctgaggctgacctggcctttcccagggtgcctggcccacagcccagtgagtcatcttctgcaccagaggcaggacaccccatcccaccgacaacacatgactgcagcccttccccctgctcctgggtctgagggagggagagaacaagaggggctggaaacagaccctggataacttccgttcccacgatcccagcccccctgcaggctggggaactgggtggaggatagggaagggatccctgctttccagtgctctgtgcaggtcaggaatcagaggctgaacggtggtggtcctgggccacagggcctgattccctgagcactggtctggtgctgagccagtgttagacattttgaatgaaataacttttagagctgggagaggagggcccctggaggtcatctcattcataggttttaagccagggctgggaccacaggccaggccagtatgtaggcagaagtgtgcataggggaaggtgggtgcatttcctgggagccctaaagcaggagttgccagatttagcaagtcctacctaccctaaggcctcatgggattaccagtggggtccttctcgactgccaagggcagggcaacctcccctgctcagactcagatgtgggacccagaagatctgggttctggtttctctgcctgtaaaatgggggtgacagtcccagcctcttgggctgagaggatgattgcattcaaagcttctgagctcctaagatgtttttcacatctgttgggggtctgtctatccatctacttctcaagccccacctcctgcttcccgctattatccataatgagaaacttttccttcccagcctggaaggtccagctgtatcttcttgaaattgggagggaggggggcggatctcagagaagaaagaaagggaaaaaacccacattaaaaaaaaaacccaccagttaaattcaaaccacatgcaccacagcccctgccatgtgggcctctgctgccacctgtgggcgtctggtggaagtgcagttcttggggcttcagcttcctcactggagccataggcttaatcctgaagcctgaaatcaggaaggaaggtcaagctgtccatcctccacctctgagcatgacctcacccccaccacctctgctgccaggaagcctggtggggaatttagaatccatctacaccttcccttctcccccatttgtttacagagggggaaactgaatcccagagtggagaggaatttggctaaagttgcaaagcaagacagtcaatagataagtattgtacacctactgtatgtcaagagacctggtctctgctcttatggatcttctggttgtggaaagcagggagcagacattgagaccgtcctatttccatctaactcccagccatccatggaagagaatacagcctcctaccttctcattcaaggtgctctgggcttggcttgacttcttgttaatgtgctctgtgaccctggtgaggtcactcagcttctctgatatgccagttacttggggtcaaatcccagctttgccacatcctgacttcataacctcaggcaagttgctttgcttcctggagcctttgtttcctcatctgtaaaatggccataacaggaatacataactcagaggactggtgtgaggactaaatgagataatacatgagaaacagtgcctcactaaacattagccagctgtatacatgagctcccaccaaggatacagtgagcacacctcattcccagaggtctaggagggggctgggagcgcagtgggtacgggggtcccttctgggctaagagtgcaccagcaaggttcagcagttagaagtcgggcctgagtcccagcataaggaatgagggctaccacctccatcctcctttcagccagcagggacagtttctggaaggagtggtgaggttggagtcccagctggacccctctggggcaatagatgaaatctagcctgtgcagaaatcatccccttccttcatttctcctgtcagcatatgaaggaccctgggttcacattccgtctcttccactcactgcctgtgtgaccatggctcctccacctccctgatcctcagtttcctcagctaggcacttctcactgagagtcatgcagtgtggtcggatagtgctgggctggaattaccttgaaggcatcctcactcacaaattggtgattaatgctggcatttggctggacctcatctggcctgtcagctggcatacctacacatggcccctgcatgtggcctgggcttccccacaacgtggaggctgggtttcaagaatgagcaagccaagagagcaagatggaagcacatggcatttttatgacctagctttggatgtcacatagtatcatttctgctgtgctctgtggtcaaggcagtcacaaagctttacccagcttcaaagggaggggacctggacctcgtctttctgtgggaagagtcaataccacattgtaagaagaacatgtgggccaggcgcagtggctcgcgcctataatcccagcactttgggaggccgaggcaggaagattgcttgatcccaggagttcaagactaggcttaatctctaaaaaatatttttaaattagctgggcgtggtggtgcgcacctgtacccccaccactcaggatgctgagacaggaggatcgcttgagcccaggagtttgaggttgcagtgagctgtcacgccactacactccagcctgggtgacagagtgagaccctgtctcaagaaaaaaaaaaaaaaaaaagcatgtgagatgatagctatcttcaaaacatacagtctacctgaagatgattatgaggaaaacagctcattgtagccttgacatcccagagctcaagtgatcctcctacttcagcctcctgagtagctgggaccacaggtgtgtgccaccaggtctggctatttttagtattttttgtagagatgaggtctccctgtgttgcccaggctggtctcgaactcctgggatcaagtgatcctcctgcctcagcctcccaaagtgctgggattacaggcgtgaactaccacacccagctattttttattattattgaagtgaccccttcactttcagtctctgccattgaaccctatggaccatcaccctcaccagttgtgcagtcacatgtccacagaagaccccaacaggagtgtacacagacacacagaggagtccacacagagaggacacaggtcgtgtcactcataatcccaccccaggtgcatacacgcacccacctaagcagggcactgtccccatagcaggaagatcctgaggctctaaggagctctccttcccattcccaaagcacattccccagaattatggagcccaccctgagcagccagtccccagggagccctgtggcttggacacttcccttctagctgcctcagaggcctgggaactctgtggagccttgagaggctcctctttccagaagagagggtctctaggaaacaggacctgaccagggaaggcagggggaagggaggagaggagagaagatagggggatgggaagaagacagagtcctcaagcaggaacagatggagagactgaggccccaagaagtgaagtgtcctgcccaaggtcacttccccagtaagtggccaagccaggatttgggattgagctttctggctccagggcctgccttcttaatctctctacccaaaaagtccctcttttggaactttcatctccttgatgaactgagcacctgaggaaggcagcggctgtcagggaaatggatagcccattaggttgggaacatcccgtaccaaccctatgcttgtggactttggtggggtcaggagcatcagacagtctgtgtgggccattcgccagggccgagttcccagggaagaggatcttctttgactctagcattgcctgtggatggcagtttgtttaccacctaaaccttcaggagaatctgttcatgtcactgtcttggaacaaaggaggctgaagaaaggcaaccaccacaccagggaggtgggggttgggggagcccagctgtgtgcaccaggccaggggaggtggagtggggctctccccactggggagagggtggggtttaggagcctgggccctggaggtggctggtagaactgggttctacctcttaccagccaggtgacctctctgagcctcagtttcctagtttgtaagaagggagagtaataataatagagttcttgatgtggggctgctgtggggattaaaggagccaggacgtgtaaagtgatggtagggtgcctggcccctgagaattgtccaaacagcattagtggtgtggcaattctgagattatggggttcctagtcttccagtttgggcagctctggggcccaggcactctcttgacaaagatttaatagggttgtgcctccactcccaggagcctgatgaggcctgctgccccagtaccggcatttctccttcaccacctgcatcatgcttgccatttctttctcagttcctgtcttcctgtgtagactgtggtgcccagtagggcacagacctctttccttacctttaaatccccagcacagtgcttggcatctaataggtgctctataagtatttattgaactaatcaactaatgaataaaataaaaatgcaattgattactcatgcattaaaccatgtatctgtggattcattcatgtattcatgactgtcattgatctgttcatccattaatttattatttattcatttatcatgatttcatcctttcatcctttcatttattcagccattaccggttatctgtccatttgtttgttcatccctgtgtctagcctttctcatcattggtcccatttggtccagcaccagctggaggaccaggtggcccccaggtggacagtgcccagatgcaggaggtatgggtgggctcagactgggtggtgtgtccagaggcaggtagtcagggtattgggattccctcagagatggggaagttgttagcagattgggcagaagtagggagggttaggtgctccccagggctggtagaaaggtggtcccacagacttgggacccccagcctgcccctcctggagtggggtggtactcttgtagagcagagccctttttccccctctctgtctttccttctctgactaaagagcaggtgagagtgtggctctttcatgggagaagaggtgtttatggttgggtgtggggtatggagaggagggctgggtaggccttcaccaagcaccctgtatacttacaaaaactcttctgagccacactcattctatacaactgcacataccccaaaggagataaaatcagcactcagaacaggagctcagaggaacaatagcagaaccaacctgcataggggtaccgtggcccacctggtgccctcagcccccaccccaactgacctcatcctgaagggctctgatgcctgtgctgttatggggccctccctggacaccctgcctcagcgaccaacccatgtgctcctgttccttctctttgcttcctttcatctccccgaaccaccagccccactccattgccaagacaataggcttggatctaattagtcatccttaatgaagcagcagcagcaagcagtgcctttggcaccaagtcccgcccccttcttgggggcagggcctttcagtgaactctgtcttctgggcacccatatgcctgtggatctctcgacctcaggaccttgttcttgccatgcctcctccaggaagccctccctgaatactttcccctgaagcagcagtgactccctctgctgagccctatgagaaaaagccctgtgttgtctgggagctcctggaggcaaacaagggtggactgatctctgcagggccccatcccactggaactagtgagggaatggatgcacgtctctaaatcctgagccacacactgcctctcagccactcagaggaagctgatgcccagggttgtgtagcttgagagggtcagatgagggacgaggtgccctgagagaaagccagatgtgggttaagtatcctcagtgaccaagcaatgagccagggatggggccttcagaccaccactctgcatgtgctgtgggacctggatgtctggactggatcacaggcctgtccatcctccctttcaagccaccactcagtcaattggtctggctgttccagaccccctgcatgcccagccctgggaggaggaagaggaggagcaggctccatccgcagggaagcccacaatccatccagttgggagggtaagaggcagagagctattcaggctggtctgcctctcagtcagtaactgctgggcatgtggggagaagggaggaggaagagctattgggggcttgtttattaagccagccttccttataagtgccctggcttacaaaagggacaaggacgctgccctcaggaagcatatagtctcctgggaggagacgggcctcaatctagtaattgcttaaatgtatatttacgaactgccatacatggttaaggtaaggaaaactgagagcctttaagagcagaaattagatgcacatgacctaatctgaggatcagggagggcttccctaaggaggtgacatttgcactaaaactggtattttttctttttgagatggagtttcgctgttgttgcccaagctggagtgcaatggtgcgacctcagctcaccgcaacctcagctcacctcaacctccgcctcccgggttcaagctattctcctgcctcagcctcccgagtagctgggattacaggcatgcgccaccacacctggctaattttgtatttttttttttaatagagatggggtttctccatattggtcaggctggtctcgaactcccaacctcaggtgatctgcccgcctcagcctcccaaagtgctgggattacaggcgtgagctaccgcgcccgcccgaaactggtcttaaaggaaaagaaaaagcattactaggagagggaaaaggcatgggccaagaccctgaggcaggagagggcatggtcagtttctggaagttaaaacggaagtggctggagcacatcaagcaaagagatgagaggagtcgacagatgggcctggcttgagctatggggtcaggatgtccactgtgcaggaaactcaggggaaagcaggtttgggagaaggagtcagctgggggcttggtgagcgtggcagcgtgcagcacactaaaaggcatgaagttggccagggctgaggcacagctgcagggtgcttcagagcccccccatcttgctgggtgggagctggtgcaaaagcaggttgctcgcccccacccctcagtccagattgagtctaggataggttctgctgtcactctgggctttcaagcagcacgttatgaggatcctgcttggagacagtctaggggtgcacagtctaggtacgggagcacagtctaggggtgggagcacagtctagggatgggagcacagtctaggggtgggagcacagtctaggggtgggagcacagtctaggagtgggagcacagtctaggggtggggcggatggacagggacaggactggaaccctccaagatggtcccaggtataggacacaggacaagctggatccgggcaggggtagggatgattcaaggtgggtgatttgagtgatagctgccctccttcaggcccaagagctcctcccttgggtggaagaccagggatgtgtatgtgtgcacatctctaaatgtccgagcctggacatatgtgcctgtttctgctggcaatagttatgtaaacacagaagcacttgtctgggcgcaacgatggatcatgttcgtttctgtcaaggttcaggtctgtaagggactgtgttgatgtgggtgcacttggcctgacccccttgtgcatacgggtccaggcctgagggcaggtttccatgaacgtggcctattccgtgtaggtgtgttcgtgcccctgtgtgtgtcccgtgctccgtggctcctcggtgggaagctgcgttcagcgtgtgccggcgctgggtacaggtgcggacggaaagtacatgtcggcgcctttgtccacgggtgtgcgccgacttgtgtcctggggcgggggatgggtccgtgagcggacgctgccgcgtgggggaaggggcgggtgcgagggcagcccagagcgtgctgggggagatggggcggcgcggagagggcggggaccctcctccccacaacggggccgcgcgcgcctggctcgccgggcgcactcccagcgcggaggaggcagcagcgccgccggcggccgggccgcagcgctcagatcgacgctggaactgaccaccgcgaccgccactgcggctgccgccgcggccgggctgagcccttagggagcgagagtgggaggcggcccctgactccgcgctgacccccgccccccgccccgccgccaccccggcgcccccgccccagcggctggccggccgcatgctgcagatggtgaagaccctggcccagttcaccatcgcgctggaagacatgcgcgatatgggcccagccgccgcctccggggagcctgccgggggcagcagcactgacgccgaggagcctggggaggcccaggtacggggagggggaggggcagccagggacctgggccatggcctagaactcagccgacccaggagccaacccaggagacggtggggggaggggaggcatggggcgcagggactctctgtgaccggggatggagacctggagattgccggtgaggaaccctggcaggcggtggtgtggctggcagggcgctgagggtcaaggcctggtggcactccgcttgcagaagtgcctgtagaagctgaggctgtcgccagtgttatcctgggtccacaggctcaggaaggagaggttttcccagccctcctcttaggcttgaggtggccctggtgtatgtgtgtgctggaaagtagagtcagttttgcacccccactgccatcctctccctgccgctgggcctgctggcccttggaggagtcatgctgcggtgggaacagcagcgtccccgttctcgctcagtgtgtgtacccctgcaggggaggggaggcgtcttggggctgtttccctgtctttgtgtgtctctgggcctggactctgtgccatgctcccggccccagtgggggctgtaattctgtcccctccccgtgcaatgatgtgtctctccacagcctcaagtctctgagctggcgggcctggttctcagctgcgtgacctggctgcgttttttatttctgtgtggggcggcttgcctttatggcgtctctgtgtgcgtgtctgtcttcacactgtgcccgtcagggtttcagtctttgggttgtgatgccccagtcatcccaggagtggccccctctgtcttcctgctgtatcccccagtgcccacctcagtgcccggtgtagcgaaggtctggggatggggctggtgagggatgaggggtgctgtggggaggctgggtgtgaagggctgttctgcctggaacaggtgggcctgctgttcaggctgacagctgcgctgtctgcctcctgcctcccctgtccacccccgcaacccccgcacactacacccgtggtgggcacgtgtagagggctgctcgcgcagtgacagggagctggccttgttttctgtgtctttacctgacagctgagtgacaggccgctgtgctctgccgcagggaggaggctgggagaggcgggcatttgcagcgtcagcctccccgtgtcaccccagcctcccggcatcaggcacagcgccagccctgcctctcaggaagcctccctgaccatgaccattgtggtgcccgctgggcctgatgggccgttgtgtgggcgggggagtgtggctgaggggcccagggccgcgcctggcctggccctgctgtcagggagctccccacgccgtctcactgagggggagaaagggtggacactggtgacctgctgcgtgtggacagagctgctctgctcgctgccgcctttgccttcacggtgatgggagggcggggttattagctccatttcatggaagagaatgtggaaacagggccattaggtgacaccacagtcacacagccagtaagggcagtgctggggacctgtggcccgtggctgcccagtcagtctgggcgagaactccaggggctggggccctgagagtcatgaggtggctgaagagaccctggtccttgctttgccactcacaggctgtgtgatcttggacaagtcatgtcacctctctgacatgacccctcacctgtgcagtggaaatggcaacacctgtgtcacagagctgagtgtgaggctgaagcaagaccatgtctgtggggtgctgagatgtccctggcgtggggtagggcaggattaggcatctgggcctgtcctcgggaggccttcctggccctccacgctctcccaagtctccatcctacagtgagccttgctcgcactgcctccttctggaagctgccctggttttttagaggtcacaagagtaccgaggatagatggtctgcttgtctccagaggctctgaggctctggtctgctgtttccggaggccctgaggtaccttcccacccgtcagagcccagggctggcaatggtgggctggcaaggatggggagagccagccccccttcctccctgccccaaggggtgtccttcacacccccaccactgagttcctagcatgggagctcacttttctgagtgtgcttcattataggacactgtggggacaggccttgcccctgagtccctggtcagagggcaagggatctgaagtgggtgtgccacaagcagagggggagcagtggctgggtcaggcaggacaggcctgggctcaggtccactaaaacatgagccctgggcatagcagtgaccaggacagccccactggttgagttcctaccctgaaggactagaggtggaggctggagggatgccacagacatggacaccctggcattgccatctgcacagcacttgctcgaaccagtaagccttgatggcaggaacccgagatacggtccacagatgctcaggccaagccgagacctgggaggggaggggagagaggagaataacccagagatctggagcctagaggagttaggggccttgcccaggatcactctagggctttagaggggtcaggagtggagtctaggggtctagggcttggagtggagtctctgccagagaagggaagttgttggggctggtgctatctgggaaggcttcctggaggtggggattttgaggggagaggtgtagggactggtggagaggagcagcaggtaagttcagtcccaggggctgaacacaaggcatcccagacagggatgagcaccctgtgcctgggggtgtgggtgcagaggctgtgtgaccccttggggactcagtaattcaggtcatcagatccataggttggaggcatcggtgtctgggtttcctttttcccctccctaacatgaagagaataataacatatacctcacagggtggccaggattattgaataatatgtcatgcttagaacagtgcctggcgcataggagggcatagttaatgtttttaaatgacagaattgggatccagccttgtctgagactggctgaaccctgatactgcccagctgtgtgaccttcagcactgacttcccctctctggtccacagtgtcttcctctgtagcagggtgatggtgtctactcttagggatggtgggcagcccagccaggtgggcatgtccccatagcactgagcctgaagttggggtcttcagagatggcagctggagtgggtgctggcctggaggcattgttctttgcaaatgtgaaaggttattgatttttttaaagaccctttttcaatagcctggcagaggagccaagaagtgggtggatggggcaggggcagaggagtgagtgcctaactgtgcaaggccacgtgtttgaggtgtaagtcgggggcagggggagcagctgagcaaagacctggcagagtggagggcctgggggcctcgggggaacagcccggagccctgggcggcaggagggaagggccaggagggcagggagagggtgtgggcgggttctctgggcaccatgtggctacaggtgatggggtctggggggaaaaagacccctgttcaccctctgctcctgtccccacaggacatgcggaagcacgtggccatgaccctgctggacacagagcagtcgtatgtggagtcgctgcgcaccctgatgcaggtggggctcggggcccactcccctgagaatggcctttctgagcctaggaggctgtcagatgggtgtgagcaaacccctttcatggacaagggactgaggccagagagccgtgtccctggcatccgtcgcctttccatgaagaacccccagcatggccattccagagaaggaggaaggcttctcccgggcaagagagaatgcagaggggccaggccaccccagggcaggcgtccctaccctgctgttcttccacgtccccctggcaaccctgaccctgaacttagatccgtgaactccctctgatgtgccgcctccattgtattcactgactgggaagtatgagttgaatagagttcagtattgagcacctgctgtgtgcaggccctgttccaggtgcaggagacacaggaatgaataagagagcccagcccctgccacaggagctcaccgccctgctgagtacgtagtggagtatacgggcactctagaaacatcgaggggcacctgctaagcgtggggtcagggaggtttcctggaggaggtgctcacttccaccatgacctgtcttctcaacagcaggaatagcacattgcaaagccaagtgaggcctggcacattcggaggtctacgtggccagcacagagcacaacgcgctggtcccatagctatgctgtcggagtcggcagaggccacgctgtgggggcctagaacaccagttggaggcagtagattctgccagggtccgtggatgatcagcgaagggctttgagcaggggaggtgtgtggcctgattcatgcttcatgaagtctgtctgacagctgggaaggtgggtggcagaagaggaggtcaaggccattgagatccggcaaggatagaggttacaggaagggagtgctggggacagacactcaggaagtggactggtcaggccaggcgtggtaactggttggttgtggggggcaaggtggggaagcccaagatgatgtctgggctcctggcctcggataggtggggcccaggggagaagcacaactggagcaaggtggtgagttcaggctcagacatgaacctgggaaggcccacagcctggatgcacacatggcctggggctggatgagtgtggacctgagctgaagtggggcctggcagtcaccattgaggatgaatttgcccaagctagctgggcagagtgacagcaaagggtaaaggtagaaccttcaccctatggaaacatccagagcattcactcactcaccattcattcattcattcactcactccacaaatccacggtgagccccttctgcgctccaggtagtgttctctgtgcaggggcattagtggtaagggcctgtctcctggagctcacggtctatggcagagactgacagtgaccagccagacatcaacacacagtggcatgtggtgatgcagaagtgcacacacagagaacctacacacaacagggatacgccttaaaaggagggaaattctgacatcctacaacatggatgagcctggaggacatgatgccaagtgaaagaagccagtctcaaaggacaagcactgtctgattccacttgcatgaggttcctggggtagtcagactcagagatggaaggtaggatggtgggtgccagggaaagggtgccaggctgggaaaggagggaatggggagttactatttaatgggtgtacagggttgcagttttacaggataaaaagagttttagagctggatggtcacacattatgaatgtatttaataccattgaactgtacatttaaaatggtaaattttatattatatgtattttaccataaaatacaatgcgtttgtttattgtttttaaaaagtgcatggggagatgagaacacagaagggggcctaccctggtgtcggggtcagggagggcttccctggggttggggtatttagctgagacctgaagggtgagtagatttcagcagaaagagcccggagggatggctcccagcagagggtatgtcagggacaaaggccaggaggctggaaggaacctagagcagcagggaaccagaggtggccaggtggctgcaggaaggaaggctgctgggcatggagctgggctttcctgtgcacgcaaggaagccatgggaggatgcagccagaatgccaggcaggaggagtagacatggcaggggcctgagggggtcctttgccatcccctagatgagagttggaggcattagggtcagacagtccagggttgaagtcacgtgcgtcctcactgggtgatactagcctaatcacctcaccttctctgagcctcaagtttgcctgcaaaatgtagctaatctacctatctcccatcaagaagacttaaaggtgagccaggcgcggaggctcacacctctaatcccagcactttgggaggctgaggtaggcggatcacctgaggtcaggagttcaagaccagcctagccaacgtggtgaaacctcatctctactagaaatacaaaaatcagctgggtgtggtggcaggctacctgtaatcccagctcctccagaggctgaggcaggagaatagcttgaacccgggaggcagaggttgcagcgagccgagatcctgccactgcactccagcctgggtgacagagcgagactctgtctcaaaaaacaaaacaaaacaaaaaaaacaaaaggtgatgacggcacccatgcctgttcacaggcaggagtcaggagcagtggagagctgggagcaggcagggcttgggcatgtctttctacctccgccaaatctcccagacccgtccagggctgcacttgggagagggtgcaggacctgtgggtggaggaagccagaatgttgggtgagcaaggtggaggtggacaggagggtgtcacgtgaacccaaagaccgtccctggaggcagccctggagtgtgggaggaggactgaggtctggctccaggtcaggagtatgactctggagccaagccaccagcattcaaacttggctccatctcctggccagctgcatgacccggagcatgtcacataaccagtctctgcctcagtttcctcatctgtagagaggggataataatagacctgccttgagtgcagttaattagagacacatgtttataatttagcatactgcctgcagctctgcaagcatggtaaaaagttgcatttaatctttgtattaaccttgtgaggtagatattatattctttatacaaagaaacgaagactcacagaggttaagaaacttgcccagggtcatccatctagtgagtggtattagttgacattcactgagtgcccactatgtgccaggcactgttctgaatgctttagaacagtgagtaaattcatataagcctgactataaaccccattttgcagatgatgcagctgagacacagagaagtaaagctgcttgtccaaggtcacagagttaggaagtgccacaccctgggttgaaaccctgtcattgtgactctgggttctccctgtcacccactagtctacactgcctagagcacagtggtattcaaattgagattggactccatagtcccagtgttaacttcgaaccatcactgccctcactaattgataagtgttgttcctgcaggccaggtgttcaaaatgaacaaagaagttaaatagaagttaggagccagaaggagggaggatttgaaactaggtcctagggctacatcccttcctcagtgtcaccctcaccctctgagcctattttcaactctgacactcgaagctaacaaacgccccttcccctgaccaccctgacgagtccccctccccttggcaccctgatcccacttctcttttccgtagcactcactgtcttccaccatgctgtatagtaatttacgcatttatcgtgcttctttcctgcctcccaccactcatgtgtcagccccacagggggtctgtgcagtgagatgccccagtgctgggcaggctgagcattggtgagtgaatggggcattggcttgtgccaggttccgtattgggctctcagtcattgtttgttctttcctcctgctgtgtgcccgcttctgtgtggggtgccgggaccctgaggtgagcggtttagctgctgctcctgctccttgtggagcagcgggccctgacccagcccaggagctggctcacctgtgggcaggagactgcctgcctatctcctcaccatcatcccggccttttcagaatccccagccaagagagaggattctgttgagctttactttctcaagcttgttttacaaaacaagccagatttttaaaaatgtttaatataaatgttattgcaacatcacatatgctttttcaaacaacaccctcctgttttttttagcctgcagttacagcgtagggccagtagagggcgacctctccacaagcgcaccggcccctgagctgggctattaaagctaggggaacatctttgcacgtagatttgacgtaaaataacgggagttttagtcacagactggccagcaggtctgaaatctgtataacagcgttcagaaagtgtcaataagagtctccagtaacttcccatgtggtctcatgatctcccacgaccctccctgctctatcttcacaccattatcgccttatttatttatttatttagtcctcaggctggagtgcagtggcgcgatctcggctcactgccacctccacctcccaggttcaagcaattcttctgtctcagcctcccaggtatctgggactacaggcgcacaccactaggcccagctaatttattgtattttagtagagacggggtttcactgtgttgcccaggctggtggcgaactcctgagctcaggtgatctgcctggcctcgacctcccaaaatgctgggattacaggcttgagccaccgcgccctgccgcattatcgccttttaactgactacgagatttccatatgtcatccattctgagactcgtggtcttcgcgttttaatatccctaaatcagggttcattctataattggtagcatatcataatttaattggcaaccagtttttcttaaatataaaataatggctgggcgcagtggctcatgcctataatcccagcactttgggaggccaaggcaggtggatcacttgaggtcaggagtttgagaccagcctggccgacatagtgaaaccctgtctctatgaaaaatataaaaaactagctgagtgttgtggcgcagacctgtaatcccagctactcgggaggctgaggcaggagaatcacttgaacccgggaggcggaggttgcagtgagttgagatcgcaccaccgcactccagcctgggtgacagagcaagacttcgtcataaaataaaatatttcttagatttgatgaaatatgatattttaaaaaatttcttccgtttgtgtgtttcatcagactagatcctaagctctatcaggacagggattgtggtctttcttatacattgctgtctcccaattcttagaacagtgcctggtacgtagtaagtgctcagtaaatctttgctgagttagtggtgggaggtctttcaaggagccccatcttgctttcctcattccaagctctgtttgttcatacattaaacaaacctcttcctgagcgtccttgctcccatcttgtgccaggccctgggctcagcgatgagggcatgagcttagatcttcccatctccctcctggagctcttggtctcatgagggagatgtggaaggcagggcgctgagctgcaggcccgggtgattctgtgtgcactcacacaggggccctgtgtaggtgtggtgggggcggcatctctgagggagtgtgcaccgaccctgtgggtccttcagggctacatgcagccgctgaagcagccagagaactccgtgctctgtgacccttcactggtggacgagatcttcgaccagatccccgagctcctggagcaccacgagcaattcctggagcaggttcggcactgcatgcagacctggcatgcccagcagaaggtgggagccctgctcgtccagtcggtgagtggccccgctgctgccaattcccacaagcacaggccctcctggaaggggctggatgtggccacggaccccacccccacccatcccacctggatactgactctgtttccagatctgaccatagaacttggctagacattggtacttaccccagcccctgggtggacctgaacttggacactcccctaccccaaagcttggccagactctggcacggactccgaccccagccagacactgactctgatcctggaccctaccccgctcctggctggcactgacgtgactctagtcctgaccccaagctggtgcggacgctgacccagacctcagatggatgctggtactgacctccaccctatctttactggaaccaaaataactgccctggtcctgaccctggacttgggctggatgttgatgctggctgagtcttgactttttctccatcagatattttcatcataatagcatacctgtttgctaggcattgttctaaatgtgttgtatctatcaacagccctggtaggagagtgcgttggttaccctgattctaaagatagtgactgagacatggagagattggtaacctgatgaaagttacagttaggaagtggtggaggactcaactccagaaagcctggttccagtgccccggcttcccctaccccatactgcctctcaccacaggccagatctccactgtacacttgtcaagctcccacaatagcgagtgagatcttagaaaaggtattgacttcagaattcaaaaagaacatcgaaagcaaaaccaataagcatttaattaaatgcctgtaaaacatagcatgccattttcattcattgttaaatttagtatttataagaatttaattacatttgaaaaacttccagttccattttattttgccagaattcccaagaatacaccatgatgactgataaatcatagccaaatgcaaactaaatggtttctcagagccacataatttcaaaagcaaaattgtaaaaattcttgcaaaaattttacaagtgaaaaattatatctatttctgtgggatgtatgtttcaatatatttgctatgctgtggggtggggccttgaaccatcttagaatgtccttgctgacccagaaactgatgggaccagacaggggtgatggggttccagcttggattgagtgctgatgtctccagcccatcatcactctcagtgtcagtaagctcagccccctgcctggaccttgatgctgaccatggactacggcgaagccctggacccggaggggtcagcacaggatgctgtgtcccagggtgggggtggttggtgagggttgtcttcctccctttgcttcttcacaccctgccctgttctgtccagaggcaggggcacttggcaccttagagggacaggactctggccgggcgcagtggttcacgcttgtaatcccagcactttgggaggccgaggcaggcagatcatgaggtcaggagtttgagaccagcctgaccaacatggtgaaacctcgtctctactaaaaatacaaaaattaggtgggcgtggtggcatgcacctgtaatcccagctactccggaggctgaggcgggagaatcgcccgaacctgggtggcggaggttgcagtgagccgagatcgtgccattgcacactccagcctaggtgacagagtgagactccgtctcaaaaaaaaaaaaaaaagacaggactctgaggggtacagaaatatcactaatgtggtcacgtagcttatccacagtacagttgagacaggaacccaggtttcctggttcccagacaaggcttcttaccaataacctccatatttagtccgccatcagcatcaagcaggtattagccaccagctgtatgtcctgccctgagctgggctttactgtgggtgggatgggagcacttttcatggagagggagaacttgtcctaggagatcaggagaagccagaggccaggtggcgtaccaggcagagctctagtcagggaaaggagtacttccgagaggaggcagaactggagcacagccctgaggcggggcgagatttggatgaggaagggcattcctggtggggggatctgcataagcaaaggccaaatggctagaatgagtctgtgtcactcagagaatggggaaagggagacctgcctggctggacttcgtgagggtggaggtctagggatggaaatgcccagttggaagtgagagaaccaggtctgagctcacaggatacattcaggtctacatatgtgcatacatgaacagtcacacccagataatatgagcactcgtatatccatgtgtacacatgcacatacgcctaaacacgaccacacttagagccacaggacatgtgcctgatcccttagagattgtatcatttctagttggagggaaaagatggtgactcatgaatcagtgaaaactaggacagggtgaggtggggtgagggacaccttgagggtccccaacctgcctcctcctccacagttctccaaggatgtcctagtaaacatctattctgcctatatcgataacttcctcaatgcaaaggatgctgtgcgtgtggccaaggaggcgaggcctgcctttctcaagttcctagaggtactgtgggctagggcagggggatggaggtgaccctcaccttgggccagctttgagggccccaggagctcccagcgtgggtaccatagtcccagccagtgggccagcctccgctctcaggctgagctggagaggcttgctggggacctgtccctggacatagtcttcctggcatgtcattcctcacatgatgcccatccatgggtttcagcaaagcatgcgtgagaacaaggagaagcaggcgctgtctgacctcatgatcaagcctgtgcagcggatcccacgctacgagcttctggtgaaggtgggcatggacctgggtgggcaagtgggcaaggcctggaagcatggggggatacaaggaggtctaaggcccctgcctcgttgagcctgacatcagggtccctaggggacaggtaggaaagatagtcctctttggtgtctacccatagtccctcctgctccagcagtctggggccccaggggtagctaagcagtcaggtctgctccccattcccaccccaggacctcctgaagcatacacctgaggaccacccggaccatccactcctgctggaggcgcagcggaacatcaagcaggtggctgagcgcatcaacaagggtgtgcggagtgccgaggaggcggagcgccatgcccgtgtgctgcaggagatagaggctcacatcgagggcatggaggatgtgcgtgcgccctgccccaccccaccctaccccaccccacccacatctgtgtccactcggcctctgtgtgcatctgtggccacctggaatcgtggctgtgtccatgtccggaaccacagtgtgtttgcatccatgtctgccagcctctgtggccacacgtctccacctgtctgttcttccacgtctgtctctgaccttgggtcctgtggcctggcagcacaagggcattgagggtgggaagcatgctgcttccattggcctagcccatggagtggggccgagggatcactgggatttttggaggggatagggattaataactggccttcgagatgccttgtccctcctgtcccacagctccaggcccctctgcggcggttcctgagacaggagatggtcattgaagtggtaagaagtgtcccagtatctgtccggctgtccccacctcctcactttgtcctctcttctgctcacaccctctacctgcaggtctccctgctctttcaccccgaggggagccctggtcgagtccccactctgctctgactctctgggaagctggggaagagccctcactctccctgggtctcagtgtccccttgggcactatgggcaggggggtgggcttctggactgtgtccacccagcctgaattctgccttgggctccacagaaggcgatcggtggcaagaaggaccggtctctcttcctgttcacggacctcatcgtctgcaccactctgaagcgaaagtcaggctccctgcggcgcagctccatgagcctgtgagtggctgggccggggtttgggtggtgccaacagggggagcatttgtccctctctgagccccactccccgaccctggccagagcgccccattggctccccacaggtacacggcagccagtgtcattgacacagccagcaagtacaagatgctgtggaagctgccgctggaagacgcagacatcatcaaaggtgggtttgatgctaggggttctgggtgttggggtcttcctctgagaagccctcctggagggtctgagctccagccagtctggctgcctgtccagctgcttttccacttttgggcctcgctctctcatccagtgcaagggggctggcatgaaggacccatttggcacccatggagccagacagtctgtccatgtacacttccttccaactgggcagggacctaggctggcagcgggagctgggtgggggtggtgcacacagagcagcatcactgtaattagccattgattcatctgtgcaaaatcatttgagcgcctaatattagatgatgttgcactgtctggttcagcggtttcacacacagggaacagacactcgcttgagttactgcaagcaaagggttgattggagccatccatgttgttcagggctgagactgttgggagctgaggcagcttccaggagccgctcctcctgcggcgtctgtctttcttcccttcttgctgagtctgccctgttctcactgctgttagctttccctgcttcctcataactcccgtgatcagacccaggctggctcctggctcagctggaggggagctcacctggagcttggccctcagggtaacagacaggtttgctcggccccttggtgaacccaggcctgcccactatgtaggaataccagctgattattactctaattggtccaagtcaatagaatgaccacctttaagttaggtgcccactcctggtccagtcagctgtgagcaagaatggggcagggtcatatggaagaaaacatggctgcccaggtggtgagggttgggatgggacagtttctgtcaaaaggagtagatcggcttcatctcttcaggctgttttaacaaaaataccacagactgggcaatttataaacaagaggaatgtattgctcaccgttgaggaggctgggaaggccaagatgagggtgccagcagaactgcaaggggcctgtgcctcacagagggtgccttctatgtgtcctcacttggcaaacaagctccttcaggcccctttatcggcacaaatctcattcacgatggtttccccctcatgaccaggtcacctcccaaaggtccgcctctttttttttttttttttttttttgagacggagtctcactctgttgccaagctggagtgcagtggcacgatctcggctcactgtaacctctgcctgccgggttcaagcaattcccctgcctcagcctcccaagtagctgggactacaggtgcgcaccactacgcccggttaattttttttttttttgtattttagtagagatggggtttcaccatgttagccaggatggtcttgatctcctgaccttgtgatctgcccacctcggcctcccaaaatgctgggattacaggcgtgagccaacacgtcagccaggtccgcctcttaataccaacacactcaggattcgatttcaacctgtgagtgttgagtggacacaaacattcaggcaacagcagagctgttcccagcctcggcctggcaggaaactccactgccatccaccgggcacacactcttcttcccgtagacacagtgagacagcctccctgtccagcgtgactccatcttacagttacaaagcgtgccctcccctcctcagcaggctgcctctcacccccacggggttcttggtcacagggccacttcagacaggacttgccagtctcaggttccatgtctctagtgctgtcatgacccgtccagggctgccttaccattctgcaacctgtggcccaaatattaaatttatatacaccaataacacattctataaactagattggagaaaaacaggaaaagaaactcatttaggaaaaagcaaaaagacacttcttttcccttgatttcaagacacatgtgtcctggcccaagggtggagggacagctccatgtatggaccactggtccagaatgtgcgtcccaagccttgggttgagggcggcaggccgtctgcaggaccagctgcttggcagtgttcaggtatgggataggaccatagaaatccagggcaccatgcactgccccctcctttgtggggcgatgagtctcttggtcagcacatttgactgcctggggctctgcctgctctgtcagcacgcccacgggaggctgcaacgccgcagcagttccgtgtcagccagggcctgtgtatcgcagagccagccaccatttcatactccatgctctcctgggaattctccgtgggcctgacatcctgcgccacatggctctgaatcaggcctagtccccagctcacagggctggggttcctcagggagctgcctgttaacttttttcccaagagcttggggtttctatgctttcggtttgtcaggtctctccccggcccagctgcaggctatgcagtgagggaaggagagtctgtcccagcctgaccttgtctgtctctgtatcagtccacggccttcctctctccctctaggggcatcccaagccaccaatcgggagaacatccagaaggccatcagccgccttgatgaggacctcaccaccctgggccaaatgagcaagctctctgagagccttggtttcccccaccaggtctgtgccctctgcctgacactggggagccagagggtgggaggcttctgaccctgtctgagagatagacagccctgacatttgcctgagggaagagacatccctttccctcatctgaaggcaaaaatcgcagcctccctgcgtatgggggaagtaacatgttccaggtctgagggtggagacatagctgcatccccatcagagggtgacagaggccccatcccccatatatcaaaggaatccaggtctgagggaggagacagtctcacttgctgtctaaggagagaggcaggtccccacacattaagggcaggtgcaggctctggtgagatgctggggcctgaggcctgggccctcttccccacagagcctggacgatgcactgcgggacctctcagctgccatgcaccgggacctgtcggagaagcaggcgctgtgctacgcgctttccttcccgccaaccaagctggagctgtgcgccactcggcccgagggcaccgactcctacatttttgagttccctcaccctgacgcccgccttggttttgaacaggccttcgatgaggccaagaggaagctgggtaagccaaggcacatgttggccctctcctcctagagcttccaggcaggaggccagaggcatctcacagctgtctgtgacttcaggagccagaaccgcagtgccctgtgctccggctccacctggtggggaggggggcttctgcagtgaaacatcagactgaataatagctgtggcctccctggcagggaggggattccatggatagggtctcactgtctgctggacctgccccatagtgggcaccgatagccaagaccctcgccataccctccctacacacactctgagcagggctggatcagggaaagcgattgatcagggttcatggcttagaagatccacagagacctctgggtctaaccccaagacaatacacatgggaaaagattgaggccaggagcaactgccttattctaatgtggctgggatcaggccttcccctaaagagaccctgaggggcaggggaggaaggggaatggggcaggggcaggaccagggtgagatggatgctatgctaagcagggtccgtctgtctgtccatctccactacagcatccagcaaaagctgtctagaccctgagttcctgaaggccatccccatcatgaaaacccgcagtggcatgcaggtatgtctgcatctgggtcacttgggtacatgttttcaaagccagcaggtgttcatgaatttttgtgtacgacattgtgtatatgccgtgaacattgctattgctccttatgtcttggagaattcagctctctgtacatgtgtgtgggtgctgcatatgtattacatgtacacatgtatatgggtatgcttcgtgcatatctgtatctgtgcatgtgaacaaaggttatatgaatgatgggaagtagcttcatttatgtgcttgtatgaggctgcatacatatgtacagaggttaccagcatcacattttttctatgcatgtatccatgattatatctggggatatgtgtgtgtacatgtaggcatgatgcctgtatcccataggcatgagtgcatttgatgtgtagagggtcacatgggcaaggtgcggtggcttacgtctgtaattccagtactttgtggggccaagttaggaggatcacatgaacctaaaagttcaagaccaggctaggcaagaccctatctctacaaaaaattcaaaaattatccacgtttagtggcgcgcccctgtggtcccagttacttaggaggctgaggtgggaggattgcttgagccctggaggtcaaagctgcagtgagccatgaacccaccactgcaccccagcctgggagacaaagcaagaaccaatccaaaaaaaaaaaaaagggtcctgtgccgcgtgtatgtgtacgcgtgtgtagaagggtgtatagggcatccacacacacacacccatgcaggcctgcctccctccattctgccggggtttcccaggagtggggaatgctggcagcagttcctccattcaccttctcctgtccattggcgcctcctgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccggtgaggcctgggcggcggggtgggcggcaccgcgggcctgggagaaccaacccctgtcccagcacactctcaggccgccccggcgtggttgtgggcggggcccggcgagtgtgggcggggtcggtgggcgtgtccaccaccggggccccgtctggctcgtagctgctgtcatcctcactccgtcttctcgcagggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccgcccagagctggtgccctttgacagtgactctgacgatgagtcttcgcccagcccctcggggacgctgcagagccaggccagccggtccaccatctcctccagctttggcagtgagctttggccatctcctccaacttggccttggcaggcagggtggactgcccagaggagggggagaggagggaccagtgtagggcaaaggcatggcgtcagacctcaggatgttagcacacagagcaatgagggcaggggatgtgacaccaaggatccagaggacagtgggacagtcaggcgggatcatgaagaccctggagcactcagctaaggaagatggggtgctggtggagtggggacccacggtgtggccactgggtctgaggggccaggcaagatcaaggattctgtagtgctgagctgtcggtgagcagggcagcagggcagcagaccggagcaggccggggaagaacagctttgagaggccttccggaggggcatggccaggagggatgcatggcctagaaagatatcaggtcccaggcctggcagagggaaatggagacagagacctttgtctccctcagatgaggagaccccgagttccaaggaggccacggcagagaccaccagctcagaggaggagcaggagccaggcttcctgccactgtctggctcctttgggcctggtggtccctgcggcaccagcccaatggatgggagagcccttcgccgctccagccacggctccttcacccggggcagccttgaggacctgctgagtgtcgaccctgaggcctaccagagctccgtgtggctgggcactgaggatggctggtagggacaggggagggactagggacacagtgccagaactctgagctccctgctctggaaatcatgtggtcccctggagccaaggcaggagggctttgggtcacacctcaggggtactgctgaccagggatgtcagtgggtctgacaatcccagggaggctgtgggacctcagtaccttgggcaggcacccagcattgaagacgtggtgctaggggcaaagaggtggagggatgactccaggggctggtgtgccccaagcatttgtcccaggtgcataccccgatccacagtgtccacgtgtaccagtcctccgacagcatccgtgaccgcaggaacagcatgaagctccagcatgcggcctctgtgacctgcatcttgtaaggccccagggtggcccttcctatctagactcttctcagccacacgtgcaggcctccttctgttcatctggtccccctgctctactgtccctcctctgtgtggaggctggaagccagaggcctggccctaggctagctgtgcctcttacacactgtgtgagctcgggcaagtcacccccttttcttagcctcaggcaacccccacctggagaacaaggggtgggaagaggtggcctctcgggagccatacccattctatctgtggttcccctggtcctgggtgacccactttggctgcctgaactcccttactgcttcctcttttccctacccaggtatctgaataaccaggtgtttgtgtctctggccaatggagagcttgtggtctaccaaagggaagcaggtgagtatctgccctcccccacaccctgcccctgtccccttactggtgttggggctctctcctggagatgtggctttgggcaactcccaggccctctgtgggccttggtttctttgcttataaaaggggaatgttaacatctcatttcaggggagaccgaggctcaaatttagaactggagtgaatttcctgttttctttaccccactccaggccatttctgggacccccagaacttcaaatcagtgaccttgggcacccaggggagccccatcaccaagatggtatctgtgggtgggcggctgtggtgtggctgccagaaccgagtccttgtcctgagccctgacacgctgcagctggaggtagcagggggtgggggaatggaattggtgccatgggatgagctaggtccgtgtgacagggagatggagaccatggtaggggcataagcagcatccagcagagggctagggccttcctctgaccacagagtgacgctggccagtccctgtcctccttcgatcctcatttcttctgtagctgatgaggaatacagtaagtgtcccatatacattaggaatcttattcatcctcctgcccaccctatctctcaactcaggttttagggtcctttggggataggacaagagtcctttctgatgtcaacatccattagcattagactctggcatttattgctgcacatgtcacttgcacacatgtcagaagtatccaggggcaacgggttcccttaatttccctcacttattccattgttggctgggcaggagtccaaagccctgggttcaggccccagctctgtgactgacttgctgtgtgacctttcccttctaggcttcagcttccccacctgtccagggggaggccagtgactgattttagaaccctttaagcattgaagttctctgatccttaaatcactcaagtttaatggggaaaaagcacctccattgtaattcctgagaactaagttgggaggtgctggtgaaaccaagcttcgaaaggttaatcagaccaaggaccaacgctagtgtgagttgtgagggatggacactggtgaagctccaggctagggtgggccaagggaggcaggcctgccaatgacccatcttctcccccgccttccccagcacatgttttacgtgggtcaggattcaagccgctgcgtggcttgcatggtggactccagcctgggtgtgtgggtgacattgaaaggtagtgcccacgtgtgtctctaccatccagacacctttgagcagctggcagaagtagacgtcactcctcccgtgcacaggatgctggcaggtactgacctcaaactaccacagcaccctccttggagcctttctgcccgatcgtagaggcggctgagccagggccagaattcagccccagctgtggtctgtctcccaccccaggctcggatgccatcatccggcagcacaaggctgcctgtctgcgaatcacagcgctgctggtgtgtgaggagctgctgtgggtgggcaccagtgctggtgtcgtcctcaccatgcccacttcgcccggtactgtcagctgcccacgggcaccactcagtcccacaggcctcggccagggacacaccggccacgtccgcttcttggctgcagtccagctgccagatggcttcaacctgctctgcccaaccccaccacctcccccagacacaggtgggtcagtgcatcataccccaagctagggatcatggacatttggtttaggactccccactatcctgccagaagagctttcaagagggaggaaaagtgtcacatagagctggaggtggcatatgtgacaggaaatacaccacggaagtgtccaaatgaaatctaggatagttgtgtgtgtgtgtgtgtgtgtgcgcacctgcatgtgttgtgtgtatataaagttctatccagagaaatgtcatgagagacagggagggaactataacctaagaggtagaatatgtcacaaatagaatatgtatatagaaaatatgtcctgttgtatatatttcctatatgcaccaggaaatagcacaggactagaaatgatatatagggcaggaagtggaatcaggaagtgatgcacagagcaggaaatagaaatagcaacagaaaacaacatagaatggcactagcacagaaaatggactgataattagaaagtgaaacagccgggtgccaggcgcggtggctcacacctgtaatcccagcagtttgggaggatgaggtgggaggatcgcttgagcccaggagttcaggacccagcctgggcaacatggtgagacaccatctctacaaaaaatacaaaaattagccatgtgtggtggcacacacctgtggttccagctgctcaggaggctgagctgaggtgggagactcacttgagcccagggaagtcgaggctgcagtcagcagagattgcaccactgcaccccagcctgggtgacagagtgataccctgtctcaaaaaaataaaaataaaaatatggccgggcgtggtggctgacacctgtaatcccagcactttgagaggttgaagggggtggatcacctgaggtcaggagttcgagaccagcctggccaacatggtgaaaacccatctctactaaaaatacaaaaactagctgggtgtggtggcgggcgcctgtaatcccagctactcgggaggctgaagcaggagaatcacttgaaccagggaggcggaggttgcagtgagccaagagtatgtgccattgcactccagcccaggcaacaagagcaaaattccgtctcaaaaaaaaaagtgaaacagcaggaaatgaggtacatcaggaggccacaaccagaaaagtcttgctttggcaggacaagaaatgatattcccaagaggaagtggctgtggaaatcaggaagcaataaagcctcgggtcaggagttgtctgggttcacagaagacttaagctacctgggaaagggctgttggaagtaggaggcttatttaatgcaaggacgttgcgtgcagtaatcaagagagatagaaagtggcatcttacagggcacttacattgtaaaaagaaaaaaatcagaagtggcgtcaccttgggaaattatgtgactcctgactagagattacagatgggacataagaagtctggctgccaagaagtgggcatttctttctaaataagttcctagctaacagaaagtgggattcccccataggaagtgtgcacatcttccttcctatcttctggggtgtgggaattcaggccccgatgggacagtgaagcctccattcgcccccaagctgacagatcctcccctctgcccccaggccccgagaagctgccatcactggagcaccgggactccccttggcaccgaggccccgcccctgccaggcctaaaatgctggttatcagtggaggtgatggctatgaggacttccgactcagcagtgggggcggcagcagcagtgagactgtgggtcgagacgacagcacaaaccacctcctcctgtggagggtgtgaccctgtctgccgtggcccaggactcgcccgcccacctgccttcagcctgcttgcctctccctagcccacacgcagactttgaccaggagtatccagccaggggcacacatgtgcctgcgtgggctctgccttgtcttcgcggaagcattcctgatggaacacccactggccagccaggccatggcttctcccgaccctctggctgccccggtgcttccagtcatgatcgggtgggggacatgtgggctgaccaggacctctgaccctggagcttctaccaaagacacagctgggtctggaccccacggggctggggagggccatgtgcaatatttggagggttttctggagggcagcaggaaggctggggaattccccatgtacagtatttatgtttctttttagatgtgtaccttcccaagcacttatttatgcagtgacctggtcacctggggtgggggtgatttgaggaaatgacatgaggaaaagaaacctattcctgccctggggaccaccctgggactctaaccaagccttcctggagggacccatgcgcccctgagccccattccattcatacagacacacacgtacgcacactgcatgtccaaggccctaaacattgcccgttgacataaactttccagggccccagcctgatggggctgccctcagtcctctagatcaagatgctgactattagggggcagtgattgccatctggggacctgtcaggctttgtcatttcccagtttgttggtggtgcctttagtggttccctaatttgggaacactgatggggccttggacagggctttctctcaggtaggagaaatgggcccatgatctcctcacagtcgcccccagtccttggccctgcttccctgtgtctcatgcactggcacatatggtcaccttggagggcagacctaggagcccctctgaccactgaatccgtctccacaccccttctgccaagggaagccccttcaggaaggaccccccaaagctgaggggctgaatgtagccttttcaacagagaaggctcccacttgagagcagcctctacctgaccccctggaccacagagagccactctgaccctcagccccctcgcttcttcagctaaaactccaaaggtttggtttcagatggggtttgttttgttctgtttggttttggttttgtttggggtgggtgggtcattgcggtcttagattatgtttctcttgctaccaaacagtcatgtattaactctctttggatgatgaagtttaaagagtcaataaatagaaacaccagatgactgc

SEQ ID NO: 36480 - DNA, 60336 bp, Homo sapiens
gctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgtgagtgagcacagccctggaggggaggagggagacaggggagggctggagaccctggcttcatgattaggatgcttccttccttagaagaaacgttcttgttggcaaaggattttaatgcttcagaactgatgattatccactgaactagcggtgcgaatctcttactcctaatttctgttttataagcagaagtcggatatgttggaggaacacaacatcccacaaaatcaaatagagctactagtagaatgggagctggaaggtgtccttgaagagtccattgtcaagttgactccatcctggtcccacaatacctttgtttttctccacactcattccatcctattgtgaggaggggtaaaaagagagagtgatactttatgtctcctgtcagccacccaaaaagacaaagctaagccattttttgtgggagaataactcattttcaagtccccaaccctatgggcatctcacggcacatggatcatttcaggaggcttgggggtaaatgagtttcccaaagcaaagggagacagggaccaggagtctatgggctgggaaatgtggcttaaagacctgataagcttcaaatttattcccagggaagatgttttttgttgtggttagttggtttttggttttgttttgtttttgcactctccagaggagcctctggagggagcatgccctctttttggtaattaaccctttagcagctggcgaggccgctttgctgggggttgaagatagtcatagaggagggaaaaggggtgacggttttggaagcatctgcccacacctacaatgggcttaagcacaacttgctttctgttttcctgagttggcatggaggaattttttttttgtcactattgcattggtatgtgagttttctttggacaaactagcctccgatgaagtatgactttgtgggatacctttgtccatgggaaagagtgttgcataggaaaattgttcaagtctttgttctagttctcttattcagccacatctcttgtacattatccattacttgtgaattcttgcaagaaaaagatcagtctcaattcttgctttttgttttacttctatggaaactgaggcacagagcttcaaatgacatgcacattctcacagaggaactgagaatgggaacattatcatccaaaatgcctgcggaatgactggctgggtatgaaattgtgttgactgctagtcacagagcatattggtggacacagccctgactcctttagtgtagcaatgggaaagaagggaggaggagggaagggggtgaagcaaagaggagctggaactctgtctctgtccctaccgcccccccccgccccaccacctatgtttaagcctttgccaagaagagggagaaggagggaggaaggagggaagccaggaggctcaggaatttattgtcctgtatgcacaaggtggttgccccagatgcagctatgataatgataaataaaaccaaaacatttacagaaaaagtggtagcacttactgtgagggcccggtaccccaacacagctatcaggaatcatacagaaagaaatgaaatgcagccaaaggctttggcacccttggaaatcgttgactctgctcttccccactcccagtcgcaggctctgggcccatgactgccttgtgtccggtagcttccagtgctcagaaaggtactcctgaggctgaagtcaaacaaagcagtctaatcacaagcaagagtgtgaaggattctcctgttcctggaaatttcactatcatagactttttattcagccagttaataccgtgacaagtgtctcctcccctgcctcacctctctcacccctgccaggtccacacttggttctgcggacagagcccgagtcaagaaatagaagtggtgtgtgtgtttgtgtgtacatccttgatgtaaggagatgcctttaggtccggttttcccttgtggatgtaggctgttctgatcccctcactcttcctcaccctgtccagggacgtacattggcataatggctggctggagttcggggtgcatgctgagcctgggcagaagtcatctctgtaaatctgggtgagaatgaaccctagaaggtggcttctttggcaccattaacaaaatagtgagtgtgtggccaagaacttggatttaagtattagaaaaacctggtttgagtaatggtgtctctgtgtaagtcacaagttacctaatctaagcctcagtttcatcacctacaaaatatggatagtagtacccatctcacagggttgtgaacactaaaagcggtgctgcggtagagcacttagcacagagcttggcgtgtcataaacactcagtcaaggccagctatgaaattattacttcatctgagtcaaggaacccagaaaccggtgaagtgggccgaaagcaaatctctactcctgtccagcccctctcttccctcagtttcctgagggctgtgcaagcctcacctgtcagtttaatgagtggcccgagtaaacaagcaacccctgggtgctcagagtggggaccaccaacaccacagacacagcaccgtgctgggggcaggtggactccaggctgctggcctggctgcagccctcactgacggtggccttcactccatgtgaggaactgaaaagtggtcaaaacagagagtaaagcaagatgagcatttactaagaaacttctacatgccgagcacattcaccttttctttaagccttacgattcttgggagatgtgtatttttattcctattatcttagagaggttgaataaccttcccaaagtcacacagctaattagttgagatcagtgcttcttcctctctgccatactagggtgcaaaaaagacagtaatgtcagtccctgccctgaagaatttgtaatccaattagattccatgcaaaacacacatggatagaaccatcagagagtgctacagagcagagaccacaaattcttatattggctgatataatagtcttctgtcaaatgttcatctccctgcccccatgagtaggaacataactagaaaaactaagtgtggattagggaaagtaaatcctgactagatagtggatgctgttaaggaatttctattaatttcttttaggtgtgataatggcattgcagatatactttttaaaggattcttttcttttagacataaatacataaatatttatgggaaaaatttattggctttgggaattagccttaaaataatctgggtgggggtatatatagatgaaacaagattggccaccagttgacaattgttgaagctgggtgatgggtctacatgggtgttcattatattattttttctacttttgtatgtatgttcgaaaattttcataataaaatttaaaaaaaaaaaagaaagaaagaaaccaacattgggaggttggccttaagacagtcttaaggtctgtcttttccccagaaggacagccccaagatgcatactctggctattgtgcaaagtgagtctaggctgccagagggcccttggcctgcttctccctccagggtctccctccaagggatgggatattccagagatcctcctgattgtttaccatctttttcatgaatattccacccttgcctcttccaggtcaactcctatttgttctgcctgtctcaggtaccacttcctccaggtagtcttccaggactccctcaaggtcaggcaccttgtctgagcgctccaataccagtctgtaccaaagcccttgggacatgacttttgtataatcatctgttttcttgggctgtctcactcaccagcttgtgggacttggagggcaaaatgcaaatgcagggcccagcacacagcaggccttcagcctctgtttgttgagtgaatgttagcaggggattggggagggtagaggtgggacttggaagaattgaccccagcttctctccctccctttaaagggccagacctgtcagccagtgtagctccgccctaatcatccgggaactctccttcagcccaggtagaagacaaagcccctgggcaagctgtagccaacggttcagtgaaactcttgtccttgtctcaggtttcaggaaccggatcccaaccggtcaacttgtgtgtcctctttccttcccaagtgggaaagaaaatctccagcctgcctccccctcccttctccctggtgttagcaggggctggggattagcgcctgtacccagccagggtcagggcagctgagctggtgggggtggaggaaagctctccctagaggtaaactcgagaagcaaacccgaagcaacctactaatagcggctgctgggcctgagccctcctgaccttccactcccactgcctgcacagcctcagcagccccctcccccatcggttctagttcacagctcagtgtccatggtatctctacggggccgggaaggcccgaggccggcggcctaaccctcagaatgccctttgcagagggttgggacctatcaggagtgcactgagcagcacggctcaatgcttaaggagattaaccccaactggtacacacccaaaatagccctggaggctagggtgaagagggcagaagaggtgacgggggcctgttgacccagggaggcaaaagcaggcaccggagagggttagactgttaaaatctcgccctgaaatttgaaactgcctccatccagagtttgaaaaagcaactgcttgtttcttaaactaggtggtacaatccacaggtgtttgttttaaatattgttattatacgttttcttctgtatgtatataatatttaaagaattttgagggcaggtgtgatggctaatacctgtaatctcagcactttgggaggctgagacaggaggatcacttgagttcaggagctcgagactagcctgggcaacatagcaagaccccatctctaaaaaattaaaaattaaattaaaaaaaaagaattttaccagcctggccaacatggggaaaccccatctctactaataatacaaaaaaaaaaatggccaggcacggtggctcacacctgtaatcccagcactttgggaggccaaggcgggtggatcacctgaggctgggagttcaagaccagcctgaccaacatggagaaaccccttctctattaaaatacaaaattagccaggcatagcggcacatgtctgtaatcccagctactagggaggctgaggcaggaggattgcttgaacccgggaggcggaggttacggtgcgccgagatcgtgccattgcactccagcctgggcaacaagagcagaattccgtctcaaaaaaaaaaaaaaaaatgctgggcgtggtggtgcatgcctgtagtccagctacttgggaggctgaggcaggagaatcacttgacccgggaggcggaggttgcagtgagctgagatcgagccactgctctccagcctggctgacagagcaagactccatctcaaaaaaaaaaaaaaaagactttgagcaagtgaggcattagtgcctgctcccaccctcagtgctgccctctgggtgcctgccttctccttactgggacagtaggtataagagcttggttaggccgggtgccgtggttcatgcctgtaatcccagtgcttggggaggccgaggcgggtggatcacgagatcaagagatcgagaccagcctggccaacatggtaaaaccccatctctactaaaaatacaaaaattaactgggtgtggtggcgcatgcctgtagtcccagctgctcgggaggctgaggcaggagaatcccttgaacccaggagatggaggttgcagtgagccgagatcgtgccgctgtactccagcctggcaacagagcaagactccatctcaaaaaaaaaaaaaaaaaaaaaagagcttggctggatggaaaatgcaagagggaggcaggacagatggacaggaccaaggagcacttgtaaaataagatggctcaccagtgagagcgggatatagatggttaagaggtggggtctgagtcccactaaccaaggggaggttgctcccagcatcagagaaggctggaggcttcagggattctgggagcttcatggtccccaggctgggacaagaaggtgaggacaaagccccggtcttatctgtctatcctccttcagtctctctttctctcccccaggagactttagagtatctttgtcagaccgtgtcagcatatctacagctgggcccagagtgtgcagagcctgaatgaagcacaccaagagataggcagtctacacacatgtgtatacacacacacacacacacacacacacagcaggagcagaggaacaacacacagcgccatgcatgggggacaggagtggcgacgctaatatttacatgcctgccaagttggataaacaggaatatcctgagccatagaatgcaggcctttccagatcaggcccttccttatttattggaccacttttgtttaaccagcaaaagagcagtggtctccattcggttcatcagttctcccaatggcttgttagtgtctgggcagtgcggtgagacagaaagcccaggggtgtctggaatcagataggtccaggtttgaattctgctcctgccccttactgatccagtgacttggaataagttacccaaggaagaaagaacattaacttgattgagtgccttctggagccaaaggctttatcgatgctatctcattaacatagcttcttgaggcccaattacttcacctgtcaagtggggatgataaaatcatccttgaagggttatagtgaagattaaataggatgaggcattgaaagtgtttggcacatcacgagagaccttctttcctcactctaaactcttcagagtttgtacctgtatatctgccaaatcaacattattttatctctcacgaaattaaaaaaaaaaaaaaccatcagtgagtgtgaaggaatgatgaagagagaggggaaggggaggaaggaaagcagggaggcagggcttatgtaattactcgctgcctggccccagcagcctgatttctttgagcctctgcctaatttattttatgtcacaggctcaggggcccaaactgagttgctgggttggaaaaagacagagtgaaaggagattaggagaagattttgaggtggattctccttgtctgcaggcttccaccccagcacaagctcagaaaagccaaggctgctttgggagaacttggcttcagctgtccctggggcccactgcagaaagaacaagccgggttgtcgggatgctgtttacaaacagctaggaatagaagcacctcctgttcccacacccttccaccaccctttcatggacagcccacaggctccttctgattgttacttcaataggccttcctttgagatcaagccggcagggctggcaggacccctgtccctgagactggcaggtgaaaggtgctacatcctcaggcagaaattcccagggaagctctgagtgcagactatatgagtctagtggttagaatagtctcctcaggggccagctagacctgggtgcagatccagctctgctggttgctggctgaatgacccaaacaagtgacttcacgtcttggagcctgagtttcctcacctataaaatggaaattacggccgggcgcggtgtctcatgcctgtaatcccagcactttgggaggccgaggcgggcagatcacctgaggtggggagtttgagaccagcctgactaccatagagaaaccccgtctctactaaaaatacaaaattagccgggcgtggtggcacgtgcctgtaatcccagctactcgggaggctgaggcaggagaattgcctgaacccaggaggcagaggttgtggtgagctgagatggtgccattgcactccagcctcggcaacaagagcgaaactccatctcaaaaaaaaaaaaaaaggaaattacaatgcttagtcataggatagttatgaggtttcagcaaaataatccacataaagcactaagcagagtgctgggttggaaacctagtagtaaaggcccatgaacattagtttcctcccttcccttcactcctatccgctcctcccattcccattctcttcattcgttttatacacagaattcatgaatcatgctttatgtttacaaggagggaggaggactccattaaatcattaatttgccagctctttaatgagttcctattatgtactttctaaatgccaggatagagtagtgaacaagagagacaaggttcttgccctcatagaggttacagtctatgtttgtttgtttgtttttgagacaggatctcactctgttccccaggatggagtgcagtagcatgatcttggctcactgcaacttccatctcatgggctcaagcaatcctcccgcctcagcccccagagtagctgggactacagttgtgcaccaccatgcccagctaatttttttgtatttttagtagagatggggtttcaccatgttgcccaggctggtgtcgaactcctgggctcaaatgatctgcccacctcaatctcccaaagtgctgagattacgggcatgagccactgtgttttttgtttttttgtttttgtttttttttgtttgtttgtttgagacaggatcttactctgttgcccaggctggagtagagtagtgcaatctcagttcattgcagcttcaaactcctgagctcaagggatcctcctgcctcagcctcccaagtagttaggactacaggtgtgtcccaccgcgcccagataatttttaaattatttgtagatactggggtctccctatgttgccaaggctggtcttgaactcctgggctcaagtgagcctcctgccttggcctcccaagtgctgggatacgggcatgagccaccacacctggccaaggttacattttaatgggtgagacagacaatatatatatttccatatgcagatcatatgtagcatgcatacacataacatgtaacatatgacatatatcttctaaaaaagagtaatgtcagttaagggaagagtatatgacatatcaatgggagaccacttccaacaaagtagtcagggtcttcactaccaaaagaggtgacatttgagcagattctttttttttgagacagagtctcactctgttgcccagtctggaatgcagtggcgcaatcttggctcactgcaacctctgcctcccagattcaagcaattctcctgcctcagcctcccgagtaggtgggattacaggtgtctgccaccacacccagctaatttttttgtatttttcagcagggagggggtttcaccatgttggccaggctggtctcgaactcctgactttgagtgatccaccagcctcggtctcccaaagtgttgggattacaggtgtgagccaccacaactggcccatttgagcagattctaaatggaccgaaggagctagccttgggaagatgtggggaaaagctttccaagcagagggaacatcaaagacacaggccctggggtgggggcagggttagcatgtcagaggaaaagccaggccccaaaactagagcaggaggagtggggaaggagcctggaggagacgaggccttggaagtaagcagggttccgatcatgtggggacttttagggcagcagagtttgactttttattctaagtgccatgactttttattctaagtcattggagtgttttgagtaggggagagatgtgatctaatttatgcctttaaaaggctcattcttccagctttcagataaacagactgtaggggggcaagagtgcagaaatgagaccagttagaagggtgtttctgtctctcaggtgagagctcaaagatggtttgatgagaaatggaaactggctgatgcactgggggaaagagaagagtcggggtgatcagtactgcctaagctattgggtgaatttgatgtcttttttttttttttttttttttttgagacaaggtctggagtgcaatggtgtgatctcggctcactgcaacctccgcctcctgggttcaagtgattctcctgcctcagcctcctgagtagccaggattacaggcgcctgccaccacgcccggctaattttttgtattttcagtagagacaggggtttcaccatgttggccaggatggtctcgaactcatgacctcaggcaatctgcccacctcggcctcccaaagtcctgggattggccaggtgtggtggctcatgcctgtaatcccagcactttgggaagctgaggcgggcagatcacttgagatcaggagttcaagaccagcctggccaacatggtgaaaccctgtctctactaaaaatacaaaaattagctgggcgtggtggtgggcacctgtaatcccaggtactcgggaggctgaggcaggagaatcgcttgaacccaggaggtggaggttgcagtgagccaagatcatgccactgcactccagcctgggtgacagagtgagactgtcaaaaataaataaataaatgaataaataaataaataaaactaaagtgctgggattacaggtgtacaggtgtgaactaccatgaccggccaaatttgatgtcctttactgccatgggaaacagcagagaaggagtggttttgggaggtgaagaattctgatttgaacaagttaagtttgttgtgcttagtagacccccaaggggaaatgttgggttgacaggggttgcactccagatcttgtctcaaaaaaaaaaaaaaaaggacatcaaattcaccaaatagcttaggcagtacggatcaccccgactcttccctttcccccaatgcgtcagccagtttccatttctcatcaaaccatctttgagctctcacctgagagacagaaacacccttctaactggtctcatttctgcactcttgccctcctacagtctgtttatctgaaagctggaagaatgagccttttaaaggcataaattagatcacatctctcccctactcaaagtctggggctcagtgggaagaggggatgggagattaaatttgggattcatcagtctgtggatgctactgaaagccatgagcctagaagagatcacttagggaataaatgtgaatggaggagagcagagggctgaggccccagcccttcattatacctacatttaggtgttggcagaggagaaggagccaatgaagagactgagaggtagaggaaattcagagtggtttcaccaaatcaggtgagaaaggatttccagaaggagagagtactgtaccacatccattcttgctgagaggtttaataaggtgagacagagaatcaatcacagtaattggtaagatggaagccattggaaccttggcaagaatgatttcactgtggtgaatagtggactcaaaagagagaatatggataaggattggagatggagcatctagataagtctcgtttttcctcagttttgttctaatgggaagcagaatagtagggtggcagctggagataaatgtggaatcagggaggatatttttgaaagacaaggaatattatagcatggctgatggggataattcagtagacagggagactgataacaccagtgaagggggcaaaaagggatagaatgcagtcgaggggtcacatctcagcagcaggtaatcacttaggagagaaggcagcagagatgggccaagatacagccaggttgataagtgtggtgatgggaggttgaggtttgcctcatacgtgcaatgtgctgctctggaaggacagcactggcagccataggctggtctgaagggaggagaaaccaaggaggctatgacaatagtcagaggttaagcctcaggtcacaagaaaaatgctcagtgctccccggatgagggcagagaaaacatgaaagtacttccggacatgaaatctggcatgagaacagtcaacagacaacagccagctgccagagctgcttgaaaatccagtagattttcacctccagtgcatcgatcttctgtcccttaagtcacccatgcccaaggagaaggagggagcacactggtcccttcccagcatatgactgacagctggcgtggtgggacaagcactggacttgcaagccaaaccagggggacctggggctaattcccaacttggctatttatcagctgggtggtctcagacaagcatttaatatttctaagcttcactctattttatttttattctttattgccttgtccatatttcatttttacttgacaataatgtttttataacatttttattggaatataaaatatttacagaaatgtgcacaaaagtgtggagtttcatgaattatcacaaaatgaacaagaaactgaatgttgtcagcaccacagcattgtccctgcccaagcttcctctccaaagatagcccctatcctgatttctaatcccctaggttagtcttgccatatatatatatatatatatatatatataatgtatgtatatgtgtacatatataatatatatatgtattatatatatatgtattatatatatagagagagagagagagaaaggctcatggagtgtgtattttttgtatctggcttctttcactcaactttatgtttgtgacatgcaaccatgttgttgtctatagcatttttttttttttgagacagagttttgctcctgttgcccaggctggagtgcaatgacgagatcttggctcactgcaacctccaccttccgggttcacgcgattctcctgcctcagcctccaaagtagctgtgattacaggcgtccaccaccaagcctggctaatttttgtatttttagtagagatggggtttcaccacgttggccaggctggtcctgaactcctgacttcaggtgttccactcgcctcagcctcccaaagtgctgggattacaagcgtgagccaccacaccatctgtagcatttttaaaccttcattgctatgcagcattttactatgtgaatataccacagtttatttattcatttcactgttaatggacatttgggttgtttccagtctgggactattacaaacaatgctgttatgaacattttcggacatttttagtgcacttctgacttcatttctgttgggtatgtacctaagaatggaatttctgcgtcgtagagaatgcatagtgaactttaatttcttcttctgtcaataaggatgataccacctaatttgaaggtctccatgaggaaaagatacaaaaatttgaaggtttaacatagtgctttgcaaacagtaggcactaagttaagtgatagtcattaacatcatttctttctttttgttttttctttttgagacaaggtctttgtcgcccaggccagggtgcagtggtgcaatcttggctcactgcaacctctgcctcctgggctcaagtgatccttccacctcagcctcctgactacaggtgtgcaccaccatacctggctaatttttttattttgagtagagacagggttttgccatgttgcccaggctggtcttgaactcctaggctcaagcgatccaccagcctcaacctcccaaagtgctgggattacaggcctgaaccaccactcccggcccatcgtttctaatggagtacatctttgagagcaactagatgctgtataaccttttcagcgtgttctgcctcctgtcctcctgaccctctctatcgagatttggacacttcactaaagcccaggtcagattcctctacctcaggattcatctgttccaaagatgatgacttagaggcatatcccatttcatggcctcttctcattcctagccttacctactctcagtatggactgacttctcttccactcaattttcaggctttacttgtaattttcctctttaacttatatgttactatggttattgtgaacattatcctcaattctcatgctcagtcctccccaaccttccatcacccctagcctgaatgaaagtaaccatttagcaattctattgtgcatccaagctactgaacatacccagcagcctcagatagcactatattggtgcctctgtggattaaaaccctataacctcagccaagccctcaaagctgcccagaaaacatctacactccttcttctcactcctctgggacactattctaaaaattagtttgtttttttttgatacagggtctggccctgtcacccaggttggagtgcagtggcatgattatggctcactgcaaccttgcctcctgagctcaagtgatcatcccacctcagcctcccaaagtgctgggattacaggcatgtcccaccgtgcccagccagcctttctttacaaactctcttgtcccatctctcttttcaccctcaacagatgatctagcctcatatttcgtggagacacttgaagccatcagatgaaaatgtcttcaaatttctcttctgtcacctgaaaacttgtaagcatccatgtatgcaagttttcgcctttctctccctttttatatgcaagctttctctccctttttttttttttttttttgacagagtctcattatgtcgcccaggctggagtgcagtggcaccatctcagctcactgcaacctcctctgcttcctggggtcaagcgattctcatgcctcagcctcctgagtagctgggattacaggcacgcaccgccacgcccagctaatttttgtatttttagtagagacgaggtttcgccatgttggccaggccggtctcgaactcttgccctcaagtgatccatctgtcttggcctcccgaagtgttggaattacaggcgtgagccaccgaacccggccttccgtttctcttttatcccatggaaaggatatccctcttctgtcccagactattacccaaacccactttttagaatcttttctctcctgcctccacacgacctttgctcctttaaacatctctctctctcttcaacattcccttttactggctctttctccccaattcccacattctctcctttccgtcttagctaagctgtaggaaatggcatccatgctcactatcaccctggacgtctctgcccccgcactgcacagacatcagccttgatgaggtaactggggacctccttgttgctttatctgaacacaccttttagtctttattctatttgtttactttgtggaatttaaccactctgtcattcttttaaacactcatttccctcggtgccaatacagcacattctccttgttttcctttcatctctctagctgttccttcttaatctcctctgtgagcagctcatactctattgcctaaatatgattgtttagggctctgcccttcctatgcagtcttcatggctaccttcatccaaccccatggattcagttatccccgtatgctctctttctatctctggcctagatctctattttgagttctagatcattcagttgtctcttggacacctcaagtgtctcaaattcaactggtctgcaaataaattaatcatcgtcaccccaccccacccctaaacctgtttttcctcctgtgttctgcactttgatgaatagaagtaccatttaatcagacacctacatcataaccctgggctgtcctgctccaatccctctcccagtgtctccagactttcctagtgataggatcctgttgtttctgcctctatgatctctctgaactctgcccctcctcgcaattcaacttctattactcccatgcatatcacttatcaactagaagaacgtcacagcctcctaactgatctcccaacctctcttctcgtgccattggaatccatcctccccacagttgaccttccctgtgtaaaagccttcaattactcagtgtagcttccgtgatcaaattcacacttcttagcatggcttagaaagctgctgatgttccagtgccttcctatttctcaagctacgaatactcttctccttgactctcaccctacagttgtacttgaccattggttctccagagcgccaggctttatcttgcttcctctgtgcctttgaacatattgtcgcctccaactgggatgccaagcctagccaaccctcattcctctttcaaggctcaactcaggtgacactttctctagaggctttccggacccccccagcctaagttgtgtgctccacctctgtgttcacaaagcacctcctgcaagttctggcacctcctgttccattcgcatgtaacacatcatttcagcattgtctgtttctgtgcttttcccaaacttcttaagggtgagggctgactcttattcatcttcatgtccccagcagtgaacacagtccctggcttaatggatgcctgttgaatgaatgaaggatgaggaatttacaaaggcagttctatcatacttgattgaatctacaaaatttgtaattcatctatacccttctgagactatttgaaaatatgattttgtatccaacttctcaaatgaagaaagatttggcagtgatccttttttatcctctttttaaaaataaccaattaaatcagtctaaaatttacactctgaggtctgaattgttgggatagatcactgccatatttccccttcagtttaaacttgttccactttttcttcatttccttgcaattctgtcttccagctctgtagtaacctgagattacagactaacatattaattccacttgccaggcgtggtggctcatgcctgtaatcccagcactttggtatgccgagtcaggtgaatcacctgcagtcagaagtttgagaccagcctgatctactaaaaatacaaaaattagctgggcgtggtggtggacgcctgtaatcccagttacttgggaggctgaggcaggagaatcacttgaacccaggaggcagaggttgcagtgagccaagatcacgccactgcactccagcatgggcaacagagccagactccgtctctaaataaataaataaataaataaataaacaaataaataaagtccacctatgatccctggggccacagatagaccctaaagaaaatattaattatatttttgcaggccgggtgtggtggctcatgcctgcaatcccagcactttgggaggccaaggtgggcggatcacttgaggtcaggagttcaagacaagcttggacaacatggcaaaaccccgtctctactaaaaacacaaaaaagttagccaggcatagtggcacacacctgtaatcccagctattcaggaggctgaggcatgagaattgtttgaacccgggaggcagaggtagcagtgagccgagatcacgccactgtactccagcctgggcaacagagggagactctgtctcaataatagtaataatatttttgctgataatttgctctatatgcacccagataaggcctttagctcccatcatctggattcttccataaaatatctggagaagttcagcagcattgcctctagatctaggaaaagtaatacagctctcctagagaacttgctataagcagatttccctttggatcacacacacaagagcaggagagggagtggccctcttcacagcactcacagagcccacccctttgggaggcccagtgcttgggtatgtggctatgatggcctggaagttatctggatataccaattctgcagctgggtcgacacagacttgcctttctgacgcccaagtagtgaggctggagcaaaggaggagcagagctgggattaggtccttgtaggcaactgatcagcttttctcagccaggcttctgtaagagaattaagcgctggaaaaaatgaattgagagactatatcctcaattcccccgtcttagtccattttgtgctgctataaaaaaatactacagactgtgtgatttataatgaagagaagtacattttgctcatggttttgaaggctgggaagtccaagatcaagggcctgtatctggtgaggaccttattgctgcattatccaatccatggcagtaggcagaaggacaagtgagggccaaagagagccaggaagttgaaattgtccttttataacaaacccacttccatgataatggcattaatccattcatgagagcagtgcccccatgacccaaaccctttccattaggccccagctcccaacatcactgcactggggattgagtttccaatgtatgaactttggaggacacattccaaacacagcactcccaaagattctagctggtcccattctgaattcatagggaagaaattaactctatataatggatgccttagggcagtaagggcttaaattgtcttctgaaattccagttgtcaagggctgacattgcgccattttgcttacactgagtttcctcaaggtggatcatctcacctaccccaatggcagcatctcttccacttgctacttagtgataacccacttgtcccatgtcctcaacttcactgaaaagtataacaaattcttctttttttttttttgttttttttgtttgtttgttttttgagatggagtctagccctgtcaccaggctggagtgcagtggcgtgatcttggctcactgcaacctctgccttctgggttcaagcgattctcctgcctcagcctcctgagtagctgggattacaggcacacgccaccacacccggctaatttttgtatttttagtagagatggggttacaccatgttggccaggatggtctcaatctcctgacctcgtgatcctcccacctcggcctcccaaagtgccgggattacaggcgtgagccaagtataataatttttaaatcaccaagaaaatatctaataatgatcccagagtactaaagactcaagtgttccagtggtcaaagttctttcaggttgggaggcttttggttttacttccagtctctgtaatctttgccttaaaagcaggagaagggggtgatacaaagaacacagacatgatatttctaaatttgttttatttgaagaaaagtatgcttataatgtaataaggctcatcatagacagtatgcaaaacgtgggaaaaaaaggaaaatagccaataattctttgtcttagctaaagatatcagccattgtcaattttcttgtttgtttgtttttgagacaaggtcttgctctgttgcccaggctggggtgcagtggtgcaatctcagcttactgctcccacgtgccaccactcccagctaatttttttgtattttttgtagagacagggatttgccatgatgtccaggctagtctcaaactcctggactcaagcaatcctccctcctcagcctcccaaagtgctgggattacagttgtgagctacggctccctgcttcagttttttctgagtgtataattctgtatgtatttttctttttgtagttgagatcatttaatgcacagccacatattcacataaattgtgttccctaccttatttatttatatttttgcttatcatattataattgcttttcccatgtcactaaaattcttcctaaacattgttttcagtggatgtcatcatagtctattgtatggctgtgttgaaccatttgcctatatttggacatttacatggctcccaataaatacactttccaaggccctaaacagatccccagagcctcagcacgggctccttctcttggcctttggcgcccatccccagagagatggagtcagccaaacaagatgataaacagaacagttaacacactgcttccccagctgagccttatgggctgatgggtgaaacaaagcccctaaaagagaaaaaagactcactgggcactggaaacgcagagacttatggtcagctcacagcacagacactccatagcccagagaaacataaggccacacatgttattcttttagaggatcaagttcctaatattggaccatctgccaagcagagcaaagccccacctccctctcgctttgactccctgtggggaaatgtgtcggtttgtatgcagtatagatagagcacatatgcctggtttttcttcctttggggaggaaaaaaatgttactacctaaaaagaaaactggctgggtgtggtggctcacacttgtaattccaacactttgggaggctgagatgggaggcctgcttgagcccaggagttcgagaccagcctgggcaacacagggagaccccgccccccagtctctccaaaagaatttaaaaattagccaggaatggtggtgcacgcctgtggttccagctacttgggaaactgaggtgggaggatcacttgagcctgggaggttgaggctgcagttagccatgatcacaccactgcactccagcctgggcacaaaggaagaccctgtctcaaaaaaatttaaaaaattaaaaatagaaaagagaaagagattgaaaaaaaaaaaaacaagcctccagccttgaaaaatttcaggtcttgggtggatgtcaagaagagaaggtcaactggttcatcctcctgcttctacagggccctaccctaaaaacattccacaccaataccaaaccataaccaaatggtcatgcaaagtaattttccccttccaagaaaaatggaaagtgtcttactcccagaagcttgtaggtaagtacttagttgctgtcttagaacatcacacaatatgccccagctcatccatgcgcaataaaagcagaacctaatgccttgggtctgaagatttatgggcttccacatacgttatctcttttgatccttgcttcagccttataaggtagacaggggaggtaaattttaatctacttgacaggtgaagaatctgaggcttagagaggtcaccagctggtggccaaggaagatctttttttttttcttttttttttgagctggagttttgctcttgtagcccaggctggagtacagtggcacaatctcagctcactgcaacctctgcctcctgggttcaagcaattctcctgcctgagcctcatgagctgggcttacaggtgggcgccaccatgctggctaatttttgcatttttagtagagacagcgtttcactatgtcggccatggctggccttgaactcctgacctcaaatgatctgcccgcctcagcctcccaaagtgctgggactacaggtatgagccaccacgctcagccggaatatcttgaactcttttctttgtctctctcttttttctttttccagagatagggtcttgctctgtcacacacactagagtgcaatggtgcagtcataactcactgcagccttgaactcctggcttcatcctccggcctcagcctcccaagtagctacgactgcaggcacatgccactatgactggctatttctttcttttctttctttctttctttctttctttctttctttctttctttctttctttctttctttctttcttttttttctttctttctctctttctttctttattcttcctttctttcttctttcttttccttccttccttccctccctccctccttccttccttccttccctccctccctccttccttgcttccttccttccttccttcccttcctccctccttccttgcttccttccctccctccctccttccttgcttccttccttccttccttccctccctccctccttccttgcttccttccttccttcccttcctccctccttccttgcttccttccttccttccttccttccctccctccctccctctctccctccctccttcccttgctttctttttttttttttttgagacagagtcttgctctgtcacccaggctggagtgcagtggcgctatctcggctcactgcaagctccgcctcccgggttcacgccattctcctgcctcagcctgctgagtagctgggactataggtgcccgccaccgctcccggctaattttttttttttttggtattttattagagatggggtttcaccgtgttagccaggatggtcttgatctcctgacctcgtgatctgcccgcctcggcctcccaaagtgctgggattacaggcgtgagccactgtgcccagcctctctctttcttttctttttctttcttttctctttctttcttttctttttctttcttttctttcctttttctttttctttcctttctttccttttctttctttctctctctctctctctctctctccctccctctctctctctctctctctttttcttctttcttgttgagacagcatcacactcccggtcacccaggctagaatacagtggcacgatcacagctcaaggcgacctcgacttctaggcctcatatgattctcccacttcagcctcctgagtaactgggactacaggcgtgcatcaccacattcagctaacgttttgtatttttagtagagatggggttttgccatgttgcccaggctagtctcgaactcctgaactcaagcaatctgccccccgttggcctctcaaagtgctgggattacaggcatgagacactgtgcccggctacaattaaaaacaatttttttttcaatagacagggtctcactatgttgtccaggctgatctcaaactcctggtctcaagggatcctcctgcctcagactcctgagtagctgggattacagacttgagccactgtgctggctctgaacactttcttttgacctcaagttgcaacaaactgtgcataacttaatagaaaaaataatctgtccctccagccttctttttgggcctccatctgaatgggagatgcatctctttgttcagcagttatgaagcatccactgtgtgtcaaattccaggatgggtgttgctcagtcttggtggccctttcagcagcagctttcctgtcaccgtgctgcactctggaaaccctctgcactctgagatgggtactggccatgctccagcgctgccctctgggagaccctggggaagggctgtcaagagtcactcctggcctggcgcagtggctcacgcctgtaatcccagcactttgggaggccgagacgggtggatcacctgaggtcaagagtttgacaccagcctggccaacatggtgaaaccctatctctactaaaaatacaaacgttagccgggcatggtggtgcgcacctgtaatcccagctactcgtgaggctgaggcaggagaattacttgaacccaggaagcgaaggttgcagtgagccgagatcgtgccactgcactccagcctgggtgacagagtgagactccatctcaaaaaaaaaattcactcctttaaaatacccaatgcagtgtttttagaaaaaaagcagtattcagtatattcggcaaatatactgaatataatagtgtattatatatattatattatatataacaatattatattcagtatattcagtgtgaatatatattcagtatattcacaaagttgtacaacaccactacctgattccagaatattttcatcagtcccaaaagaaaccccacagctatcatcagtgacccttcatttctcctcccaccagccactggcaaccgctaatccattttctgtctctacagatttgcctattctggacattttgtgtacatggaatcgtaaaatatgtggtctttcagatctggcttctttcagttatgttttcaaggttcatccatgatagagcatggtactttattccttttaatggctgaatattataccattttaatgaggtatgacattttgctgagtcattcttcagttaatagactttgggtgctttccatttgggggctaataggagtaatgctgctgtgaacatttgtgtggaagctttttgtggacatatattttcaattctcttgggtctgtattgaggcatgcaattgctgggtcatgtggcaactctatgtttaactttttgaggaactgccagactgttttcccaagtggttgcactatttatatcttaccagcaacatacaaggggtccaatttctccacatccttgtccacacttattattgtctgtctttttgattatagacacccaataggtgtgaagtatatctcatcacggttttgccaatctcaaagggcatggattttgtttcattaaataatgtggtgattttctttttctttttttttttgagatggaatctcactctgtcgcccaggctggagtgcactggcatgatctcagctcactgcaagctctgcctcccgggttcacgccattctcctgcctcagcctcccgagcagctgggactacaggcgcccaccaccacgcctggctaattttttgtatttttagtagagatggggtttcactgtgttagccaggatggtctcgatctcctgacctcgtgatccgcccgcctcagcctcccaaagtgctgggattataggcatgagccactgcatccggccataatgcggtgattttcttgacctattctgtaagtccctttcctcttcctgataactcacttttcagagtcaccatatttactcccgtggttttcattgctacgtatacaccaatgactcccaaacctacctgtcaagcctagatctcctttctgagccccagatctttttttttttttttttttttttttgagatggagtctcactctgtcgcccaggctggagggcagtggtgcaatctcagctcactgcaacctccacctcctggggtcaagcagttctccaacctcagcctcacgagtagctgggactgcaggctcgcaccaccatgcccagctaatttttgtatttttagtagagatggggtttcactatgctggccaggctagcctcgaactcctgacctcgtgatctgcccgcctcagcctcccaaagtgctgggattacaggtgtgagccactgcgcccagcccagatctttattaatgccaacctgttaggcatttaaattttgtcatggccaaaacagttgatcatctcaagtgccaccctcatctccccgctccatattccccgccatggttataagcatcactctctaaccaggcaaccaaactggaaatcagggagtcatcctccacttctcctcggcattgtccacttcactgaatcttattaactgtaccctagaaatgtccatggaatgcatctccactcctctgtgttcactgctcagcctggtccaagatctcatcatttcctttctttttttctcttctttcttacttttttatttatttatttatttttatttttagaaacagggtcacactatgttgcccaggctggtctcaaactcctgggctcaagcaagcctcctgccttggcttcccaaagtgctgagattacaggcgtgagccaccgcgcccagcctcccaccccctattctatattcgctgggtcctgcactgtgtagaggccacttggcctccttgatttaatggcttgacatccttgtttgctccctgtcttcccagtaggtcttggcttttctttctcccttccagtagaatatccagacccacctcctaattgtccttgagcttaaagactcagcttactcctcagctatttctcaactatgattgacttcctcagcaagcaagtggaattctggtctctgtggccttggcataggaaaaaccggtgtctccaagggcctcagctgctaaaagggagctgcatttaggagttgtattgaccctgtagcatgatgtctttccagaacaattcacaaggcctgggaaagtatgtcattttactggggtagtaatccccagtcagagagtcaatggtgggtgggaggctgaggcgggcggatcgtctgaggtcaggagttcaagaccagcctggccaacatggagaaaccctgtctctgctaaaaatacaaaaattaaccaggcgtggtggtgggtgcctgtaatcccagctacttgggaggctgaggcaggagaatcacttgaaccccggaggttgaggttgcagtgagccaagatcatgccattgcaccccagctgcctgggtgacaagaacaaaacttggtctcaaaaaaaaaaaaaaaaaaaaaaaaaaaagagagagagccagtggcgggtggagatggcattgaagccaatatattccttctactctttgaagtcctgggctcttctggagactttaggaagacactgaaaaaggctgcttacaatagtttagtggccaggatggagagatgtggactggaaggtgatgcaggtggatgctgattggtggctccctggaggcctgtagtaggataccagagagttctgccctggagtctgccctggttagtggacaaaaagatccagaaggcacatgtaccacactggcagattatctgaagctgagagtcacagtgagcttttaaacagcagaaccaggatttagaaaattctagtcaggctggaatggcaggcttagtctaacagatgaacttttctagcccacagaaaagcagcctcagggagaggacccaatacctacagagcactcacatagaagagaaggggtcaccttgctttatacagtccctgggaataacaggaccaaatgggctttctgacacagagtcaggttaaaaaagaagaaaaggggccaggcgtggtggctcatgcctgtaatcccagcactttgggaggccaaggcaggcagatcacctgaggtcaggagtttgagaccagcctggccaacatggtgaaaccccgtctctactaaaaatacaaaatcagccgggcatggtggtgggcacctgtaatcccagctacttgggaggctgaggcaggaaaattgcttgaacccaggaggcggaggttgcagtgagtaccactgcactccagcctgggtgaaggactgaggctctgaccccccaaaaaaaaaaaagtttctgtcttttagagatacacactgaggccaggcatggtggctcacacctgtaatcccagcaaaagtgaggccaaggcgggaggattgcttgaggccaggagtttgagaccagcctgagcaacatagcaagaccccagatctacaaaaataaaagttagccaggcatggtggcacatgcctgtagtcctagatactcggaaagctgaggcaggaggatcacttgagcccaggagtttgaggttatagtgagctatgatcataccactacactccagcctgggtgacagagtgagaccctgtccctaaaaaagaaatagagtacacactgaaatatgtatgcatgaaatgatacacctggaatttgctttcaaataatgtgagattgtgacaaaaatgggtgggcatcagatgaaacaagattggccatatgtagagaatcgctgaagctgggcaatgggtaccttgaggttcattgtgctgttctctctagtttgttgtacagtcgaacttttccacatataaagttaaaaagaaggaggaggaacaaaagaagaagtgttagccaggcagagaagaaagcgagaggacatcctgtgtggcaggagcagcatgcataggcaacaagacccaagagagcccagcatggggtagggcagcaagacccaagagagcccagcgtggctgttcctcactgtaaccagagtgcaggcaggaaggggagggcgcacagaggcaggcacaggccaggtcacggagggctttgttgccatgctacaaagtctgcacttcatcctgaaagcatgggagccatggatcagaatcacattttgaaaggtctttctggagacagagtgcactcaaagagaaggaagacaggaggcagggggttcagtggggaggcaagagatgatggaggccgcaaacacagcaatggtgaggggatgtgaggaagctaatctcagctatgttaggaaggtgggatgaagggaacgtggtgagggaaaaaggaagcgtcaaggctgatgtcccagtgtctgtggggtgggagagccattcctgaagagggagaaggcgggaagacagagagctgcaccatccctgatccctggcctcttaggcctaggactggctacagaatttgcagggcttagcgcaaaatgaaaatgtgctcaagaattactaaaactttcaagacgatgacagcagagaattaaaccaagcgtagggccctctgagcatggggccctggagcactgcagaggtcagacaccataaagctgctcctgctttagccaatgtacccttttctgtttagaaggaacaggagaggggctgtatgaaagccaggcctcctgctcacagccccaggcagtaaaagaacagtatgttccttctgccaccctccgggacctaagtgggacccagaagcctgggacaaatagcttgcatttgtgtagatctttacaacatttcccagacttgcttgggttttccttggtgctgggataaaatgaagaagcagaaagtactagccaggcacttcagagagcagagtgctacagtgacttgtttatctccccaaagagatttcccggtttctccaaaaatggggtttgctacaagcttcccagtatgagtcaccagaccagttggcaaagcatttagttctgctgagagcaatggagttgacccttcattggccgagaagatctgccacaagaaccttcatccccctagtgatgggttctgcataacccccaggcagaagccagaatggcgctgactgtgaagtcttagctattgcaggctgtgttgcatgccctcacctcaaaacgcctctgtctttctctacttgcagtgaatgcagaagccttggtggtaggggtaagggcctaggtgaaacacagacaccgctcaccgtgccttcctttctggtgcctcttgatggctcttggcaggcttttgaggtcaggccaccttcccccatttaccatccctttcactagaaaccctggtccttaaagactcaaggcaggcaagaaccctcccagccttggcagagtttggtgacacatgcagtgtaagtgcccagccacccacatctgcacattatccttgtcttttccagaaggtttctttgctccccttccctacaaagacagagcaggccctgagatggtggcgttcactcctcttgtaaagcctggtctcccgcaggactgcatcagaaaatgccctttttttcccaggttcacaaaccgctgcccttttcttggctgccattgcgccactccgacccctggagatcatcttgggaggtaaaaatgaatcatggcgtttctgtttatgctggagctggaggcagtgcctgagaccctttggccctctgctcagcactgatgtttatcaccggggctgatgtgtaattgctggaacagagccaggcgaaggtcaggctgcgaggcaggtcctgggcacagcacagccgggctgaagactgagcacagtgacggggaatcccctccctcccacctctggccccatccatccctcctccccacaccacggcctgatgcctcttggtttttaattttgttttgtttttgctgtgaaactcagttatttaaagacaattttgtttctttttcataaaacagcttttgttggtttttgttttgttttgttttgttttgttttttgagacagggtctctctctgttgctcaggctggagtgcagtggcatgatcacggctcactgcaacctcgacctcccttggctcaggtgatcctctcacctcagcctcccaggtagctagggctacaagcacatgccaccacgcctggctaatgtttgtattttttgtagagatggagtttcaccatgttgcccaggacggtcttgaactcctgggctccagcttcccctcaccctgaccttccaaagtcctggaatagatgtgcctttgttgtatttttctgatcataaaagtagttcaagccaggtgtggtggctcacaccgtaatctcagcactccgagaggccaaggtgtgtggatcgcttgagcccagaagtttaagaccagcctgggcaacatggcgaaaccccgtctctacaaaaaatacaaaaatccgctgggtgtggtggtgcatgcctgtagtagcagctacctaggaggctgaggtgggaggatcacaagctggaggaagtcaaggctgcagtgagccgtgtcacaccactgcactgcagcccagaggagagaatgagaccttgtatcaaaaaaaaaaagttcagacattagacactgaaaggcttcggatgggtctggccttcagcaaggtccctggggctgccgtgcaaggatcgccctggaggaggtcagcgaaaccgagaggaggttgttgctataaccccatgagaggtgatagtggcctggaccaagggaacatctgtgaggatggaggagagggattgatctgagtggggttcaggctgtagtatctgtgtgcaggtaacgagggagtatataataggtcgatttcccagccttcccccaaaatcacttgggctactggtagggaagggtgagtgagtgcagagcggggtgcagaggggtccacgttgcctccccacagatccctcctttcctcttcccagccgggttctgattggagtcactgggtgtttagaggagccacttgcccagatagggaatagtgcaggggtcggcaaggcagtgggggaagataaggagtccagtttttgaggtactttggggcacacaaaccaagatattcattagacggtactaccttcctagtagtgtctggcccagagatccagctttgagagacatcagtacgtagaatgcagctgatgccatcagaatggatgagataatccggtgagaggctctaaaggtgaaaacaaaggaggcctaaaataagaccttgccaacacccacatgtctcaaggaagagggtccttgaaggaggcctaaaggagctatcagagagctaggaggaaagccatgaaggctgcggtggaaaccgatggggaagcgttttgaaggaaggacctggccaatagcgccagatgcttcccacgcagtttgagcaatatatgaaataaaagataaatccgacttagtgacaggagggtcagaagtgatctggatgaaactaatttccatggaatgttgggggtgaggcaagagtgtgttggattgaggaatgaatacggatcaaaaagtagagctctttgaggaagtttgggtatacgggaaggctggcgctacagctggaagggactgtggacagaaggaggatctgattaaccgggagagatgggcaggtttaaagggtggtgggaaggggccaggaaagagggagaggctaaggctgtggaagagggtgcgggagtgcaatgtggggaggaggggtgggcaccagagtgcgtggggaggggtgagcctgggcaggaggagagggaaggtgaaagatgagcctggaggtgagtttgtagaagaggtggcaggaagttggagaattgccatgggttgtttcctctgtctgcctgggaagaaattagaggagattgtctgccaagaataggggtggagtgggacgagagatactaagagaagggagaagaattcggatagatgctatgaagaaccaggagagagctagacccataatgacagttaccttttattgaaagcttcctgtgcagccacaggaagtggatgtgttatccactcacctcaatgaagccttaataccgccccgtaccagatgtgatccccgttttacagatgaggaaggcaaattaacctgtccatgttgacataagagcaaagtgtggaaccctggccttctgactctcaagctggtcctcagcattggcgccacttgtgagtgttagggttcacaggggctgcagacagtggacggcaccacgtggggtgtgggctactctccccagatagcccagcacctgggaggaggagccacacaggcctgcagtcagtgctttggctgtagggttggggctttggctggcacgtgtgactggggttgaggatactggcaaggtgatgactgacgtgctggatagaacaagaggtgaagcagtcaaggtgggtggtgcagagaagtcagaatttgggtctcatggccagcggttccacttttgggtccatctacactcccaaagagttgaaagcaaggacccacacagatatgttcatagcagcattattcacaatagccaaaaacagcccaagtgtctatcaatggatgaatagataaacaagctacataaattatacattttatgtataatttacataaaatgctaaaattatcaaggtatatacatacaatggaatactattcagccttaaacaggaaggaaactctgaattcaaattttggaggtgtccccatttcacaggcagcagcctccatttggcagggcttaagcctcactcttgcccacataccttcctcagcagcaaaagggttagcaatgatctagatgagaattgaggattaaggaggcgagccttgtcctggaacagcatagtttttattttttttcttttgagacagagtctggctctgtcgctcaggctggagtgcagtcgtgcaatctcagctcactgcaacctctgcctcctgacttcggacgattctcctgcttcagcctcctgagtagctgagattacaggtgctgaccaccatgcccggctaattttttgtatttttggtagagatggggtttcaccatgttgcccaggctggtctcgagctggtgacctcaagtgatccacccgcctcggcctcccaaagtgccgggattacatgcatgagccactgtgcccagcctgaaacatcactttctgagtggtgatccaaggaaaagccactaaagaaagtagctaacagaggacagttctgggagttgtgtctttgcttgatgctgacaagtctcttgtttgctaaaacaaactcaacttctttccagctgctcagtcctttgggagaaagggtgaagatggacaataaaatggctgtcagtcccccgcctggtcccagcttcccacctctggcccagtgaggctgggcttctccttgtttactacattcctttagggaacgtcagtggtgggcaggctctgggagctggcctgccttgcctcgctgcctctcagctcccaccgccttcctcacagccctggacatcctcaagtttgcaggccttagcaggtaaccaaacaccctggtgtccttctcagtgtggactccaggaagtttgtttttgttttcgttttttctgagatggagtctcactctgtcacccacactgtcacctctaggctgggagtgcagtggtgccatctcggctcactgcaacctctgcctcccgggttcaagtgattctcctgcctcagcctccggagtagctgggattacaggcgcccgccaccacgcccggctaatttttgtgtttttagtagagatggggtttcaccatgttggtcaggctggtctcaaactcccgacctcaggtgatccacccaccttggcctcccaaagtgctgggattacaggcatgagccaccgcacctggctgacaccattttcttattcattcattcagcaattctcagcatctactatgtgccaaggcatcatactgtgtgccaggcatcgagtcagtaataaaccatatttcatgtccctgatcctgcaggggagatggacaaagaaacagagtgataggggccaagataagggagggagtgaagggagctgtgggggagggggaggagaagggcttgggggtcaggggtcacttcccaaagcacaccatgcttgatgctgacattgatcctggaccatgagtagagtgaggccgggtaaaaatggggtggagcaatgcctgtgcgaagggacaatgttgtaggatgaagcttgggtataaggaagtagatgaggctgcagagggaagcctcttcctctacatgctctgctccatccatttaccaaacttccactcctccttcaggaaccagctcaaatgtctctgcctgcatggaactttccttcactccttccaggtgcaacctcctggctctgtgctccacatacattagcagactggaagggctttctcaggcttactgtttgcttctgccagaaaccccctgtggatcttgttagtgctcagccaggcctcctccacaggccctgctctgtgccccaggctccctgtagttagtgccattcatgtattcttcgggttgcctcttcccagccttattatgttgtggagcatagttttcctacttccatttatttcctttttggcctcaaagttaagcacaggccttttcatttgagtctcattgccaagcactggggaaagcaacacagggaagtcacagagtaaggtggcatacagtggaggtccctaggccataaaccctgactcctgatggtgtgaaaattagaagcccaatgggtttgtctgtttgtttcaagacagggtggtctcactccgtcgcccaggctagagtgcagtggcatgatcttggctcactgcaaccttcacctcccgggttcaagggattctcctgcttcagcctcccgggtagctgggattacaggcacccaccaccacgcccggctaatttttgtatttttagtacaggtggggtttcaccatgttggccaggctggtctcaaactcctgacctcaagtgatccgcacacatcggtctcccaaagttctgggattataggtgtgagccactgcccccagcccccagtgggtttctgaccttggctttagtttcttgaggctgccttctccctaactctgccttagcaaaagccatctggaccttttcctctagatggtccctcctctcagtctggcatgaaatccaagggaatgctggagaaacttccggggtgacattcgattcaccatctctctgcagagattcataccttatctatccctgtgtccccagagctgagcccagtccttggcacttgagtgcatctggccaaatgatcacatgcccagatagctctctttgggtttgtgttgtgtgctttgcagggagctcctggcaggagtgtggcattcactccttagtgtatcactgtgaccgtggggagcacagcatagtagttaagagtatatgtgctataacccaagagatctgagtgtgaactccagtcctcccacttactactgatatagtttaagaatgacaccagccatgcaaggtggcgaacacctgtaatcccagctattcgggaggctgaggcaggagaatcgcttgaacccaggaggcagaggttacagtgagctgagattgtgccactgcacttcagtctgggtgacagactgagactccatctcaaaaaaaaaaaaaaaaaaaaaaaaaaaagaatgacaccatctgcaaaaggggaaaatgttaccaccgactcccagaaactgtaactccccctgagcacactgcccagaggtagtgaatttgcagcagttaatttcttaggcaccacagtaatgtgatggttgttaagaccatgatgataaaagcatacaggctgggcatggtggctcacacctgtaatcccagcactttgggaggctgaggcaggagaatcgcttgagcacaggagttcgagaccagactgggcaacatggtgaaatgcatctctggaaaacaaaacaaaacataataaaaattagtcaggtgttgtcatgcacgcttgtagtcctagctactcaggagcctgaggtgggaagatcgcttgagcctgggagacggaggctgcagtgagccatgattgcgccactgtactccaacctaggcaacagggtgaaaccctgtctcaaaaaaaaaaaaaaaaatgcgtataggaaacagtgggaaaggaagacctcaaggtagaagtgaaggtgggcacatgtgaaggcccctggctcccagcagcccaaaagggctcctccctcaagcctcctcttgctgagactggagcctcaccaagctctgcccacttcagatggcagtgctgaggagtcaattacatcaatgacttaagtaaagcacttattagcacggtgtcttgcaccttgtaaacactaagtgatggctgtggatattgtgattaacattcttatttcagtgttgggtggctgggggtgaagggctgtgtctggaccaggcattcaggtgaaagagtggcttagtacatagccccactaatgcaaagagcataacatagaggttaaaagttcagactctagagcctaagaacctgaacttgaatcctgctttatcgtgtaatagctgcataatcttgggcttcactttcttctgtaacatggggatgcgttgtagagtcatctgaggactgcatgagtgcataactggatgagaggcacctggggcggcatggcagccagcactcaccacggttagctactgttatgctggagaagtgaggtattaggaagctcttgggtactccctggactaaagatttggggaaaaggattaaactcaggttgtggaacttgacttctcaggtggactggcgaccagggatggggaccatgcccttcagaaatatgggctcaaggccaggtatggcagctcacacctgtaatcccaggacttgagaggccaaggcaggaggattgcttgaggccaggagtttgagaccagcctgcaacataagactccgtctcttcctcccaaaaaaagaaaaagaaacaaagaaagaaatatgggctcaaagctatgaaatgagctcctccagtgttagaatttctctggtttcttcactggatggaaggggtggccattctcacacctgagaccccatcatctgcagacattttgccagggggctgcatgctacgccccacccccacgagttgcctcacacactcacaagtgggttggctcctggagtgcagtgagaagccaccgagaggtcaggcagggtgggaatggagcagtatgggcatctgggatgcctgcaggagcacagcttttcgtagcttcatgactgcatgggccttagcttctcagcccacattttaccaggtatacatgttcccctggggggtgccctggatgacccttctgaagccctgagcatgtgggaggctgtgcccacatggccagcattcttctgcggaatgagagcacaagcctccagcgttgcttgtcaggtttattgggtgcggattgggtcgcatgctgtctatcaacagggcctaaggttgggagcagggaatggctgagagctctgagggctctggagttgaggggccatgctggggccatgtgggaagagcctgactcccttccatttcggacagtttccatgtgggttatttggggatggtgcactttgctgtcatcaccaagcatttccagagtacctgcggtgtgtaaacccccttgctgagtgttcttactctctcctgccttggtcaggggctgggagctccagctatgcagtgctgtcagtagtctcggaaagtacacaagaaggccgccctgtagcacccccacaacatataccaaagcccccaaccccaaattaggaattctgtgttgagcccctgtttttcaggggattaactgtgctccagtatgggcaggagctgagcatctgtttgggtttttgtgtataagcccttgaacattcccaaaagtatgtttccagagatgttaacctaagggggtgaggttatacttgcactccatcctcacttgtcattttcttctcccttctccaaccccatttctgggtcacagtttccccagaagtctcttataacttggaggggtgaatggaagggttcccttagaactcatccagcacaggccagtggagacagccaatgtttcaccagagtgggggctttgaagtagcggaagcaggtatgggatgggctgggaagggtcagagctgggataaccaaaaaagagggttgctggcaggtgctgagacctagtccctgagccactgccagaacaggagttgaagaacttcagtctgagaatggctaagaaaggggctgctggccttttgggggaggctgcagtgattctgtggctggcctgaaggaatgctgttggctgaagcggtagctcttcagcagcggggaggcctgctctatggtggggggcatgccctcaacaccctctgctacatacactttgatgtgaacttgtcccctggtcggccacgtcccctaagttgtgagggcaagactgtttctcatgtagcactgtgtccctcatacagtgttgacagaagcctcttggtgaatggggccgtgaatggatgaacgagcaaggcccgcagcaggattcttggtggaatggcttgagaggacagactcctggcacccacagggcccaacaagtgtagctccctacaagtgctagttgctattgttggtggggataatacctgtccctatcccactccaccctggcctctgtcaccataggactggggtgggtttgggggaggcttctcaaagcagcctcatcccttcccagcttgtagccctccaggcaggtctccagggcttaatacatggtcatttcattttccatggaaaagcacacaatgtagttccattctgggtaagaacaaatttcaccctgctaaacaataccaagatactaagcaaagggggcaggggctcagataggaggaggttggggccctactgcctgccctcgaggcttaatcacttctcagaaggacccagatttttacagcctatctcctattcaaggctttcttgtcatcgggatctaggtttgagtcctggttctaccacttacaacccagtgaggatccccagagggatcagtcccattgtacatatgagacaacaggttcagaggtgctaagtgtctcagccaaggtcacagagctagttaggggcagagctgggatttgcacataggccaactgtctaaagacccagtgggctcatatgccactatgggcagaacttttccggaacagcccccagttttcctggcagccgtaaagggaacctgtagttttctaggggcaatatcagttgttacaagatctgaatctttgatgtctaatgagctgggcctagcctcagtagaggactcctgctccacattccaccaagggaaacaggcattacggcccctacccaggacagctggtgccaggaatccaactttccccataggacaatggacctcccttaaacttgtctatatatttatttatttattttaaatagagacagagtctcactcactatgttgcccaggctagtcctgaacttctgggctcaagcagtcctcctgcctcagcctcccaaagtgacaggattacaggggtcagccactgtgcctggcccctccttaaacttcttttccagagactctagaatctttctttttggtggaaaacaataaaagatttggcactccacatggaatgcggcaggagactgcagtgggtgaactcccccggtcccttccagccctgggccctgctgcctgccctgccctgcacaccagccctgtaaggcatctgctgtcccaggggacctttgacaggccctccagcccatagtcagctcttccctgccctcccttgtaaagatagatgagactggcagctgcagtgcctggtatcaggaagtccctaggtggctggagggagtgggccagagccccagttcttggtgggacagcttcatgggaaatgcaggggaatgttcaggggctctgagacatggtggaggcgggtggggggactgatgcaggatgcggatggacaggtggtaaggagtttgtgcatgagagtgggactgggagatgtcacatatttccctggggctttcctggtaaatataactttggtcaaggagaaaccagcagtaggccacagcctaggccaaggtaaaaatgctgtcttctaatgagctccagatccacacagactgtagctttaatgtcctaggggactttagccaaggcctagaaaaagtctcctagaagcagagtttggagaccccatagatcctaccctcagccaggagctcgagctaggggcattccggatgcctccagatgaaaagactgcacaggtatcaccaggccacattgaggggacgtagcaagggtggcatcaaaccgtcggaactgccatcacctcggtcttgctttgggaaaggaacaaatacttctgaattcacggcagtggtatcacctgtgagggtgcagtcaatgctagtcagccctgccctccttggctctgccctctcctaggcgagtgcctggaaagtgacctctgcaagcacaggcagactcatcttccaacctcctgctggagccattctccccagggtctgtctgcagacttcctcccttgcagctacatgggtccaaatgactctgcagagagggagatgcctcctcctcaggtgatgggtcacaggaaggaagaaggtgacctcagtgggggacggtgtgggctggcaaggtatcagtgggctgtggttgccgaatgcagcacacagaggctctggcccttgctctcagcaagttctcattttaaactttctggatagacaaataatccttttcctctcatcttttgccaatggaggtggtgaaatgttctctcctctgtttaatcagataagacttctaaagaaagcagcatcagaagggccaaggtaagggagaaaatgctgtgctctgcccatctgaacctatcaaaggcattaaacttggatcctaacgcacgtggcagacacagagcaacatcatgtagccataaggcctggaggagatgggggcaaggagccgtttcttactctgagcccaatcactaggtacctcaatgtgtcacaggtcagtaccggctttcagaggtcatcctttccattcccctgcctccaaccagggactcccaaaccacccctgcgggcttcccctaaccctaatgcttttcgcaaagggaaaaaataactgttgctacctagttttctcatcaagaggcctgtggacctttactgcatggaagttctttgttatatctaacctaaattcctcctgctataagggatagacagttgagtaaggtctagcgacagaaacacaggcaaaaataacctctggaggtcaccgggatgtaccatcaattctggaagcaagaagaagttttcctagcctccctttcagattagcacgaaggaagcagctctgctatgtgccggctccgaggagctcagctcaacagaaatcccagccctgggaggactctgggctccttctccttttaaggcaacgtttgagtgctcagggctacacaagcggcaacaagctccagcccctctcattcctggctatttggaggaaactgatgattaatcaaccctttccctcccacccccagcctgtttttcattaggttctttttaaagtgttggcacacctcctcaagaacagacacttggcagatccttgccaactaggaccccagggtaggggaggtaactaggaaggagtggggagtagtcctggattaggataaaggggagaagtcaggatgtgcggtgtcagggaagaaagaaggttaaattgaggctgggcgtggtggctcacgcctgtaatcacagcactttgggaggccgaggcaggtggatcacctgaggtcaggagttcgggaccagcctgaccaacatggagaaaccccgtctctaccaaaaatacaaaattagctaggcatggtggcacatgcctgtaatcccagctacttgggaggctgaggcaggagaatcgcttgaactcagaaggcagaggttgcagtgagccgagattgcggcattgcactccagcctgggcaacaacagtgaaattccatctcaaagaaaaaaagaagaaaagaaaaggaaagaaagaaagaaggttaaattgagtcctggctaggggtgagagggaagggtctgaatgggagtcctagctctgaagggggctgcgtgaaaagaggaggctggtgggtgaggctctgtgggcagctgggcacttgagtactccagggatgctgggtgggccgagaggagctgctttggcccctgatggggaaggttagagatggttacattgacttggtggctgttagtgagacagtcaggtctgaaatccagcttttcccgaacttgctaggtgaagtcagttaactcatcatctctctggatccccagtttctctctgagtgaagcctacaagtggcgtgggaactctggaaagggaagctatgcagtgcacagtgggctctgagaactcctgaaatgtgcacattttgggaaaggaaggaagaggggagggcaggagtctttgccctggaggcctaatctctagaccatgggcctagagaggctggtccctccagctctcacctccaagctccaaaagtggacagaatcagtgatggaactgctctcaacttgatgggatcagggaataggagagggaatttcctggtcaaactatgggcagatcctaaaagggctgatccattgggtttccttgtttccattctatttgcatactcctctccttctgtccctttcaaatcaaggttcagtaaggtcaccatcacttctgctccagggtcaaacccagttgatctgagggtcaaacccagttccctgggggcctgagtgagtgggagggggagctctctgccccttgctccatcaccatagccccagtggggcctccagtgcagctggaccttggggcctgcagggcaggaggctagaacagatacattccaaggccctgtctcactaggccctgtgccccttggctgcttattgtgattctagcagaggagccaaggactctcgctgctaaaaaaacccaggggctggtccccaatggcatgtgtttgtggtgcaggtacaaaccgtttccataggactcacttttctttccattccctcggcgaagagcggaggttgaagaaatgctacttgggcccgagagtgcgacagagagctgctttcctttcttccctgccctctccccacaccccaacctggcactcttgaaagaaaactttttaaatattcaaaccatagtctcttcctcttgaaaaacctttaggggaggacatcacagcctccctttaagtcccagttgctctggggtcacagttggacagttaagtctaatgtctactctatgtctaatgtctaactctgccacttcctctgcttctctgatgaagacgagaagcaagtgctctcaaaacagggctcaggctcggtgcaaccttacggaggaagaaacagggatccatggaggtgtgggtggcttatgctgtgtataaaactcaagcccccagcctggcgcggcggctcacgcctgtaatcccagcactttgggaggccgaggtgggtggatcatgaggtcaggagttcgagaccagcctgaccaacatggtgaaaccctgtctctactaaaaatacaaaaattagctgggcatggtagtgtgcacctgtaatcccagctactcaggaggctgaggcaggagaatcacttgaacccgggaggcagaggttgccatgagtcaagattgcgccatcacactccaccctgggtgacagagcaagattctgtcaaaaacaaacaaacaaacaaaccaaaaaaaacctcaagcccccatcacagctcaactgacttggtcccatggcctctctcacaaacttctcagtgtctcgggggtcaaaattgagtcatagaatccaagatctagaatctggcagagtcttccagagatcagctgacccaatgaattccagggctctccacagagagatgcttgtccttagctaagtttttactaaaaataaggacaatactgtgaatttaaaaaaatacacatatttgctgttaaggtatattctttactctgttatgcctaccttctttaaaattagctccttcttattttaatgagatgatgatggtagatagaattttaaaatatcggatgggcatggcagctcacacctgtgatctcagcactttgggaggctgaggtgggaggactgcttgaggataggattttgagtccagcctgggcaacataacaagacccccatctctaaaaaaaaaaaataataataataacaataataatgataataatttacaaatatccttaattggtaaaataaaatgttagcatatgttgatccctctacctttttttcctttggaaatgtattgccttataaaatttctgtatctcagaactattggcctactccttaaaagcaggggccaggactaaggtgaagggatgtgaggcactcaccttgggcacagaatataagcggatgccaaaaactcagtgagcaagataactgatgttttcacatatatatatatatacacatatatatatgtgtatatatatatatacacatatatatgtatatatatatatatatacacacacacatatatatgtgtatatatatatatacatatatatatgtatatatatatatatatatacatatatatatgtatatatatatatatatatatacatatatatatatatatattttttttttgagacagagtttcgctcttgttgcttaggctggagtgcaatggtgcagtcttggctcaccacaacctccacctcccaggttcaggtgattctcctgcctctgcctcccgagtagctgggattacaggcatgcaccaccatgcctggctaattttgtattttagtagacacaggtttctccatgttggccaggctggtctcaaactcccgacctcaggtgatccacctgcctcagcctcccaaagtgttgggattacaggcatgagccaccgcgcccggacttcatgtatatttttaaaaataaaacgaatgcaaaaagtccacaataaacaccaatgcaaaattttaaagacaggatcagtgttagtatttctccttttgcctcaggttccaatgtgcttggcagggcattgcttggaagcagtccttctaaatcacccatgataggaaagggcaattctgggtctgagaatactccataaaaggaactgccacaacctttgcaggtatttgtttggttgtctcacaaccctgaggccttgagtctgatgtcatcccatttctgcagcttaaacctgagtccctcttttgctgccctcaatggagacatccaccccactctcccaaacagcacaactgtccttcagaggctcaagggcagttatgtaagcgctcccccacacatccccatactcattcctctccctctgtagccagcttttcatgattatttttcttttctgaattcttaggaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagtggccccaccaagccctctgaaggaccggccaaggtggaggaggaggcagctcccagcatatttgatgagcctctggagagagtgaagaacaatgaccccgagatgactgaggtgaacgtcaacaactcagactgcatcacaaatgagatcttggtccggtttactgaggctctggagttcaacactgtggttaagctgttcgccttggccaacacgcgagccgatgaccacgtggcctttgccattgccatcatgctcaaggccaacaagaccatcaccagcctcaacctggactccaaccacatcacaggcaaaggcatcctggccatcttccgggccctcctccagaacaacacgctgaccgagctccgcttccacaaccagcgacacatctgtggaggcaagacggagatggagatcgccaagctgctgaaggagaatactaccctgctcaagctgggctaccattttgagctggccgggccccgaatgactgtcaccaatctgctcagccgcaacatggacaagcagagacaaaagcggctgcaggagcaaaggcaggcacaggaagccaagggagagaagaaggatctgctggaggtacccaaggccggggccgtggctaagggctccccaaaaccttcacctcaaccatctccaaagccctctccaaagaactcacccaaaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaagttaagtagttgtgggcatgagccaacagggcggggctgggtagggcctggaggagagggtaggactgcaaaagggaaggcatgcagaggagcttatgtcggctgcagatgatatagactcccagggcccataggggacttcaggtcatctcatgcatcctcctgcctgcaggcaggtcacacctgtatatcccctagagctgagactctacccttcctttaaggagcttcctttaatacctcactccatgcttctctttcattctgcaatgaagcctgtttctccttaaaatggagaaatggcctctacagagtagttttgcctcgggtccttcctttaagtcttctccatttccccaaacaaaaatgatccacgttttacttagcctcctctcaggaccagccaagtcctacaggtcagtccatccgaaaggtctctgggagattcacctctcaggagagtctacctttgcctagccagtgccatggacacaggagccatccctggacaccctacttctccaagccctgcctcccctggaagtctggcctgggtgacaaagtccacgatcgtttgtccatttggttggatacccaacccccacaacatcatctgggacaaggtatcatgagataaaggaaaatctcaattgtaattccagtggtcactcaatgacatccaatttttacagacaatgaaaaatgctccctcagtgtcaacacctcattcacattccacagacataacatattgcagtgtcttgtgtgtccttccagtagggagggaggtgaggtggctgagctcccttctctaacctgtctctactttgcccctacaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacctgctgctgtatgaatagctgtgtatctgtttttccataagattttgataatatatacaaacctttagctgtgaatggctgtgccccacctgttgtcctgaactgtgagtcctgatcctaaccctgggctccctggaggactctagaagctcaggttccctgccacactatttgagttggccaagaaataaattcacatcctcagaaagtgcagcatggaggaaaatctgaactctaagcagaagactctccactgacctggttgtccaggtctagaaggccaggcctctactaggtctgctcctgaaccagtcctgctgcctggagtcagtagccagagttgttctcaggggtgctggggcagagtggagcccagggtgctgggatggctatattaggcatgttcagggatgctcattccatgactctgcctaaccatgggctcagggccaggtcctcacagcagtcacaggcccaggaaggcggcaggcagagaagtggagtgactatttggagaatagcacccatatctgtgtgccctagggctcagaggggcctcatcttccccagccctccccacctgctcaccaattccacttcctgccccaactgcaggaatgctgacaatgctgccatgcccaccatcgggtgtaggtgaaaggcatctttctgaatttcattctcttgaaggtgctgccaccccttggcactgtggaactgccaccttgggtctgtgtcacttgtaggtttctctgcctccaggttgcctcaacagcaggaggcacagcagtttcaccatctttgaggtgagggtggggtgccccagctaggaagcaagatcgctgtgctaggtctgaccaaaaccagagggcagtctagtcctgggggtaaagccctcagatcccagggtacactcttctccattccctccacccacttgcctgtcaccccagtcacctaagcaatcactgggcccagaggagaggagacagacacacactggctcctggacctaaagggtatgagctggagctaaggccagctagagcttccactgtcagccctcactgtcagtcccactgcacccccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctcaggtctgttttgtttgttggttttgttttgagcccaggtcttcaggccatagaactgcttctcattaacagctccccttccttccctcactgaaataaggctgtgacggtgctgcaggaaagcactggacgctcacctgaacccaaacaacctgcctccaaatcttaagggtccaatagaacctgtcaccttaggaagccctttctaccaaacttcaaacatgatttagccagagagaaaaaccactccctactgtcctgagcaacaagtgagctgccctcttcctcggtgctcccgcggtggggatgctgtttccgtcctggatgatgtcatcactcctctagtgcacttgaacctggtgcgggagcacagcgccacctgggggtggaccgcaacccagattctccagctgctccaggggtgccctggagctgtgctagggaccaggggagggaggcagttagagggagggggaggaaaagatgggcagatagcctggtgagcttcggaaaaggggcccaaactctggaggctgtgtttctgctgcgccacgcacccactgctgcccacctgccccaccaacactggcagtcacccatctatcctgcttcctttcctaaaacttagagagggaaatccagaaaggctctatccttgtctggtgcctgtactgtacaaggacaaaaaaagaggttcgaagatagaaaatgacttgtcgaagttgatgaatcaggatttgaacccaagtctcttatctctgggttcatctagcaacctggatgaagccacggtctgacctccacggtctctgcctgcagcccccactgtcatatcctccactctgcccccccaccctccatcacttcctggagaatcacattccctagctcctacctgcaaggaagggaggcttcacctctcagctctcccggcccgcagggcccagccgttgcaccccaagcttcttgcctcctggtcctatccagatgggaaaagcgtctttccctccaccttcccagcactgggacctaggccctggtgctggctgtgggtgggatggcaggcaccagcagctgccaaggcgctggcctcacttgtccttacagaagctcaacctgcaggtgagcaaggggctctaggcctgggcactgtgtcacacatgtggcactctttaagaaacatgagatctggatgcaggtcacccatgagcttctggaccaccaagtcgggagtgccatgtgctgccccctacccttcaccctgcatggccaggctggggctcctgacctctgagtttggcctaactagggcctgtgttgctgtggtgctgggctaggctgctggcctaagagtggccaagagagtgtggcccccctcagcacccttcccccagcacctcccactcatcctgtctatgcccctcctacccctccctccctccctccttcctccagccctctagggcccttcccttacttgcccctccctcctttactctttgcctgaagtacctcccttctgttcacctcttgtggggggctccccttctcccctcacccaaggtgtctctcctttcttgccaacctttctccccctgcccattgtatttccatgtgtccctgccctagctccttcccctgcacctgacccctcccatccacctgtgagatccgctttcccttgagcaggcccagcctggcaagattcctgccctaagaatgcactcctcttgcttttgtctaaaaatgcccctcttctccacatgtgccttccagaccgccctttgggggattcaccattccctcccagcctagcaggaccctattgacactattgaggtcccccaatccttgagggacactgcccctcccaccctcactcctgcctgcccttatagagtgcctgattggctttcaggggtgctagctgaggaacaaggcgatccggaggggcaactacagctttgtactcccctggccctgctgggctccccttgtttcccagatgatgagtcagatgaggtggggtcagaggagactgcagtggtttgggaagagacgtaggggtgattgcctccatttaaagaactccaggatatgtgagagacctcttcactgctcagagcatgtgaaagtcctactctgtcacagttttgctccttttcttagaattctcttcagtgttttgcagagttagttgactggaaatggggcaactctactcttccagtctcagctatggctagggtaaacctgcctcctatcccagactacaaagcattttttcattggcaccaggttgttgattcaaggataattaattctgactggcatcaccttgcatacatttacacatcatttctcggagaaactaaaaaaccttaatatgtagatctcttccagctcccagcttcaggagagaggagactgcactccaaacctcagatgacttggagaccctctttcctaaattgtgaagccaggcactccagggctccagctcccacctcttgtccccaccctcaaagagaaagaggatttgtacctgtggcctcagctctgtctctaccagcatcagcagcccctccctgtctgggtctgatccaggggcagacatgtgggccccatgaagatttcactgggaaggggaaagccatgaatctaggggcagagctctgcccaggggaatttctgaccctggccccaaaaccctggcccaggagctcttgccttccaggctgcgtgacaagagataatcctcaagagtatgtgggtggcagaaggccctgggggcatggtcagcacaacggccatatccagaacccagctgggctgcaggatcccagaggtctgagcgggcagggcaggagagcaaagcctgaggctgcagtggggctggagtacctgtggatggggagaaaaggagggctgggcttagaggatacttggataaggggcttggagaggggaggggctcttcattggtggggctttgccaagctgagctgacacttttcccacttgagttaaaaacaataaaacttccttccctggatctgtcaccagacaagtcctgagagcacaaggaccatgaccccagggaacaaggagagggaagacagccaggcagctccagaggtaggggggctcttctaggcaatatttgtgggaggagggggagaaaaggtcatatcccccactgtgtggctcagtgggggtcacagacatgggcctggggactggcaacccaagcagctgacagaagcaccttgcaccagattcttgggtcacccagtgtctctacctggctcctagttctaggatctctaatcaggaaggaaagcacaggactaacagtttcatgtacatactatttcaccctcctgacagccatggggtattatccccatttgatttatttatttatttatttttatttatttatttagagacagatcctggttctgttgcccaggctggagtacagtggcgcaatctcggctcaatgtaaccccagcctcctgggttcaagcgattctcctgccttagcctcccgagtagctgggattacaggcgcctgccacaatgcctggctaatttttttttgtatattagcagagacagggattcaccatgttggccaggctggtcttgaactcctgacctcaggcgatcccccccccttggcctctcaaagtactgagattacaggcatgagctaccgcacctgtcctatctccattctatagataaggacattgaggcttgggaacctttggagacatggccaaggtcagaaagtggtggggcccagaatgaatctaagggtacctgaatgggaactgcctttgtacagttagcagtgcctcagctgttgtagagctgttgatccctagcagggaatatctgtagtgcaaacgagcatctcttcagagctgtggcaaaattcacctcattgtctttaggaagcctttaggaagccaggaacagtccgccttggtctgcttgtggatgggggtgaggatggtgctgtgctccgatgctggtgctggccctcccctacttttggaatatggagtgggcaacagtctgggcccagctgaaggcggtgttcctggaaggtgtggatgggtccaatgatgcgactgatatgagttatgtctttacagctttaatctagcaggccagagatgtggccagtggggcagccagagaggagggctactgccagctgctgacggaacctcctccctccccccaccccagcccagaggggacaaacagtagggccccagccttcctggctgggatcttgggagcagagggactatttgaaaacaggcactgtgacccaggctgtcatctccctcccttgcccccagtaaaaatagcccataattccaagccctccccccaacccctcatagttctagttcagctcctgttccacttccctggggctctgtccccagtagggcccagggcttggcttggtctggggcctggtggctggaggactcctgccacccccaggaccagatgcaggtacaggatgagggcatctcccaaggttggcatcactgaaggggcagcagagacatggctggttcctcaggctcccgggtaagagggctgtggtggcatatagggaggaggagctgaaagccaaagagacaggatgagggtgagtggtggcataggtggacgaaaagtaacacccctgcccccggggcagacaggacccatagggaagagtgggcctggaggtttcgggctagaggtggaggaagtctgggagagggaatctgagaatgagagaggcacaggggaggtcgcagggcaaggggtgggggaaggcagcagcaaggggctccagattgcttacttacctgcagggttgtagactgggggcccagctgggtagagtggatattggggagcaggaccactaggtgggtatatgaagccaggctgtgggggtgcagggccagctttggggtcctgggggtatgggtatactggctgcactgggatgcctgtcattggaatctcctggcctagatgggggagaaggatcagcattcagagacccatctcctatgggaagcctcctcctcctgcccaggaaaccaaggtaagcaccctggtgctggcctctggcaagctccaggctggccatctttgcctcccacaccctgcttggcagagttaagcagggagctgtgcacgtggccccagctggtcaatctgtgttgagcaagtttgctcccctcagcaggtttcagagacctcatgaaccagggagcacagcccagggaatatctcacttgggcaagaaggggacagctcagggctggtatcctgtaatccagcagagctgccactaagagggtcttctcctagcccttccctcccacactgatctcccgtatggcatcactgtccccatgtccatcaggttgtggcatatgtgcatcacatgccaacactcaggcacatattttgccatccactggagcacactcaattaatgttcatcactacagacctgaccccgtgtacttactaagagtcatatgtatgcatacacccactgcacccactattgttgacagactgcactcctgtacacatttgaatcttcatgtgtatgcacagaaatgcacacaaagtctgatgttccatatatcccaggcacattctaatattcacgggtttacaagcatttttctgggttttcatgctggcaggtgtgtgtatacagaagcacatactactacagaatttacccaatccatgaactctctgctgcccattattggacttagcccagcccatctgaggcccttcttgcccagtactgggtgtaccttcaaatgggctctggagctgctggcgccggcggtacaggtagcaacaggaacagaggaagcagcagatggtggtggcaaccacagcaacaaagaggatcacagctgaggcgatgcctgctatggtcttggggctttagacaaagaacaggtcctctcaccttccaacactcataggacggagtcctcattatgctggctccaactcctggccagcaggggggccatggcatgctgagatttggggttccttgtggggctctgcccagtccctgtgaaggagatcttagaggacctccacttcccagaaggctatgctgcctggctggctagtgtgaagcatacggggatttgcagtgcgcccccaaccattgcttttatatctacaacttaaatgattagacatacagcataacactgaaaggagccttagaaataatctagagccattttttccaaaccccgcttcaatcagaagtctctatatctattttatatatgatatattaaaaaaaagtttgacaaccactaatttggcaagcaatgacccatagaaggcaagtgtcttctccaagatcacacagctagtaagaagtggacctgggaatcaaacccaagtctcctgcctttgtgccagagcttcttccacaaagctacactgtcgtccgggtgttaaccttgaaccctccctccccatgacctggcaggaccaaagggagggctccagaaagaacctggaaaccccgggcccagtcaaagcctatgaaggtaactaacatgccttttctggaactcccaggcaccagcacctaagcacctagctctgccgccaggcttgagtcctggtgactctattcagctaagaatgtggaggtcgacaacggaggaggcaggagtccgggagggaggaagaggaggcctctggagaaaaggatagaggaggtggtgagggtgaggaggcaggaacccacctgaaggccaggcagtgcttctgctgcctctcggtgataagcaaggtcaggtccctgcagcagtaccgatggtagcaggtcccgcagcagaaggtgaagaactcgcagttaaaccccggatgccaggagccattccggtccaggtaccacaggcagtcctcgccggccagcactgcgggcagggattgggggtgcccagtggccaccaggccagttcatccccagccgcgctcggccccactcccccggcggtccccagcctgacggctcccgaacactgagggttgccccttgtctccaccctgagggtctcagccccagagcccccgaggcctctgcctgaagctgaccctgcaccccgggatcagcctcccatggcccagcatcctggagctccctcttcccgcttcttgaggacccagcaacacccaaggctcccgtggcagccggagggtctcggagaagccccgagcccaagcccctcggatcggtccctccccttcctccgcccccatcccactcctgccgcatctctccccatccccttacccaggggagcccccagcaccaacagagcgattgcggtgagcggcgcggcccggcggagccccgcgggtggcatggtgggggctgggcgcggccggggtcgggcctcccagagaagggaccgcaggaccaagccggccagctggagctgcggcggggcccagcccgcggccaggctcgggctcctcttccgcctcctctgggggtgggactaagcgccccgcccgcgctaacccagccggcgcggctccgcgcagcgcccaggagtccacccaccagcgacgcccacctagcctctggagctgggtgcccctcacccagcagagcactgccctgctccccctgtccccggctccgcggtggttcctcccatccgagccaccatgggcactgcgggcagttgggcactgcggccagggaagcctggctgtgtcctggacccgcccccggcctgggcccaatcactatgctggactccagaagccctgatcctggtgccacctccgaatgcccagacacatgggccaaccctggaggagcagggctggaccttcacttgtgggggacctcctctgccgcgtccagcctgggacatcctgtcgggggcggagagggaaagaggctggatgtcaccccgcccccattcccagaacacaagcactcattgagaggcattcagagtggctttgtccccagcggtgcccacaggcctgaaccctgccagctgcactggctccctacgatggacccttcccccttcaagtggacagagctggcatgcaccagcccatggcctcactagcagggaaggcaggctgctggggccacctggggcccatccagttaaacactcttcacagtgaaagcccttcacagagcaagcctgtactgcaatagccaccggagcatagggagggcaacagttaatttcaggtgggcaacagttaattccaggtggagacagtgttttaggatgggagaggtcagtcttcacaggtttatactgagtgccagtgactatgccccatgctacatgaggtaccctccgaggaactgcaaattaagccagggagatcatcaaaagcctaccttaatcccctgccatgtacaccctttcacacacttctgggcttccacatctacctcactggaatctttccacaactccatgaactaagcaaggttcatcagtgttatcaatcgcatttcacagactgagaaactaggactcatggaggttaaagaacttgttcaaggtaatacagccagtaaatggtagaggcatcaggaagacccaaatctaaatcagggttgatccccagccgcaacagcagacagtgtagacagtgagtatttcttgtgttctggggtgagagaatcaggacaggtccatggaaggcccagtagaatcttagtaggttagggaaggacagccgaaagaggagctaccccatcctgggcccctgtgggtgctggcacacctacccaagagagctggaataggagaggataggctcctgccccagaaagttgctggtagcctgatgggcaagagtatgtcctcacgcaggacacagtcataaatgcagcagcagggacaaagagaaacgcctctgaatccagcaccacctactcagtgtgcccattgccatccatctcctctttcctacactaaaagctccatgactgcagggaccacgtggctgtgttcaatgtggccatccagccctagccatcagtgttgtcattgttggttgaatcatcttcagataagggactgtctttcctgcccagagctgaatctcccatgtgtacccttgacccctgctgatttgtctcttcattatcccatctctttagtgtctttagcttctcacaccttaccagcttcttttccctaggaaatctcaagtctctcctatttaaagcaaagcaaagcaaagcaaaccaaaccaaaccacatccttcctaaaactcatccctctctagctactttcctgcttttttctccaactagccttcctcaaagtgtatacccctagttgacacgccctcctcaaagtgtatacccctagttgacacttccagcttgcaatgacacctagcacgcaccaacatcatcagtgattttctaattgcaaaattctaagaatgtgtttcagttcatgggatgggaggtgactagactaggacagagagtgaagagagggggctgtgggccaaccagaggggagaactggctgcactgggagaactggcacttcttaccttgacaagggatgctggagctcggagatggagagctggggctagcttatgtcgccataatgaacctgggtcttgaaagagtctgtagattggccaggagtgaggaggggcttgggtgggaggactgggggccctggaagaagttgtctaaatcttcaggcctggaagggcttcactacaccttctctaggtaagggcaggcaggaataccccccgctcaccaagctggtctcttaatccccagcaagggaaagaaacgctttcctggaaaagaggaggcagagtaatttgtgatcagatgagacaaaacataggctttgccagtaggaggttctcctcagggtgtctggaatatgatggtaatgataccaccagcagcgaacattgctgatgagctcatcccattgtacagatgaggaaactgaagttggaagaacttcaattcccccagctcacactgctgggatttgcagttggacttttgtggcttcaaagcccaggcccttcagcttcaccacctgcttctctttaaacaagtctaaagggccaggcacggtggctcacgcttgtaatcccaacactttgggaggccaaggcaggcagatcacctgaggtcgggagttggagaccagcctgatcaacatgtagaaaccccgtctctactaaaa

SEQ ID NO: 36481 - DNA, 48668 bp, Homo sapiens
ccgccccggtccgcaaagccggtggcgcccggaggctgcacggagagcggtgcccgcgtcaggtgaggcgcgcgcggggaacgggggtcgcgcgcaggggagcgggggtcgcgcgcggcttccatagagcgctagggcctgagctcgaagccccaggcccgcaggaggcccgggcccgcggccgccagagccgggacgcagcctgggcgccgcctgccccgccccgccccgcccgggcccggagtgaggacgcggtcggaggcccagcagcgcgggtcccggcaaggggctttctcaactacacaaaagacagtctaaaaaattaagtctccatttcggttaagactgcccgtagtttcggtttttatgtagacccaagagggcaggctcggcgtccgcgtgccgcgtagtccggcggctccaggagcgcgagcggctgggcccgggcgtagccaccgcagggccgctagctcggccgggacccgcctgggatgccctggggtctgctccgctggggcgaatcctgaggcgccacgcgaggcacttggcctctcctagccccgctttcgtttttggaaactggaaactatcacttatttcgtagacggtgtgagggttacatgacagtgttctgtaaagtgcactctacatatgaagtgctcagaaatatggctaataatgagggtatttataaactacttaaattataaaaagaatgagacatcagacttacagttttggatactaatttttttcacttaacgttcattatgtgataggagttttccatcctattataccgctgtgcgatctgatcttgggcacgttaaccaacctcttgttgcctcgattttctcacctgtaaaagtgggggtaatcataatgcttacttagtaggatagccctgaagaataagtgacttagcgaacataaatagcttacaatagggttttcagcatgggaaggattcagtaaatgttagctgtcatcatcaccacctacaaaggaagcaatactgtgctgaaagtttttccatcattaatgtaatttctatagtacgattcccaagaagatattaaaattatggaaataaaggtattggtatattcctaattatttcctaaaagattgtattgataaatatgctcatccttcccttaacgggatgcattccagaaaaacaagtcaaatgttagacaaagtatcagaagggaaattctgtagccagagagctaaaaattacaatagggtctctaattatacttcaacttttttaggaataattctcagtgtgttttcccacatttcatatgtaatttttttttttttttttttttgagacagagcctcgccctgtcaccaggctggagtacagtggcgcgatctcggctcactgcaacttccacctgctgggttcaagcaattcttctgacctcaggtgatccacccgcctcggcctcccaaagtgctgggattataacaggcgtggcatgagtcaccgcgcccggccgatctttacttttttattctttgtaccccctgcctatccagttagcatgtgattaaagtcaaagatttgccactttgggccacatctattaattttcatctttgttataattgtatttagtttttgatctacactgcttattactcccagtcattttttctagaactgaaaatctggtaaaatactcaaaattgcactgacttctatgtagaggcgacactccatcagaaccgtgggctgacagggaatcccactgtgcaggagctgcgcgcattttcatttctgattctctttggcgtatccaggactctgatgacatgatcatatatttatcagtagtaacaggttgggccatttgttttttgtggtaaatcatatatttaagattttagaaataagttgatagccatgtattttggaatttgaaaaagacattgcattactcagcttcaaattaagctttaatcaaatagtgaaactttccattaatggacagtgtatacctttttgtgtatttaaaaaaaaaaacactgaatatagtgcctttgtgacaggggagcttagttcctgacaatgtcctcttgagtcttttttttttttttttgagatggagtctcactgtgtcgcccaggctggagtgcagtggcgccatcttggctcactgcaacctccgccccctgggttcaagtgattctcattcctcagcttcctaagtagctgggattacaggcacgcaccaccatgaccagctaatttttatacttttagtagagacagggttttgccatgttggctaggttggtctcgaactcctgacctcaagtaatccacccaccatggcctccccaaagtgctgggattacaggcgtgagccatttcacccggcctctcttccgtctttgagctgtgaggaaatagctacattacatgagctgctagatctgccttatggtcagaaatgaaggttgaactctcaggaacagtgacatatatacacactgatatttccaaagtacaatgccccaaattgatccacaaaggaattaaggtcatttgcaacaaaatcacagaatagtaacaaataaatagaagataaatatggccaggaattgagatgagagaaagtataagtacaagaaactattccaggggaaaaaaagaatgaagtgtttcagtgttatccaatagaattttctgtgattatgaaaatgtgctatatttaattaatttatattccaatagccactctgtgtagcggctcccttataggtcattgcaggcctatatttttgtagttgagtcccaaatttgtttctagaaaggtaaacttggtcagttacatggttcttgtcttttgaaagtaaaacatacatggcaacttcattcattcattcattcattgatcccccaaatgttaatggccttgaaggaagcagagcctttcctgattctcagttatagggaaaattttctgtggacttcattatcagagcaccttgatatgttattgccctgtgaaagtctgttcagtttggggctaggagggatgcagtcagtgaaagtggcatagtttgtaatgttttttagagttttgaataattatgttaactaatctttatagaaaagtttaaagtgtacagagaagcaaaaagaaagtagtcactaaaagtttcaccacttagagacataattactggtaatattttgatgtatatatttccagacttgtgtcccatgtagctattatatttttctcaatagatcccaaagtatccaactccctccagggcaagagttgcttttacctttacccttagacctctgaggctggcagctggccccacctgagagggtcaccctctccctaatccttccccatacttctgtgagtcacctggctttggggcaataatagatacttgagagggcgtttgaggaggaacaaggaggaaggtcacagctgtagttcattctgcatgatgtgtaatccaggctttttcaactctggcactgttgacattttgggctggataattctttgtgtatgtgtagttggggtaggaaggtgtcctgtgcatcacaggatgttttgcagcatccctggcctttccctactagatgccaatggcacatacccttttccccccgagtacaacaatcagaaatgttggtgagaaatactgggttaatgaaaatcactaatttattgctgacaaagctctggagtttcagattccaatttgcatgtgggaaagagactgaaatcaaaagggaaacataatgtaagccaaggaagctgtttagtcctggctgtgctattaatttactgtgagattttgcatctctcccacgtgcaaattggaatgtgaaactctagagctttgtcagcaataatttagtgatttccatgaacccagtagttcctttttttttttttttttttttttaagatggagtcttgctctgtcacccaggctggagtgcagtgggacggtctcggctcattgcaacctccgcctcccaggttcgagcaattctcctgcctcagcctcccgagtagctgggactacaggtgcacgccaccatacccaggtaatttttgtatttttagtagacatggggtttcaccatgttggccaggatggtctcgatctcttgacctcatgatcagccccatgcccgcctcggcctcccaaagtgctgggattacaggcatgagccaccgtgcccggcccttaacccagtagttgttactgacatttctgattgtcgtgctggggggaaaacggtatgtgccactggcatctagtggggaaaggccagggatgctgcaaactgatatactgccaagtttatcagttgggaatcccaacagtgaaaagcataaaaatgaaaggaattttaaggagactttttatagaagagtgggcaggattggaggagccaacaagtgatggtgaggcacacagggaagagcttcagtgggcaccatcccctctctggtttgaaggggtagggaggggaccagagctgggaggagggggctggaatactgctggaggagccactcccttccagacctgctgtggccatcacagaatgcagccactgccagagcagcagcctgaggaaccaggcagggggagcacaagtaccctagcctctctctttctgtttcttgcctgccgatctcctccactggctaaacccagctggatgctaagagtacagtcagcctgcctgctgaggagggaccaccagggaccaccatcagcaagggatccaatgtctttctgcctctgcagaatgaaggttggggcacggggggcgctctacttcttagggatattgtgggaataaaaggaaataggcaaaaaatgtttttgaaaaacaaagcacatactgcgcacccgtgggccactactgcttttgacccctggctctgtttcatgaagtaatgtcgtgtcattctctttttaggtgctacaggatttctttaggtttgttttctgtccaccatatttcaactcatgtgtgctgtttgttgtgctaaaacaaatatttgctgatgcctgagtgaatagttgaatattttatataagtcaaatttatacgtaatgatttttcttgtaacttagccgtttctcttttacaaactcagaaaacctcagactttgaaaaggccttgaagttcctcacctgaaatctgagaacttggagcgccttaaaaaatctaaaggaaaacaaaacagtgaaagaacatgatatagtcagtgtagagaataaaattatttatgtaattaatattgaggatgcagataacacgttgtgaaatcttgcttgtaaaaaatctcgatctgctgaagaaagatgttctctctagagatctttgaaagcataattattgagcttttaaaatgttagaaacaaaagttagacccacacatattctggcgtgtggaagatttgcattccttcccctgcccgccccgcccccgcacttgtgagttgtgcctgtgtacgcagttcctgtagcactcggctgggcagaaatcatctttcagcactaagggaacatagttatgatctggaccttctgggagtggtcagtgcccaagaacaggtatgggactccagaaagttctgctctcaaccctattttgaaatagagttacacattgttctacaattatttgagttaataagcagctcttttcaaacgtgattatgcccttccaagtttaaatacactagactttagtgaaagtaattgacctcatctcatttctctcctgttatattaagatcactttcagtaaaaggtagaagcttttgaagtggtgaggaggaggtagaggagggacatagagcagataggggctggaaagtggggtggggaagagagtggcttctctttggcagagtaccaaggaaaagccctatctgtacagaacctttgtgcctgggaacttgatggctgcaacctgagcctcaacctagtttgcttgcggagccagaagagaagctaaaaaccttcagttaaccaagccagacaccaagaaagttaaaccgaaagagaaccccccaccccccgcaaaaaaaagaagtaaagtgggttaaagtgatatgttagcacagaaagagaacataagggtcatctaagttcatctgccccctcttctatttcaaggtgcagaaactaaggcacaagggaccccgtgtcctgctcttgatcacatagctagtgggtgccaagccaggtctagaactctgttctctggggtcacaggctggctcttcatccctctagagagatagctcatctgtgtgcacctgagcccgttgtgtttcggagtcaaagcaaataaaggctcaaactccaagactgttttgcagaccggctgcagtagatacggggggaggagaaacctgctttaaattgcttcaagcaagttgtttctgcaaaggtgttgacttttttctttcaactttctagtgagtcactgcagcctgagctgttatttgtcattatgcaataattcaggaactaactcaagattcttctttttaaattatttgtttatttagagacagagtcttgctctgttgcccaagctggagtgcagtggtgtgatctcggctcactgcaacctctgcctcctgggttcaagcaattctcatgtctcagcctcccgaatagctggtattacaggctcgtgccaccaccccctgctaatttttgtaattttagtagagacacggtttcaccatgttggccaggctcgtcttgaactcctggcctcaagtgatccgcccgcctcggcctcccaaagtgctaggattacagccgtgagcctccacacccggcctatttatttatttttaaattggctgctcttagaaaggcataccatgtttctggatgggaaggcttattaattcaccctaatttaatgtataaatttgatgcaatcatagtcacagtcccagtggaattttttaacttggtaagatgttctaaaattaatgagagaacttgaattaccaggtattgaaacactgtaaagccacaatcatgtaaacagtatgttataaccatgggaatagaggtctgtgatacagcagaaaaaagtgaaaaaaagaataactgtattcataaaaatttaaatgtggagtcactgggggaaaggattaaatattcgataatgtagaaacaactcaactatttggagaaatgtaaatttagagccttatctcatgccatataccaaaatactatttagatttgattaaaaaataaaaatgtaaataaagaaaagttaaggcaaggcgtggtagctcatgcctgtaatcccagcattttgggaggccgaggtgggtggatcacctgaggtgaggagttccagaccagcctggccaacatggcgaaaccccatttctactaaaaataattagcgtggtggtgtggtggtaggcgcctgtaatcccagctactcaggaggctgaggtgggagaatggcttgaacctgggaggcagaggttgcagtgagccgagatcccaccattgcactccagcctgagtgacaagagtgaaactctgtctcagggaaaaaaaaaaaaaaaaaagttaaaaatctaaaagaaaataaaaatgtatctatttaatataagtcttttgggaaaatatttctcagcataatactaaaagttagaaaatagaatgtttttgtgtttgaccatttaaatagtacacctttgaaatttaaataaaaaaaggaaaactaaacaaaccaaaacctttttgttacaggattaggtcttagatattttaagatatattaaaatacagaataaagttcctccttgattctgttcagagtttaactagtcctggccagacaatggggaggaaaggagagggagctgtgtgatgggcaggcagagagttggaaggtggagccagatctcgcttggcctgggattgctgcctctcctgacggtgcatcttatcgtaagggggagttgaaagcagaaggggaaacagcacagaaaggatctgtctggccgttacagttatgtgaccatggcaggtcctgccagtcactcacagctctgtgagcaactagctggggtaccccagctgaatgtgctttaaaaacagcaatgtggccaggtgcagtggctcatgcctgcagtctcagaactttgggaggccgaggcaggaggatcacttgaacccaggagttcgacgttgcagtgagctgtgatcatgcgtgccactgcattccagtctgtgttaaagaacaaaaccctgaccctgaaaaataaacaaataaacagcaatgccacttattctaggtggtacacccctgatgcccagtgtacgagttccatttaggcttctttctcgtgcatatgcatctctccacatcctttcgtttgtttgttttcttttgttttgctttccccagattatgtaggaaaacaataaagttcataagtaatgttctgtaggccacttttataggaaaactttcctctaagatctcattagaaaagaaaagcaagtagcctgccaccgagcacctgtgccagcacaactacactgtggagcacccagataaagtggcgctgaacgcactgcagcctcctaagttcggaaaagaaagctcattagcatctacactgaagacgctcctgttcttcacagctttaatgatcactgttcctatcgggttatttatatttcacaactaaatcttatatatctggaggcgcccttgggatatccaataaggacagctgtttttatgctgctattgttgccgtggtcaccggccatgtggtgctggccctctttatgtatgtggtctggaatgaaggctcatgacagtgacatgaaggcaaacaggattaaagtgaacatcaccttttgatagcattaaattcattttttaaaatgataaatgctggaggggggacatctgatttgaataaaattgaaagaacatgttaaagtcagtcttaaggagtcatgtttgagtagtgtaaattttgatcctcctaatatgttgtttgtatattcagttttaactatatgaatctcatttgcaaatgagaatttggaaaagttaaattagttacaaatagatatgttaattacaaaaaaaaaagaaagggagagcaagtagtagtgagatttctgcaaggtcaaaggactcagggcagtttcttctgaatgtagtttgggggctggagaaagaaataggaagcagtagaattgctaggtcagattggaattttaagagctattgctgcactaccctccacagagatgctacccacttgtagtcccccaataatatcagagtgtattcctgaccacactttaaccaacacactctggcaaacattttgatctgtcagtcagataggccttcttgctataatcagaatttacattctgtgatcatgactgagggtatcattctgcctgttataagagttacctgaatttccttttctgggaaccagagagcaatttagagctggagcagaccttggagatgaagtccaaccattcagcctacagcctatgacccgtttgaccgtcgttgttgcttgggtagttcaggactgacaggactggacaccaggtctcctgtttatccttgaagctctctgggtgaatgtaagacaggacctgtcaaggcctctggcacagcctgggtttgagtctagaaccagaaagtctggaaattgcagggcagtgccgcagtgccttggctgtgaagcagggtgctttaccctccctgaactccaggcacttcgtctgtaaaatggaattaatactagcttttttttttgccagggttctgaggattagggttaatgtgtatgaactagctgacccagagaggctcacatctgttctcatcctcctcacatttgggtgttctgttatctgttatctgttctgtcactgttctgttatctgactatcactcacgtgcaagctccaagggagacttgaatgaaagttcttaaaaacagaagtaaagcacagtagggtgttggggagggcatctctgtggggcctccaggtagccaggggagggcgagcagagtgtgcttgctggggaccctctgctcccgtgtcttcatgcaccctcctacttagagtgctggcgctcccaccccacccaccacctgcgggtcagctctcagtgtcttagttatccttctgagattttttttttttttaaatgagacagggtctctcatctgggtacaaaatagtttggggaaaaaagagataaggtctctgtcaccctgtgagtgacagaggtgacgacatgtgagatagtgactcatgtcactatcactctaggctggagtgcagtggcgtgatcatagctcactgcagcctcaaattcctgggctcaagtaatcctcctgccccagcctcccaagtagctaggactataggtgtatgccacaatgcctggctaattttttaattttttaagtaaagacagggtcttgccatgttgcccaagctggtctcggactcctgggctcaagcaatcctcccacctcagcctcccacagtgctgggattacaggtgtgagctaccgtgcccggcctttctgagatattttatgcataaaaagacatcacacctatactgcctccccaggatctgagaagaaagtccactttctttgtcacattctgctttttggagtttttcttctagtaggttccctttttcagatttttttcagatgtgaaaaggctccagactgcaaaaggaaaggcatcatgtgtgctggccaggttgggtcatgagacccactctcaaagcaggaaggagcaatgggaagagagaagggaggggagttgccgaaagcaggctattttctttttttttttttctttgagacagagtctcactctgtcgcccagtctgggagtgcagtggctcgatcttggctcactgcagcctcctcctcccaggttcaagcaattcttctgcctcagcctcccgagtaggtgggaattacaggcatgcgccaccacacccggctaatttttgtatttttagtagagacggggtttcgccatgttagccaggctggcctggaactcctgacctcaggtgatctgccttccttgtcctcccaaagtactgggattacaggcgtgagccactgcgcccagctccaaaagcaggctattttcaacacaaagcctacacgatcacccatgcccccttccccgggtagtcttaaggttgccaaggtcggttttgtttgttttggaatgggggtggttatttcactgtcattcatggttctcatccctgtgcttaaccaaagagaatgagatcaaatgctgtgctgggtccaagggcaggggttgccacagccttcccttttcagaggccttctgccctctgcaagctaggagtggtcatcgtcatcggcttcctggacagcctatgcaggtggaggggctggagaggcatctgtagtgcatttttcatcacctctggttatccatttgcctgacctttcctgcccagttttagttaaaatacagtggtgattctagtggctctaacaagtgagagaaaaaattaatctttacaggcctctgttctactgtcattccagtgtttgtccaggtgtggctcctgaccgtctgtgtgcctttacctggatgcttggtgaaaatgcagattcatggcctcccctccactcttggccttccaaatcagaatctgggagtgaaacccagaaatatgcattttcaacaagaatcctaggggtacattaaagttgaggacccctgttaagccgtgttgttgctttcttttccttcactctctggtctcccctcatctcctcttgtcacccctccttccttgctacccctgctcacctgtttgccccctccttcgtcttaatgctgagggtccggagcggcttcttggactattctttgaacatactaaattgcagtcctccagaaactcagctaggaagaaaaaaaagtacatatttcttattgccttgcttgtccccatttaaaaagccagataaaaaactgtcctcttcaagcaccagttttgggaagtgcatccttcccatggaggcatcccgattgcagctgctcttccaatgtaggagacggatctgggcttggaaatgcccttctctaaggaagcattgctggtgtgacatcccagggaagtcagctaccaccagccccaaagtagacactggcctgggtatcctagctggaaggcacaggtggtgaaggcatttgggaaacatgagaatgatgggacaggaagcagtgggggagcatggggtggcaaaggggaatgtttgcctggagtttgggcaggtgccaccagggacctgaacctctgcttttgtctttacagtgaccgaaggaagagaccaagatgaatgcagaggtgagttctttacaaagaccagtttaagggatgcttttcttattgtgtccctcatttctcctttgcagagtctccattccctttcagaaacatcagcacaaacttgagaacatttcccctctagcctactgaagtgcacgtggttctgggtgatgcaggaagaactaggcccctctgagttcttatctgtgtctgtctggcttcattcgaacttacccactgcagctaatcctgaaacaacactccctagctctggctagtagtggggcatggaggttgctgggcccagatccctgctttgtgttattctggaaacactttctctgcattgtctccttggtgctctcacttccagttctttgatgcatggagatgtctagctccttatccttttgttttttccttttgttttacccatcagccccttcctctgttcactcccttccaagtggagcctagaccttggggttcatcacttcagccactgctgtgctgacgcccactatgcttttcccacttgtcctgtccatccacatggcaaacacagaggccatccccacaagaggggggtcttgggtgagtggcacagccttgtgctgtttgcagctggcagatgtctcaacacccttatctggtgctcagcaccacccgccaggccccctgtcactctaggcagctccttgccagtgccctgaacccccagctccaggcttcatccctctccctaagctctgtcctcctcgaaggtccccctcactcttagcatcaggatcccttttcattttacagaggaaaatgtaaacattccatctgacatcatctccctcaattcctgcctctccatttgtcctgttcctcctgtcacagtgcaagggatgtttgtcagtgagaaagttccaggttgtgaacaccagaaagcctgacttaatgtggctttttcctggaagtccaggtgaagggcaggcttcagggctggtcgatcctgcggctcagtgactgcctcaaggatccaggagcttttcatctctctgctctccatccagctgttggttgcatcctagggcaggtgcccatgtggcagcaagatggctgcagtggcagttggggccacatatgttcgcattccctttcatcagcaggaagaagtggcttcctgcaactccttcaggggagtgggagcctttatttgaagccccatcaaatgtctccttcggtcttattggccagaatcaggtcctggaccatagtgtgtctgaggagcagggattttgtgattggcttcaactactcaggcccatcctggagcagcttcccccctgccccagggctgggtgtggaaagaagaaagggggatgtatccctgtctggtatgagacattcctggtccattttcatgctgctataaagaactgcccaagactgggtaatttaaaaaggaaagaggtttaattgactcacagttcagcatggctggggaggcctcaggaaacaacaattatggtggaaggcaaagggaaagcaaggcaccttcttcacaaggtggcaagaaggcaaagtgctgagcgaagggggaagacccccttataaaaccatcagatctcgtgagaactcactatcatgagaacggcatgggggaaaccacccccgtgattcagttacctccacctggctcctcccttgacacacagggattatggggattacaattcaagatgagatttgggtggggacacaaagtataaccatatcacctagtgacggtatacccttctcctctgaaactgcacactcctgcctgctcagaccttgcaccacctccttagttatctcctttgccatgtgcatcattaacctaattcccactacctctttctcatcgatatttcaaaatgctttcttcagaacaaaatgacacctcacatcttgtccagcaactgttatcctatctttctttttttaatttaattttattttattattattatactttaagttttagggtacatgtgcataatgtgcaggttagttacatatgtatacatgtgccatgttggtgtactgcactcattaacttgtcatttaacattaggtatatctcctaatgctatccctcccctctccccccaccccacaacagtccccggagttcgatgttccccttcctgtgtccatgtgttctcattgttcaattcccacctatcagtgagaacatgcggtgtttggttttttgtccttgcgatagcttgctgagaatgatgatttccagtttcatccatgtccctacaaaggacatgaactcatcattttttatggctgcatagtattccatggtgtatatgtgccacattttcttaatccagtctatcattgatggacatttgggttggttccaagtctttgcttttgtgaatagtgccgcaataaacatacgtgtgcatgtgtctttatagcagcatgatttatagtcctttgggtatatacccagtaatgggatggctgggtcaaatggtatttccagttctagatccctgaggaatcgccacactgacttccacaagggttgaactagtttacagtcacaccaacagtgtaaaagtgttcttgtttctccacatcctctccagcacctgttgtttcctgactttttaatgatcaccattctaactggtgtgagatggcatcttattgtggttttgatttgcatttctctgatggccagtgatgatgagcactttttcatgtgttttttggctacataaatgtcttcttttgagaagtgtctattcatatccttcgcccactttttgatggggttgtttgtttttttcttgtaaatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtccattttggcttttgttgccattgcttttggtgttttagacatgaagtccttgcccatgcctatgtcctgaatggtattgcctaggttttcttctagggttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcgggtttgtcaaagatcagatagttgtagatatgcggcattatttctgagggctctgttctgttccattgatctatatctctgttttggtaccagtaccatgctgttttggttaccgtagccttgtagtatagttagaagtcaggtagtgtgatgcctccggctttgttcttttggcttaggattgacttggcaatgcgggctcttttttggttccatatgaactttaaagtagttttttccaattctgtgaagaaagtcatttgtagcttgatggggatggcattgaatatataaattaccttgggcagtatggccattttcacgatattgattcttccaacccatgagcatggaatgttcttccatttgtttgtatcctcttttatttcattgagcagtggtttgtagttctctttgaagaggtccttcacgtcccttgtaagttggattcctacccattttattctctttgaagcaattgtgaatgggagttcactcatgatttgactctctgtttgtctgttattggtgtataacaatgcttgtgatttttgtacattgattttgtaccctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcgttatgatattggctgtgggtttgtcatagatagctcttattattttgagatatgtcccatcaatacctaatttattgagagtttttagcatgaagcattgttgaattttgtcaagggccttttctgcatctattgagataatcatgtggtttttgtctttggttctgtttatatgctggattaccgttattgatttgcatatgttgaaccagccttgcattccagggatgaagcccacttgatcatggtggataagctttttgatgtgctgctggatttggtttgccagtattttattgaggatttttgcatcaatgttcatcaaggatattggtctaaaattctcttttttggttgtgtctctgccaggctttggtatcaggatgacgctggcctcataaaatgagttagggaggattccctctttttctgttgattgtaatagtttcagaaggaatggtaccagctcctccttgtacctctggtagaatttggctgtgaatccatctcgtcctggactctttttggttgataagctattgattattgccacaatttcagagcctgttattggtctattcagagattcaacttcttcctggtttagtcttgggagggtgtatgtgttgaggaatttatccatttcttctagattttctagtttatttgcgtagaggtgtttgtagtattctctgatggtagtttgtatttctgtgggattggtagtgatatcccctttatcattttttattgcgtctatttgattcttctctcttttcttatttattagtcttgctagcggtctatcaattttgttgatcttttcaaaaaaccagctcctggattcattaatttttttgaagggttttttgtgtctctgtttccttcaattctgctctgattttagttatttcttgccttctgctagcttttgaatgtgtttgctcttgcttttctagttcttttaattgtgatgttagggtgtcaattttagatctttcctgctttctcttgtgggcatttagtgctataaatttccctctacacactgctttgaatgtgtcccagagattctggtatgttgtgtctttattctcattggtttcaaagaacatctttatttctgccttcatttcattatgtacccagtagtcattcaggagctggttgttcagtttccatgtagttgagcagttttgagtgagtttcttaatcctgagttctagtttgattgcactgtggtctgagagacagtttgttataatttctgttcttttacatcttctgaggagtgctttacttccaactgtgtggtcagttttggaataggtctggtgtggtgccgaaaaaaatgtatattctgttgatttggggtggagagttctgtagatgtctattaggtctgcttggtgcagagctgagttcaattcctgggtatccttgttaactttctgtctcgttgatttgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttatcattatgtaatggccttctttgtctcttttgatctttgttggtttaaattctgttttatcagagactaggattgcaacccctaccattttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgctcgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtggataacccgacctttctctctggctgcccttaacattttttccttcatttcaactttggtgaatctgacaattatatgtcttggagttgcttttctcgaggagtatctttgtggtgttctctgtatttcctgaatctgaatgttggcctgccttgctagattggggaagttctcctggataatatcctgcagagtgttttctaacttcgttccattctccccgtcactttcaggtacaccaatcagacgtagatttggtcttttcacatagtcccatatttcttggagactttgttcatttctttttattcttctttctctaaacttcccttctcgcttcatttcattcatttcatcttccgtcactgataccctttcttccagttgatcgcattggctcctgaggcttctgcattcttcacgtagttctcgagccttggctttcagctccatcagctcctttaagcatttctctgtattggttattctagttatacattcatctaattttttttcaaagtttttaacttctttgccattggtttgaatttcctcctgtagctcagagtagtttgatcatctgaagccttcttctctcaactcatcaaagccattctccgtccagctttgttccgttgctggtgaggaactgcattcctttggaggaggagaggcgctctgctttttagagtttccagtttttctgctctgttttttccccatctttgtggttttatctacctttggtctttgatgatggtgatgtacagatgggtttttggtgtggatgtcctttctgtttgttagttttccttctaacagacaggaccctcagttgcaggtctgttggagtttgctagaggtccactccagaccgtttgcctgggtatcagcagcggtggctgcagtacagcggtggctgtagaacagcggattttcgtgaaccgcaaatgctgctgcctgatcggtcctctggaagttttgtctcagaggagtacctggctgtgtgaggtgtcagtctgcccctacttgggggtgcctcccagttaggctgctcgggggtcagggacccacttgaggaggcagtctgcctgttctcagatctccagctgcgtgctgggagaaccactactctcttcaaagctgtcagacaggaacgtttaagtctgcagaggttactgctgtctttttgtttgtctgtgccctgcccccagaggtggagcctacagaggcaggcaggcctccttgagctgtggtgggccccacccagttcgagcttcccggctgctttgtttacctaagcaagcctgggcaatggcaggcgcccctcccccagccttgctgccaccttgcagtttgatctcagactgctgtgctagcaatcagcgagactccgtgggcataggacccgccgagccatgtgcagaatataatctcctgttgtgctgttttttaagcctgttggaaaagcgcagtattagggtgggagtgacccaattttccaggtgctgtctgtcacccctttctttgactaggaaagggaactccctgaccccttgcgcttcccgagtgaggcactgcctcgccctgcttcggcttgcacacggtgcactgcacccactgtctggcactccctagtgaggtgaacccggtacctcagatggaaatgcagaaatcacccgtcttctgcgttgctcacgctgggagctgtagaccggagctgttcctattcggccatcttggctccactatcctatctttctcatcccctgcaaggcaggcttctcaaaaaagatacctgcagttaatttctccgttttctcttccctgggtcattctcagcctgttgcagtctggtttcttttcccatattatataccgaaatgagtcttgtcagggtcaatgatgatctctgtaaattttataaaaatttattttgtaataatgtagacacatgttcatagtgtaaaactcaggctacagaatggaaaacagccaaaagtaagtctccctattacgttatcttgaccagccctgccccacttggggctgacttctggtaaccactttcttgtgcctctgacctccttatctgaaggcccctgtggctcaccctgtggcttgctctaattcttaggatcttttaagttctaaagaaacaatagaagctttgcattaatattaagcttatacaccctggtccaggagcagttccatcagtcatcagtgatctcttctgtcctttttgatggcttttcctcttaaccttgtaagaacatgctagacttgggtcctcctctgctgttccttacatatatatattttatattttttttctttttctttttttttgagatagagcctcattctgtcacccagctggagtacagtggcgtgatcttggctcactgcaacctctgcctcccgggttcatgcgattctcccacctcagcctaccaagtagctgggattacaggagcaccaccacacctgggtaatttttgtgtttttagtagagatggggtttcactatgttggccaggctgggcttgaacccctgacctcgagtgatcctcccacctcggcctcccaaagtgctgggtttacaggcatgagccaccatgcctgtcactcatctcagtcacagctgccacagggaccccaagcccgttataacccaggctgtactttctgctttcacctgccccaaatctgctcctcctcgaagggccatctgtgggccaggcgctccagtcccctcactctgttcccacaagccagcagccagtgaccaaggctgtaaatcctgtcattgccttgatgtagtcaccaatatttatgtgacaccatactgtaccagactctagacctggcttgatggctctaatggtaaaaatgtaagtgtggtactcatgctcatggaacttatcgctaagtgggaccaccatatctttccagtctgtcccttccttatcctacttcctgcctcctcatcacttcctcacttacctaattcttttcttcttctcctttgctttcctcaccctcctctaggccattccctctcccttttggaaggcagggggaagagacctcaggcacagggacggtccacacacccagttcctgacacattgcctctgttgtgctgtgcaaggccccgctctcagacttatttatattttattcattttctctccatccccattctcaccctgccaaagccaactattctaatgaattaagtggttttccttttttatttgtgtatgttcatgaaacattttgtttttgtgcaaataccttctaaatttatatacagtaggctgggcgccgtggcgcatgcctgtaatcccaaaactttgggaggccgaggtgggcggatcaactgaggtcaggagtttgataccagcctggccaacatggcgaaaccccatctctactaaaaatacaaaaattaggcgtagtggcacatgcctgtaatcccagctactcaggaggctgaggcaggagaatcacttgaacccaggaggcagaggttgcagtgagccaagattgtgccattgcactccagcctgggctacagagcaagactctgcctcaaaaaaaaaaaaaaaattatatgcagtaaaactgcctctttttttttggtgtagaggtttacccattaaaacacatatgtgtaaccatcaccccaggatgtcaggatgcagaacctcaccccaaaacattcttttctgttgcccctttatagtcacaacctccccttgctactgacccctggcaacatatatcacctcctgtgtgatatactttttttttcctgaaacagtctcacccttgtcacccaggctggagtgcagtggtgtgatctcagctcactgcaacctcggcctcccgtttcaagcaattcttcagctgcagcctcccatgtagcggggattataggagtgggccaccacacccagctaattttagtagagactgagttttgccatgttggccaggctggtcttgaactcctgacctcaagtgacccaaatgcctctcgacctcccaaagtgctgggattacaggcatgagccacagtgcccagcctgatatacttttaatgtacataattgtattttatatcatttatatctcattctccatttttctgtatgttaaagatatatagttaatctgctacacagcagcccagaatgtgcatccatttagtcctaacaaaaggcctaggagcaagatgctattattacccattttgtagatgaggaaaatgagcaataagtcaattgctgtaagtcacagggggttaaggagcatcacagagatctaagccctgatgtttttgacccatgaatgcctttgttcttgcctatatccagctaatcccatccatccagttcaaatgtcctttgtactgcacaaacagttttctcaagagtcctctctcgggaagtcatacctccctcttatgaatttccattgtgctttatgtatcttttctttcgttaccttcccctcctgctttgactgtagctgtcggggtgcctcgctcatcttagcatccccatggcatctgacttgatgcctcatgcatagcttatcttcactaattatcagttgactaaatgataggatgattcagagactgttaagtaatcttctaatgcaatccagagcttgggagggtcagtgaaagtgtagagaaaggaaatcatatgacagaaattttcaagcaaaactagttgtggcccagaggctggctggagggagaaagacagaagaaggaccatcggccacagtcgggctttgatcccaggatgtttgttgaatgcaggaatgactccaagcatttaaagctgggggctgccaggattcctagagctactggcttttgcccagaagttcagagtacaacctgtcaggaagggtggataattggagtttagcacacagcgtgaagatccagggcgcggtgggaaagccaggttgaaatgccttgggaatgcggcttggaagagaggatggcccacagctcaggatgctagggtctttggcatagaggtggtcatggaaaccctgagaatgagggacccccatattctggggacatgggagagagagaaaaatagagggatgaagactgagctttgggaaatatgcacatcttgggtaaaatgaagaaagaaagtgaaatgtgaaaagaaaacctcggtagcatgaggtaagagaagaaaggaaggagtgagtttgaagaaggtccaggtaagggtcactcatgtctgaagtccaggaggatgtggctgagaagaagcccttgaatgtgatgagaaggtcttggatgacccacggtgaagcagggaggtatgggagtgaaaaccaattgcagcagggccaggaggggtgagaggagtctggggcacttggggtcattggacagggcaggggcaggggcagcagaggactctgagcactgtagagggagctccaggaagggaagcgggagtgagccaaggcgctatacactgcagaattctcaccttcctagagcagccctctgatatttatgtctgttttcagtggtggtttatattttagatagtgaatacatttgtgtgattctaaactttaaagaggaaaaaaagaaaaaaaaatattttctatgagaagccttcttccctcctatccctgtttcccagccactctgtttttcttgctcccagcaagagcatgtcgccagtttcagtgttacaggtttctgggctgtcctttcaaagagattctaaacatagacagtatctttttcctttggctaccacccctcctgttactacacagactgtagcacacagtgcacactaggctgtcgtttgcttctttcacccgatcatctatcttggagaccagtccctttcaatatataaagggcttcctcgttcttttatttttatattgccatgtaatactctatatcacgagtctatcataactttcatagccagcctgttattaatgacatatagattatttccatcttttgcttgttataagcaaggctgcagtaagcctaagtcacttgacttgtgtagctctataggacacattatcttacagttggatttaccagaacaaagggcatttgcattttaatttgtaataaatatttccaagttgctctccataaagcaggttcttctctccctcctgcaacatatgaacatacctgtttccccaggccaaccaatgtgttatcaaacttttttttaattcttgcaaatagtggatgaaaacgactagtttgttctgtccaactgcctggactctccttccaccttttcagcacctgccctcatgcctcaccttgaagtttttctacagtgattttacattttcttctaccctctttatctcaaaaaaaattttttttctaagttggcagagcacattcctaactatgaactccatttttgcatctggagtgccaaacaccagcttctctgagtccaagggtgggggcgcaagctcactctgtgactgtgatttggacctaagtgagttttttagtcactttgctgtgcttatgtgtccttttctgctgtctcaaaactgctcctgttctttgttccttaaataccacctctatagggctatttgtagtggcattttcccaaaggttcaggatagcagagcacagcagacaactgaaaatggaactgtggatgtcctggtttctggaagtccattgctccctcctccactgggcgtttctcactggcttccttctctgcagattttagccttttgctaacctgcgtgcactttcccctttcctctgcctcctactggttcctagccccaaagttttagctgctactacagagtggtctagccatctctgatttgcagtttcccttcagaacgcaccttcaagatccctcatgtaaaatgaagaggctcacgttaaaaggcctaacaagtaatttttctcaaaaataaagttcttcccctaagagcagcttgactattaagataccagtgtcttcactcatatctttttttttttttttttttttttgagatggagtgttgctctgtcgcccaggctgaagtgcagtggtgcaatcttggctcaccgcaacccctgcctccccggttcaagcgattctcctgcctcaggctaccaagtagctggggttacaggcacccgccaccaccatacctggctaattttttgtatttttagtagaggcagggtttcactatgttggtcgggcaagtctggaaactcctgacctcaagtgatccgcccacctcagcctcccagagtgctgggtttacagacatgagctactgcactgggcctttcacccatatcttgtccctgtgtgtcagttttgcaaggcagtaatatcgaaaccaaatcctaaagcagtttataatttagcctgacacactgtgcaagccaggttttgtatgcaagtttgtgtgtatcattaactaatgaaatcttaaaaagcagtttggcttatttatagataatggagctgtttcttaaccttgtgccttttttttaagctggtagaagcatatcctggttattatctggaatgtagtaatacggtaaccttaagaatgccataaatatttaacctaataaggggattgctagtcttcttttcttgattgaaagggaaacaaatattaatatttgatcattaatatgtgttttggctgtacagatttctccagaggctgtcttactgctttttggtaattagaaattaccaaaaaaaaaaaaaaagaaaagaaaacaagactagtaacccaaaaaggacttacttggtgaaattgtcaattgtcagttgggcactgtggccactccttcctatactcttccctgacttccagaagagaagccaggaactaggtctcccagagtccccttttatatgtgaagtccactcccaggactcccaggaaacttgcaaggctgaagaaagagaggcagttagtcataggagacagttcagtcagatgtgtgagccaaggccagtgtatggtttagcagcagtggacagtcaggctctgtgaatcactcttcccaagctgcaggctgacagaggctgagatcctttccagacgtcttggcttctgggcaagttctggagaatctctcgcttcaatattgaattgtataacaacagtacaaggtctaggagaaaagaaatggaagtgtactgttgtcaggttctttatagtatatgtggaatagtgcataatattactttaaagtagactgtggtaagtaaaatatataatataaaatccttaacttctgaaaaagagttatagctaatagccaacaaatgggataaaatggaatcataataaatattctaattaatccaaaataaggcaggaaaagaggggaaaaagaacagattgaacaaatagcaggatttctatagaatttgaatggaaacccaaccatatcaataatcacaatgtaaattgtctaaacgtttcaactaaaaggcagagattgttagactgagtaaaaaaaagcaagacctaactatatgctgcctataagaaactaactatagctatgaaaacacatatagattaaatgtgaaaggttggggaaaaaatgtattatgcaacactgatcaacagaaattgggaatggattgttaatatcagacaaaataaattatagggcaaaaaatattaccaggaataaaaatggtcattttagaaagataaaggggtcaattaaaaaaaaggacataaccatcctaaacttgtatgtatctaataacagagttttgaaatatgtgggtcaaaactgatagaactgaaaggagaaatacacagttatatacaattatattcagagatttctctaccctcaataattgctagagcaaggagacagaaaatcaggaaggatacgaagacctgaacaacacaatcaaccaacttgatctaacagacttatagaacactccacccaacaatagcagaatacacattcttttcaagtgtgcccagaacattaaccaaggtagaccacatcccgtatcataaaatatctcaataaatctaaaaggattcaaatcatttaaagaatgttctctgaccacagtgggattaaatgagaaatcaataatagaaaaacatttggcaaatccccaaacatttggaagaaatcctggaaggagaagacaagagcagtgggcacaggaagaggggcagagtcagtgggaagtggtgacaactgggtacagaggtgaagaaaaggggcaaatctgagatgacattcatgtttctatgctcagaggcatccaagaagtgagtttaagggatgcatggagataatttttttttttttgagatagagtctcactctgtcacccaggctggagtgcagtggcgctatcttgggtcactgcaatctccgcctcccaggttcaagcaattctcctgcctcggcctcctaagtagctgggattacaggcgcctgccaacaggcccagctaatttttgtatttttagtagagacgaggtttctccatgttggccaggctggtctggaactcctgacctcaagtgatccacctgcctcggcctcccaaagtgctgggattacaggcgtgagccaccgtgcccagtgcatggagataaattttatcagtttttattatactgagttgctgtataacttaaaagtcagtttgatttttcactgtaatactgttcacatacagcctccagcagtgcacttaaataatatttaagatactgcagtatcttaaatgtggaactcagaaggctgtagtgaagagtcaaagcctctggatcccacgctgagtaaggtgaccaatcatggtttgcccatttgcctcctctgccagcatctgatgaagaagctgtgccctctgaatgactcccagtagtatcagattcatgtgtccactggaggagggacccagggagggcagaagtaccaggccatgggctgggtctgggttaatggggaaagctccctcattattggagatggggcagtagaagtggagagccaaattgggggaacactttctgtgggtactcggaaggttttcaacctaaagacatggtggagcaccttcaagaacaggttttggcgggactgacttctctccaagcccccatttcggggactgtctcatcccatcctgatgctgtggcttcctgtgtgttttgggctggcttccatcttgctcgtcgggaccctgccagctcctttgttttgtagttttctgctcgatgcctacagtgttttcagactccaccttggtcccttgtgtttcagcccgagaggaagtttggcgtggtggtggttggtgttggccgagccggctccgtgcggatgagggacttgcggaatccacacccttcctcagcgttcctgaacctgattggcttcgtgtcgaggtggctcacaatgtctttgtgcttcataattcatggaaagcccagtgaggcggattagctgcaggacatggagattttccagacccagggcagggagagccatctcccaactgagaactgtgcttagggtcagccccataagatctcaggttgggatgggtctgggaactgaagcttgctgggcctgcagctgggatgcacagtaggttggcctgggagactggaagacagaggcaggagggtgagctcaaggctgacagttagagaaggggcacagaaaacacatgcatggggctttggcctgaaaggctttcggtgtgcaccggggaatcctgacatagtcatcatgacagccatcctaggtggtcctgggctctacatgtgatatttccttctgcgtagtgttattaaccccccagtttacagataaggaggctgaaccacagaaaggttaagtaatctgcctgaggtcacacagctggaaagtctaagaactgaagttgagcagaagtctgtttccaaagcccatcttttaaacaccatgtgttcttttgccattggtaattttgagcctcacttttattattattattattttttttgagacagagtctcactctgtcacccaagctgcagcgcaatggtgcaatcacagcgcactgcagccttgaccgtctgggctcaagtgatcctcccgcctcacagctcaagtggtcctcctgcctcagccttctgagtagctgggactacagacacacacaccaccacgcctggataattttttttttttttttgtagagacagggtctccctatgttgcctagactggtctcaaactcctggggtcaagtgatcctcctgcctcggcctcccaaagtgctgagattataggcgtgagccagtgcacccagcctcccccttttctttaaggattcatttatctccagtcaaaatcaaacttatcaccttgtttcttcttcccccatgctcaaattttccactcacccctgtacacacacacacacacacgcaccactcaccagactaatcctgtataacatcatttgtcaatattaattgtgaactagatacaggcaccagactaatcctgtgtaacatcatttatccatattaattttggactaggtgcaggcactgggctgggcctgaagacatggtagtgagcaagttaggcaactctttttctagtgctttagagacatcagataaatatttacacaaagcataagtaacaattgtgatagtctatgtagaaattttttcatgttttcattcatggggccatcctcttccggcctgtctcaaaacatggccccacttttaaggatttaaaatgggcttggaagcaccagggagacccagaagtgctagaatctgcccttgggccagccttctcctccccataagattccaagggagctgcacacaaatgggagagcaaagttaagatcaggcagcaccgtaacccccatcgcacccctatctggagctgggaccacacacagcacttgggcgcaaggctgaaatgggacctttccttttcccttaagccccagtcctctgccagttggcttccagggtcagctcagtgggaacacctacactacccaggttgtatgggaggatggccaggtcacacccctgcatgacagccctgccagtactcacactgtttccctcttcacatacccttcccttcctgacctacctgctaagttctacctcctccccaggaagcttttctggtgtattcctttcccaccctgagtctccatctcctacttccaagcaccacatttctcctggtagtcttgtggtagtggtatgtacgtgtgtgtgtgtgtgtgtgtgtgtgtgtcttcctctagctgactgagctcattgaaaggcgatgattttaatttgttctccatgatttctcctacagcgcctagtacataataggcaaacaataagtattgctgaaattgagcaatttagtttgggtggccccattaaagaaacctagcataatactctttgggagctaaattttcctgaatgctttctgcctgctgcagctcagctggagctctgagcgggctgagggccttctgcttgctagctgtcccacattcccccatgactgccacccttagagggctactctcctgccccagccgctgcactgggaggtgtacggactgctggggctttggctcttcgaagactgcagctcccccatgctctagaagagtcagaaggccttgggttcccctcctgcttctgctcctggttagtcaaggctatcactgcctattatgtgctaggcattataggagaaatcatggagaacgaattcctcaccttccaatgagctcagtcggccagagggaggaagacacacacacacacacaaacacacacacagacacacacacacacaaacatgtgtgcgtacatactactgggcttcgttagcttagctataaagtagctcgaagtcgcatgccagtttgcaccctaaatgtgttaacgtattggatttggattaggtttggtagtcacaatgtttggccaagtgcttggaactggaagtgaccatagagatcacttctcatgagataaaagtagattgttccttttatttttatgttattttatttttgaggagtcttgctctgtcacccaggctggagtgctgtggtgcaatctcggctcactgcaacctccatctcccggattcaagtgattctcctgcctcagcctcccaggtagctgggattacaggcgcccaccaccacatttggctaacttttgtattttttgtagatacaggttttcaccatgttggccaggctggtcttgaactcctgacctcaagtgatccacccacctcggcctcccaaagtgctgggattataggcttgagccaccgcgcccagctgtttcttttgttttggagatgaagtaattcaagactctcccaggtcatacacgctgtgaatggtactgttggcactcaatgccagatcccctgacttgaactctgaggctatttttctcactccacaatggaaaatagcctggaagtgggagagaagaaactcatttcttcatttctggcagcagatcaccaggacctgtcgggaggaggggagaaggatggtgctcctttcttctgtctaccattgagttccatttctctgttactctgaaatagaagggagctcgggagcattgatggagtccagcagatttctttggaggatgctctttccagccaagaggtggaggtcgcctatatctgcagtgagagctccagccatgaggactacatcaggtgggttttccacacaggcagtccttgccttacacagcagtgcagtactgcaaaaatgagcaagcaagctaaaacaccctgcaaaggagtcagaagagccagtgagaaaattacaattgctctgtgaccaatcacagaagtgtcaaaacattaagaaattcttattgctggttataaatatataaggaagtgaaaaatagtaaaattaatatttagtatgtgtaatttgaaacattagaaacattcagaattaaagtgttttatttctctgtaaaaacccatcgagagtagttttcaacagtagtggcctccttcttctcaccagacagtttaggatgtggagccggcatccttggcaaattatcatactcccttctcagtttggatcagcttccaacgttttctcctttgtgctttcaatgtcataaaataacggttgagttcctttaaccctcaggacctggcagctaacagggaagtgccagctgccttcctcagtctagcttccttctaggttcttacagctgctcccaccatgctgtttcccacgggtaagatgcttcctctttatcagtctagctctagagtagacaaaaacacctctccttggctttccttaaccttttctggcaccagagtgtatttccttaagaaaagtgattctgacataagtcccatgcttataaatatttgtactctggtatccacagaatgaaatctgaactgctgagcacagaattgtaggtccttcacagtcaggcccccagctacttttccaacgttattatcctccacggcctgtagtccactcccctgccacactgaagtttgccgattgaacaaagccccacaaatgcccaagcccctgcatacgctgctcacagtgaaatatactcacatgttgcacctggaaaatgtctgctcatactttgagacccagttcataggtccttagtgaaatcttttcagactgcctcaggcaaagctagccgctgtgggttttgtagcctttatagctaccatgtggtgataggaaatttatttgttaatgtgtctttatttctcctccacagtaattggtaaatagtacttagttgaataaatgaatggttgaatgttcaaattaacacataaccagaaagttgatctgtcacaggatagtagaaaacaatgtgggatacagttcttcctccatatcccgtggcactgactcctacccccagtcatgacacattcacacacagaaactctcatgcctttataacattctgttctctattatgcagagcatttcagtgaagcttattcgaagtgttctttctctgtatttgtctcgtttaccaaaggcagttccttaatgctggcaagcacgtccttgtggaataccccatgacactgtcattggcggccgctcaggaactgtgggagctggctgagcagaaaggtaatgtatcttaccaagagtttctgcctccaggatttctgtgatatcatctttatgcctttaaaacttaaccccatttcagatatctcctcctcctggctacactggcactgtgggctcccaactgcctcctcacccccacactgtaaacacagatagtggagggcagaaggatgggtgggaatttgcaaacttttggtcaaagcttatcagcttattttactcactctaaggaaaaaatatgaattagttttcacctatgcttatgtcatgatattattttggctttattcatgtgatacttatattgctaaatgctgggatatcctaaaaatgctcaaatcagagaaactgattgtcttatttgcatagtttgtagtttttgttgtttctaaacaggaataaccatttattaaatatttagtatatgctaggaacttggaaactctgctaagcacttcatatgttattttgcttaattcttctagaatcccttggaggtatatattttctctagatgctgtatagaaaaatatggctcaaagaagttaatttgtgccaggtcacaaagctaataacatgactactaagtgggaggtagagattttaatcaaatcctacagggctcttaagttcacatttgttcccctaagccataccaccctccagaagggagaaattaagactttcccaggccagacgcagtggctcatgccctgtcagcccagcactttgggaggccaaggagcttgggacaaccctgggcaacataatgagaccctgtttctacaaaaatcttttacaacttttttttttttttttttggtggggtacagagtcttgctgtgtcacccaggctggagttcaatggcaccatctcagctcactgcaacctccgcctcctgggttcaagggattctccttcctcagcctcctgagtagctaggattacaggcgcccaccaccatgcccagctaatttttgtatttttagtagagatggggtttcacgatgttggacacaatggtctcaaactcctgacctcgcgatccacccacctcggcctcccaaagtgctgggattacaggcatgagtgaccgtgcccggcatacaaaatttttaattacaagaaaaaaaaaaaaagactcagctgggcacagtggctcacacctgtaatcccagcactttaggaggctctgatggatagattatttgagcccaggagtttgagaccagcctgggcaacatggtgaaaccccatctctactgaaaatacaaaaattaactgggtgtggtggtgcataccggtagtcccagctacttggaagttcacctgaaccttaggaggttgaggctgcactgaaccatgatcgggccactgcactctagtctgggcaacagagtgagaccctgtctcaaaaataaaaataaaaattctttaaaagacctacccagacaaacaaaaaccaagtgagttgatcactactagacctgccctacaggaaatgctaaaggaagtctttcaagttaaagtgaaaacactagacagcaacacaaaaatattgctctctggtaaaggtaaatatatagacaaatacagacttccgtagtattgtaatgttgacatataaatcactttaggccaggcacggtggctcaagcctgtaatcccaggacttggggaggccgaggcaagcagatcatttgaggtcaggagttcaagaccatcctggccaacatggtgaaaccccatctctactaaaaataaaaaaattagctgggcgtggtggcgcttgcctgtagtcccagctactcaggaggctgaggcagcagaattgcttgaacctgggaggcggaggttgcagtgagctgagatggtgccactgcactccagcctgggtaacaccatgaaactctatctctaaataaataaatatcactttaaatcctggcatagaatttaaaagacaaaaaaatacaaactatgttaatggatgtatagtataaaaagatgtaattggtaacattaatagcaaaatggggggtcagagatataaaggagtagaattttgtatgtgattgagttaagttgttagcagtttaaaatagattatgcagtcgggtgtggtggctcatgcctgtcatcccagcactttgggaagccgaggctggtggatcacctgaagtcaggatttcaagaggagcctgggcaacatggtgaaactccgtctctactaataatacaaaaattagctgggcctggtggcacgtgcctgtaatcccagctactccagaggctaaggcacgagaatcgcttgaacccaggaggtggaggttgcagtgagccaagattgtggcattgcactttagcctgggcgacacagtgagactccatctcagaaattaaatacatacataaataaataataaaaatagattgtgcctgtaatcccagcactttgggaggctgaggcgggcgaatcacctgaggtcaggatttcaagaccagcctagccaacatggtgaaaccccatctctactaaaaatacaaaaattagccaggtgtggtggcgcgcacatatagtcccagctactggggaggctgaggcaggagaattgcttaaacccaggaggcagaggttgcagtgagggagatcgcaccactgcactccagcctgggcgatggagtgagactctgctcaaacaaaacaaaacaatacaaaactgacaagatgtaatgaaagcagtactaagagagaagtggatagttgtaaatgcttacattaaacaagaagaaagatctcaattcaacatcctaactttacatttcaagggactaggaaaagaagagcaaactcaatcgaaaattagcagaaaaaagcaagtaaagattagaacataaataaaatagagagtagaaaagcaatagaaaaaaatcaacaaaaccaagtttttttgaaaaaaatccataaaattgacagaattttagcagattaagaaaaaaaagagtcggccgggtgcagtggctcacgcctgtaatcccagcattttgggaggccaaggaggacagatcacaaggtcaagagtccaagacctgcctggccaaaatagtgcaaccccatctctactaaaaatacaaaaattagccaggcatggtggcacatgcctatagtcccagctactcgggaggctgagacaggagaatcacttgaacccaggaggtggaggttgtgctgaggggaggttgtggtgagccgagattgcaccactgtactccatcctgggcaacagagcgagactctgtctcacaaaaaaaaaaaaaaaagaaaagaaaagaaaagaaaaaaagagtaaagactcaaactaaagtcagaagtgaaagaggagacattacaacaaatgctgctgaaataaaaaggattatatgagactacaatgaacacttatacaattgttatactccaacaatcggataatctagaaagggataaatacctagtagcatataacctactaagactgaatcatgaagaaacaaaaatctgaacagatttataactagtaaggagattgaaccagtaattaaacacctcccaataaagaaaagcctaaaaccagatggcttcactggagaattctaccaagtgtttcagtctcttcaaaaagtggtcccaggaaaacaggatatccacatgcaaaagaatgaagttggacacttaccttacaccatataaaaaattcactcaaatggattaaagaactaaatttaagacctaaaactgtaatattgttagaagaaaacatgggaaagcatcaagatattggatttggcaataatgtcttacatacgacatcaaaaacacaggcaaaaaaagcaaaaaacagacaaatggactaatcaaacttaaaaccttctgtgcctcaaaggaagcaatcaactgagtgaaaaagcagtctatgtaatgggtgaagatatctgcaaatcttatctttgataagagatcaatatccagaatgtctaaagaactctacaactcaacaacaaacaaaccaaataaactgattttaaaatgggcaaaggacttggatagacatttttctgaagaagttattcagacggcaaacaatcatatgaaaagatgctcaataccactaatccttatagaaaatgcaaatcaaatccacagccaccgtcagtaaccaccagcatcagtcagcagccatcaacatggaagcaagaccttccttcagcaaaaagatggaggatcagatggtagcattttttgtttgtttttgttttttggttttttaagacagtctcgccctgttacctaggcttgaacgcagtggcgcaaacctccgcctcctgggttcaagtgattcttgtgcctcagccacctgagtaactgggattataggtgcacaccaccacacacagctaatttttgtatttttagcagagatggggtttcgccatgttggccaggctggtcttgaactcctggcctcaagtgatccgcctgcctgagcctcccaaagtgctggaattacaggcatgggccaacatgcccagctcaataacgtatttttaaattaaggtacgtacgttgttttcctaaacatagtgttatcacatacttaacaaactacaatatagtataaacataacttgtgtatgaaccgggaaactaaaatattcatgtgactccctttattgcaatattcactttattgtggtggtctggaatgaaacctgcaggatctctgaggtatgcatgtaaccgcatacaaccatcaaaatctggaaattggcattggtacattacaacaatctaatcctcaaacctcattcaaatttcaccagttgtcccaataacattctttatggcaaaatgactgagttcaaaatcatgtattatcttttattgacatgtcacttttagtgtccttcattctggacagttcctccatcttttcttgacaattatgaatattacagttagttattgtgtaaaatgtccctaaatttgaatatatctgatgtttcttcatgattagatttggggtatgcatctttcacagaaatagtatgcaagtggccaggcatggtggctcacacctgtaatcctagcactttgggaggccaaggcaggcagattacttgaggtcaggagttcaaaaccagcctggcctacactgtgaaaccccgtctctactgaaaatatcaaaaaaattagccaggcatgatgtgggcacctgtaattccagctactcgggaggctgaggcaggagaatttcttgaacccgggaggcacagtttgcagtgagacgagatcgcaccactatactccagcctgggtgacagagggagactccccatctcacaaaaaaaaaaaaaaaaaaaaaaaaaaaaaggaaacgatgctgtttttcacattgtgttctgtcaggtaacatccaatatcagttcatctaattactaatgatatcacttcattaggtggtgtctgacgggcttttccactgaaagttactttttttccctttgtaatcagtgattattttgtgagaaggtagtttataactagttaaatatccattctcatcacactgtctgatattcatttattattttatatcagtagaaactcatagctttgttttgtttttctattcagtgctgttgttactttttattattcatattgatgtccacattgttccaaatttgctcagtggggaacctcttcctgccagctcccttgtcattttgttatgtttccattattctttgaattcttgctttctggcacaaagtggttaaggctcatcttgtactttctctgcctcagccttggaattagtcagttctccaatggctaataacgttttgatggcaagatttggacactgcttgtgcttatggctttgggctatctctgcaagccctttcagtgaacagacctgggaatatatggatacggatgtgtgtgtgtactgtggttaccatgtgtgtttatcacaatcaggcattgagtgaacgacaggaaaacaacaaaagacacagctggaaaatacatagtttctttaataaccatggatgtggaaacacagagactgttacatagtgctggggaaaatataacatgttccccagagtttcacggtggggtggggggcagtgggcgaaactacctgtgaggagaaaagcttgtacttattgcaaagcattttgtgccatttagttgttgcaaagccattttgtgccagaaagcttctacttatcacaagaagttccttttgccacattcacgtctgaaggagtgggtgggaaggaccccatcctcccacacacctgacatttctggagactcctgcgacagacatcctccttgctcctgaggtgcaggtcaagcccagagcatttggcagtatttgctgtgatgctgggttagacaaaggcaaccgtcccaggagcatctcccactgacccagatttctgtctgtttcagtgaaactgtagatcataaccacactttgtacttaatcacaaaatagttctggtgttttaggaagcttttggcctagaaatgaaaaaatttttatagagcgaaaaaattttatatagcaaaaaaattgttaacagctttcttttataatccaaaatttattttattttatttttatttttattttttgagatgggctgcagtgcactggtacgatcttggctaactgcaacctccacctcccaggttcaagtgatcttcccagctcagcctcccaagtagctgggaccacaggtgcatgccaccacacctagctaattttttgtattttttgtagaggccaggttttgccatgttgcccaggctggtctcaaactcctgagcttaggcaatccacttgccttggcctcccaaagtgctgggattataggcatgagccaccaagcctgggcacgttcttactctgttagatttttatgctgcactgcctcctcctgtctagaacagtagctaactgtctcctggcccacagacacatccctgatctcatcttgcctttggacacaggtagataccatcttgttctcttaaattttcatttcatttctcaggttttcgtttcattcatttctctttttttctttttctttttgaaacggagtctcactctgtcgcccaggctggagtgcagtgatgcaatcttggcccactgcaatttctgcctcccaggttctagtgattctcctgcctcagcctcccaagaaggtgggcttacaggtgcccaccaccacacctgggtaatttttgtatttttagtagaggtggggtttcaccatgttggccaggctggtctggaactcctgacctcaggtgatctgccagcctcggccttccaaagtgctgggattacaggcatgagccaccatgcctggccttcatttcattcatttctgttgtaagcttagaagtagcagcctcttcagctggggtgggtgacagtggtagggaggccatcctggccatgtgcccagggcagttatgagtgcttcatgtcttgtgttaggggatgacagagtaccctctgggatgcacacctagacacaactgacgactgccctttttattccatttttgtcgttacaggaaaagtcttgcacgaggagcatgttgaactcttgatggaggaattcgctttcctgaaaaaagaagtggtggggaaagacctgctgaaagggtcgctcctcttcacaggtcagtgctacgtgggatcacaggtcacatgtgaggtccaaagaccagccagattctttcctggctctctgggatgggagcttatattcatttctgctcaagactctctgactcagggccacttaattttcccagatgggatttaattccttggtggcccttgggtaaagagtatgttagaaatctcaagcatatttgtgctctgtcccaacctattaactagttggagattatttttcaacaggaagttgtacattaaaactcttttaaaaggatgagaggtgcttggagaggagaacatttttatacttccttgcaaagcaaatataatatgaagagctcccttcctcctctagcaagttacaaggacattggcagcaaccacagtatttatttatttatttataataaataataaatatttacttattctgttcttactctgttgcccaggtcttactctgttgcccaggctggagtgcagtggtgcaatcatagctcactgtagcctcaacctcccaggctcaagcagtcctcccacctcagccttccaagtagctggaaacacagatgtgcgccacaatacccagctaattttaaaatttgtgtaaacagtgtctccctatgttgcccagcctcatctcaaactcctgggctcaagtgatccacctgtcttggcctccaaagtgctgggattacaggcatgagccaccgtgcccagctgaccacagtatctgatctgtatttgtagctgtttacttgatgttggtcactctttgagcagctccgttagcaataggaaatgggcatgcaggaagctcctgctcttgtggccacttttggatgggctccttctctggccgtatcgttgggcacctgggccaccattcctgagggctttcattacagaaaggagaccctgacatggcctggcatttttgcacggtaaagccactgatacatagtagaacctcatttcaaaatctgtcttcatccttgaaaatggtaatataatgagagtacaaaccattaatttgtacaagaaactgtgttaagttaagtaagttaagtacaagtaactgtgatgtgcattaatccatatgacaatcctataaagtggtattcactacccccattatacagataaactgaagttcagaggcatgagtggcttcacagaggtaacgtagcggtcatgagacagagctggattggagctcagctctctaagtggctggaactgttgtgggtggctgcttagtattctgtccaaagaactaggctgggcatagtggctcacgcctgtaattccagcacttggggaagctgaggctggtggatcacctgaggtcaggagtttgagaccagtctggccaacatggtgaaacaccgtctctactaaaaaaaaaaaatacaaaaattagtcgggcatggtggcacgcacctgtaatttcagctacttgaaaggctgaggcaagaaaatcgctttaacccaggaggcagaggttgtagtgagccgagatcgcaccactgcacagcctaggtgacaacgagactctgtctcaaaaacaaacaaacaaacaaacaaaaaagaactagagcagacagtaaccagccctggggaagtctttttgttttgtaagtttgatacttaggccccagtgatttcaaaccatattgtctatgaaaattctaatttttgtttggttttatatataacttattactttttaagaatatactcattgttattagtcattgttttaagtgaatatcaaggtcataagaaatgttttgtttataatgtaatgtaacagatatgaagtcttttaaacttaggttatgtttaagattttggctggaggcagacgggagcagtatcttgaccaaatggatttctcacaccaatactcttttttatgtttatatatatatatttttttgatatagggtatcactctgtcacccaggctggaatgcagtggtacaattatggctcactgtaacctcgaactcctcaggcccagatgatcctcccaccttagcttcctgagtagctggggctgcaggtgtgcaccacgacacccgcctaattttgtgtgtttttttgtagagacagagtcttgctatgttgcctaggctggtcttgaactcctgggcgcaagcagtctgccagccttggcctcccgaagtgctggtattataggcatgagctactgtacgtggcctttttaggcttactgcaacctctgcctcccgggctaaagtgattctcctgcctcagcctcccaagtagctggggttacaggcacccgtcactatgcccgggtaatttttgtatttttttttactagagacggggttttgccatgttggccaggctagtctcgaactcaagtgatccacccaccttggcctcccaaagtgctgggactacaggcgtgagccaccacgcctggccccaatactcttttgagtgtacttttttgttcacaagattaggaagactaagaaaacatttaacattgtatcaattttcttgatattgaaatagctcaaaggtattaccattttctccatagctattataataccttcataccttattgccacttacacatcaggtagttataagaatacaggcttgcagggctaaaatactttgattcttctacttttaccagactactttaaatcactaaagaggatatatatatatgtatatgtaggtatgtgttgtgtgtgtgtgtgtgtgtatgtatatctacatatgtgtacatagatgtatatattagaagcctgaaacttttttattatcctgtttggctggattgactgctgtttccagtagaatgttttactaaaactcaatttaataaacaggaaaagacagagatgcttttatgatagagttgaagttcagccacctgagttttcatcagtatcattaatcacgttgcctgcctaccacataaggcaaggtcccattgtactgatcactcggccacatcttttcacacccccgccacccccacccccctgtcctgctttccacttggcattcctgcttcccagttcccacagcatttgtgatttcccacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtgtgtctggagacagagaagaaaaggtaagtcatgagaagccatgaggaggaggaaatttaaggacatcctagtacatttgcaggtatgatccaaagggagccccgaggggctagaccctcactcccagctccagaagggctgtctgcttctgcagatggagtgctgagattgcacttgtgttgcctcatctcatcctctcagcagccctgtgaggtaaagaagacaaacataatcccatctgccagtcagtagacagaggcttacagaatgccagcaggttgcctaagtcatgcaagtcattcatagcagattagtagtggaaattacattaccttggctgggcgtggtggctcaggcctataatcccagcacttggggaggccaagggtggtggatcacctgaggtcaggagtttgagaccagcctggctaacatggtgaaaccctgtctctactaaaaatgcaaaaattagccggtgtggcggtgcatgcctgcagtcccagctccttggcaggctgaggcaggagaattgcttgaacctgggaggcagaggttgcagtgagctgagatcaggccactgcatttcagcctgggcaacagagcgagactccttcttgaaaaaaaagaaaagaaaaagaaattatgttaactctgtgacctgatttttttcctgtgttttcttatgaaagttttcgggcatattgtgaagttgaaagaatttttaagtaaacacccatccacctactccctagaccctgccattaacactgtacatgttccccgcagggccacacattcacccctcagtgcagccagagtgtgagggtctgtgtttcagctttagcatcccatcaccctgtcacactgttcccaaaacattctgacttatttctcataccaggtcttttttaacaaaagcacattcataattttcctcccaaagcacctgggctctgtaaattatttagaacagtaagggttttagagtgtttctggatgcctttgcagagaggtgggtctcctggtagtaaaagaagcagacactgggtattttaaaaagaaaaaagaatttgagttcctgaatgaagcctgatctagtccattttgaggagtttcttcttcgctaggaaaaggcagagaggcctggcagatgaaagcaaagcacatggaacttggcagtgctccctatggagtgaccaacagtggtggcccgggctctggtgtggccatgtgagtgttaggattgcagccgtggtcagacctatacacagacagttgtagcaccctgtaattagaggtaaagatactgtagggtgctgtaggagcacagggaaggggaacctggactaggtcagctcatggttctgatgggaggcggtgccttgtttggtcttgaagttgagtagaagtcaatgaggaagcaagatgttggggaggcagaggctgactctctctctcttttttttttttttttatgagacaaagtcttgctctgtcacccaggctggagtgcggtggtgtgatctcagctcactgcaacctccatctcccgggttcaagtgattgtcctgcctcagcctcccgagtagctgggattataggcgcctgccaccacgcccggctcatttttgtattgttagtagagacaaggtttcaccatgttggtcaggatggtcttgaactcctgacctcaagtgatctgctcaccttggcctctcaaaatgctgagattacacgcatgagccactgcacccagccctggctctcatttttgcacaggagaggcaagcatcagatgagggattgggacagagagcagttaatataatataatagtaacttcttaaaatcatagtactttccgtgtcccaaattgcatttttaaatttttttatctatttatttatttattttgagaccgggttatgagactggctgattttcgtatttttgggtaagatgggtttttgctatactgtctaggccggtctcaaattcctgggctcaagcgatccacccacatcagcctccacgcctggccacaaactgcatttttatctcacaatgtcacagcaagataggtaaagctgtatacttattaccattacttatttttactagtgaggaaattgaggtacaagaaagatcttgacattctgcattccctcaaatcccaagattccatattatttaaaaggacatgagaggccgggcacaatggctcacgcctgtaatcccagcactttgggaggctaaggcagttggatcacctgaagttgagagttcaagaccagcttggccaacatggtgaaaccttgtctctactaaaaatacaaaaattagccaggcgtggtggcaggtgcctgtaatcccaggtactggggagcctgaggcaggagaatcgtttgaacctggaggcagaggttgcagtgagccgagattgcaccactgcactccagcctgggcaacaagagcaaacatctcaaaaaaaagacatgagaaattttcttaggcagactacgtagaatacctcaagtttatttttattcagtgccaaaataaaagttaatctttgttgccatctcccagaacatttgctagactgtactatgagcttttaaaactagtcatgggaggccaggtgcagtggctcacgcctgtaatcccagcagtttgggaggccaaggcaggtgggtctcttgaggtcaggaattcaagactagcctggctgacatggcaaaaccccatttctactaaaaatatttttttaaaaagtagccaggcatggtggcaggcgcctgtaatcccagctacttgggaggctgaggcaggaaaattgcttgaacccagaaggcagaggttgcagtgggtcgagattgcaccactgcactccagcctgggtgacagagcaaggctccatcccagaaaaaaaaaagtcactgaatgaattcccctgcctgatggcaaaattaaattaaagactgtttggctgtgaggttgacacagtcacccacagcctctgggaggctggtggctgcaaggaggatgggtgcctgacaaggacatgttaccaggcggtctggtgccagcaagcacccacttgtgctcttgtgtaatctctaacatgattcttttgtcttttgtctttgcagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttccaagatggcaccagcatttggttcttctcaagagttgaccattatctctattcttaaaattaaacatgttggggaaacaag

SEQ ID NO: 36482 - DNA, 48668 bp, Homo sapiens; identical to SEQ ID NO: 36481

SEQ ID NO: 36483 - DNA, 331401 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagtaagtgtctccgcttctcacccacctccgccttcacacgcgcgcacactcacgcacgcactcgcacactctgggagacacagacactctccgcccggggagcgccgggggtgggctggcagggggaggggtgccgcgatgggggcgtgtggtgcggggagctgcgctttcccgggaggtgcgggcgctgggcgggcggccgcagggggctgtcggcgggagggaccgggtgtgttgaggggcggcggtggtgctggtggcgaggatggaaacttgtttgggtgattgagggaaataacccgcgggttcaccttccaaagtaactttagagctggggtccggggctccggggacctggggagccgccgggggtggcgggaggggcagctgcgtggaggaaggcgcgcagtgggaatgtgggtgtttggcgggccggccggggtcggggccggggtcggggcgggcagcgcggggagcgcggcggcgggggcctgggcgctggggcttagggccgcgagcgcggggcgaggcgaggcgagggcggcggtgccgggcgcgcggcgggcggaagccgggcgtggagcggccgagcggggccccgcggggcgcggagacgcgcgcggggcgcggagggcgtgtgcgggttgggcgtccgggctttcctgggccagctacggacgcggcgcccgcagtcccccgcgcatcgcggggctggggctggggctggggcgggggcgggggcgggtgggcgccggagacgccgccgaagtttgggagtcggagagggaccgagttcccggggagctaaagtgtgttggcgaggagcgggatccgctggaggaggctggcgtttctgcctctcgcagcggacccaactccgcggcggcggctggcgaactttttgtgaggctggcagcccccgagcggcgggaggggcgggcccggcggggcggtggtcgggggcgcgcggaggggagttgtgggagccgccgggggcgcccgaggagggcagctgtggcggggagggccagtggtccgaaaaggggtttgtgggaggggagaagcgttcaggtgggaaggagccgcttggttacagttgtggggagatacaggtgttaacttcggtgggagcccaagaggcggctggcgagaacagagcccctcccggcccgggatgccactgtcacggcacactgcaaagcaaagcggtttgctgctattcttgtgtacttgtaacggtgatttggttgttactaaaaatgagaacgaatagtgactgtgatcactgaggaagaaccccccccttttttttttaaactgtgcaacagatcagtgattcccagtaaccacttaaactctgagggtcagagttatccttgtcgttgaacgcaccctgtctttctgagggggttcagaccagagaaaaagtctgagagcatctctcaaaggtactttggttaccttgcgcacagaaatagctgcgtaaataaaaaccgaatgcgcaggcgactgagtttccctccttggtttaggcagttagtctccccctgaaagttttgtgtgccctagggatgggaacatttcctaatctttgtgttggcagcaacacactcaattcccataggatttagaggtatcaggccttgatgtagcaaagcaaaacaaaacaaaacaaaaattagagaggcttttttgtttttttgcaagagatattttctgagctgcattcaggatcttgttgctgtgacaagtagtatataaaagacatagcgttatagcctggttaagaaacggcagttactagaattgaagttttgaaatgcagtctcatttgtgtgcattaatcattttgttataatgtgcctgataaaaacatctgaaggaggatgttttaatgatcacagaatatttgaatttcacattagtcagagtgattgaaatgtattgaggcatgatcttattttgggggtgactgaatttgagaatcaaagtaattttagattttaggtgaacttccaggaaggggtgaactttagttgaatcccactcagtatcctgaggactgcttgatttttttttttagtttctcagataataacaaggatgttggaacttgcataactgtggtcctttctagctctaattctgtgatttcccaccaggaaaacaaataattgccactttgctgtcaaatctaccaaactgaacaccaagtaatatctactctcgtgagcagatcagggttctgctagatggtgctatttgatttaaatatatttcttccattcatttcaattggcagcaggaattcttgactggtttgccttatgaacttaaatataggtgaagaggccgcttttggagaattgacaatgactgttctgggttaattgtcgttgcattaatttctaggttaatgttgtttgaatctaagacaaacatcgacgtaggttctgtcttatagaataaacttaatttcatcttggtgggagagttgatctaatctctcggtttttctctttatgtttacttgggactttaatggcactattctgcaacaatgtactaacatctgaaggtaggaatcttgaagtcatcattaaaatggatgtcaccagatttttgttcttaatttttaaggtaacagattataaaaggtgaagaattctcctttagtaagcaaattagaactgttcttatcttaaaaatcacagaaataatttgtttctgtaacaaatactcattttaacaaaaacattctgcaaaaggagtcattattataaataatagcatgcttaggaaataagcacattggttttataatcaagaaatgtgttttctaacatgagttcatggtgaatagttgacaagtgcttacctgtattagatctttgttttgtctttcattaggaagtcactatatgaaatatttgaagtgaattattggttttacacaattcctgtaatttcagtatacagttctgataaaaatgatcagggtaagattagttacttactctgtcattttaagaaaagcagatcaagtcttaattatagagggagtgattgaaaacccttggagggaggtgggatttagaaattttaattctgatcttgttaggtcatttcttcctttagcaggctttctttataacactaatcgcaattgtgattaaataaccgtgattggctgtttaatgtttaactttccctaaaatataagtttgttgagggtaggagataatctaatttcttctctgaggtatcttgaacattaaggtgccttctaataccaaaagcatcaataaattattgttattgaagatgttagactcaaaggaattttttcaatgtaaaaaaattttttttcagtgacctccaaaataaggacttgtaagtttgagtttcacattctctagcttagttgtatttcagaaatacccctaaacaacaatacaacaaaaataactattatttatttgccatcctgtgtgccagtcactatgttcagtgttttatgtatatttttttcttaattctcccaacaaatctacaagacagttgctttttttttcctccattaaagaaatatgaaaactaagaccctgaatggttaaagaactcaccgagggatacaatgctagaaaacaggaaagctgggtttctaacacagatttctctaactttagaacctgtgattgaagctgaaagatacatttttcagtgtaccagattgtcttcctgaactagggtaggatgctacagatttagggaacagcattacataatcagatgtgacagactttaaagatttgatcaaatatgcagtcttaaccactggtgcaccctgatgctttgcagatctgtgtatggtgtgggagaaggcacagaaattttaggaaagttggaagcctaacataatgacgaaaacttgtttcttcagattccccccccccccaggaattttgtttgattgcttgttttaaagttaaacataatagttgtgaacaattcctatatgaaatgttgctgaacttaaagccacacagtatgccacactaccgcagaaagagtaactggcacctgcaaatagatgagtagtgatattaattttttattaaactaatttgatcttttatgtaaagcacagaaagatgaatctgctagaaagcaaagttgaacataaaagatacacataatatataccgacttttatttagtaaactagccagaaactacaagaatcaaactgtctaatcttgagctctgaaaagtaactttggcttttaaattttcaatgttagttgaatataccaagaagcaaataccatatgcttatttcaaagtagttacagtataatgaacatttaaatgccacttcatataaaagggattaatatctgccagcatcaccttgttctccccttctaccattaaagtaattaaagcattcccccatcattaaggtaccccctgcaaagaaaaatgacaaacctttctttctttctgaaggaataaggcaagaaaagtaatagagatctcttcagaaacttacttgacagcaattcgcacaattcaggatttccaaaactaatgaaggagtatcttatggaagtgaaattttgtgtaaaatattaaattgcccctccccctttcagtctccaggatgttcccccaaaatacaagttgtttaacttgtatccgaaatgtcatgttagcttttgattgatctttttctgttatttcagaagtatcaaaaaaacccctatttttaaggaacatatctaaagaaagaatctgtgtaagatgttcagagttaagttttggtattgtttatccagagattaattgtgactcttagaagtagtagtaatattgtaattttttttcagagctgtgagagaaaaaagttgaaagttttcagtttcacgctttcaaagccagtttgccacataaaaccaatttaggatgcagacaaaatcactacattttagttgttctgcagtaatagaccaaatatgcctttcatctttaatcacttctagaattattttgttttaagattagagcatactctgtggggcaggggctggaatacccaggttgcagtttattaatgtttattaatacttcacctcagtagttgagagttagaagtaaaatttgggggaaaaaacaattcaaatttagaatcttctttcttccatagaaatcacaaccattgcattaatcctgggacataggacaaaagtactgagtttgaaagacatggaactactaggaatatataatttaaaaataggatttcaaaattattttggaacacatgaggttattctctattattgtgtgtatgttattgctttgccattggtgtgggaattacagattatatatttgcatgctagtgacatgtgagcctctgtaagcgtatgctaaaatattaattttattaagaacttactgtttctgaaagggtggacttaaaatagcattggagcaatagaataagattcatttgttaatatctgaagcgtttggaatataaataatattcccgattttaaacatttgatcaaactttgtgtattttacaaatgtagcatgtattcatgcaaggttttgttaacgtatgtatataacctagcataacttggactgtgagagttacttgactattagattaaaaccctatacatactacaaaaggtgagctgaagggtggtccaccaagattaatgtcttgcctgttttcagtagttagagaaatagcagaggctcttcttctgcaacctattttattctttgtgtgaggacattaaaaaacaagtggaaatatggactgcctggggaagaatagagtttttccagataactttaacatttctgattggtcataattggtaaatggtaatttttgtcatgtaagttaatagttaagaatttttgaaaaatggaactgttaatgtttttcttataattataggaccaaaaattcatctggactcaaatcagcctgggcagtctcaatgcagtggcataattaatatttatttttttgttcttttttttaaagacaaacttcagttggtgtcatttctttagaaatgacaaaactactctcatctttttcctttaagaatgttaattacatttcatgtatgaccctaaacagctttcagacaataatgagccattgtaacattttaaatcacagttcagctagagtgagtgtaaacgaatgacctggcaatctcctatttttgatcttctctgttaattttgcttcatggctataatgtcaaacaagtagttcagcacagaaaaaaaattgtagaggctaaaatatagccctttgtttttttttttctagttttaaatatttttgtaattgtaggtgttaaagagtatggttgtaattacgaatatagctttaatttttaattagctttaaatctatagcatattaaaatactgatgaaatatttgtaaaggcaagaataatagatgaaaatatatgtagctctgtccatgtaagttgggtgaggaattgatgacagaaaaaggctcttacctgaaattaatatgatttattttagtgatctgatatttgtctgattctccttttatttgtctattttagatgagaaaaaaccaagagctactttattaatggaagaaatctaagtaaataaattattcttttaaaaatgatctcattttaaataggattaaagtgaatattttttgtaaaataacaaaatcctaaatagtatataaagagtttgtgttttgtcatagaaaattattgcttaacattaacagcagtgctatcatttgagtatcttgtttgtttggcacttgtctgcattatctcatttaatcccctcaaatccagtaggctgtaggtactgttttctcttaatgttatggaagaaacaggcttgagtttattaggcttttggcttcaggtatcaaaacaggagacagaaaacagcttaattgatcaggtttaaaagtaaatctcacataacaggatgtctagaagtggtagtgtaagagttcattcattgagtcaagaacatcagggttcaggatcggcttctttgccatcctcatggtcttcctctcatgaatgtagcatggctgcctcgggttcccagcatcactcccttacacactcaagtgtaaaggcaggaggaaggacagggtttttctttctttgtgtctcaccaatcagggaggaaaactttttattgaagttgcttaggagacatcttcttatcccttattagagagaactacagaatttcttcctgtaaacaaattatgctagatataatgggattaccataattggctcacgtgaactacctaaacaaaacttgggatctttagcaaggaagatgtatcttgaggatatagggagaataaaatgagtccctgctttcatgagactttgaaggttgaaggagaaatatataataataagcaaataaatgtactaggcaacttcaaatagtcatatatactataaaaataataaaatagtgtgatgtagtgtagagaatgactgggaggctatgctagattgggtagtcgggaaggttcttggaggagaggacatttcaacggagaactgaaagaatcagccatagaaagaccaggttacagtatttcaggcatgtctaagctactattgaggaaaccttagcatcaacataattgctcaaggatatgttaaatatgagtgaaaattgggatgaagaagccatacttgcctggttttgtttttaaaatggaggaattgggtgttgggttcagtttatctgatcttcctagataataggattgatatcttttatctttcaaaccctaaggataaacttgttctgaaggacagtggggcttttataatgatgattatagaaataactaagatttgttgaacacttacagtatactgggttaacagaggttggtacaattggcgtaattatttctcctaaaccttctagattggattggatactctcatagcagacttttttctttttcatatttattataaataacaaattatttgtattattatttttttgagatggagttttgctcttttgcccaggctggagtgaagtggcgcaatctcggctctctgcaacttccacacaccccccaggttcaagcgattctcctgcctcagcctccctagtagctgggattacaggcatgcaccaccacacttggctaatttttgtatttttagcagagagggagtttcaccatgttggccaggctgggcgcgaactcctgacctcagatgatccacctgcctcagcctcccaaagtgctaggattacaggcatgagccactgagcccggccatttgtgtgatgtttaatgcctcatcttccagttagattggaagctccataagagcaaggaccatggtgtcttccttaccgtcatattcccactgcttagcacagtggttgcaaggtttgtgattatgtatttgtggaataaatgagttaaggatgtaatgaattggaaatatgtcacaatagtctatcaccgtatctagctgattttctccccaatactcctagtatttggtataagaattaatgtaatttctaaaaaatacttttctataatatgggcatttagtattctttctttgaatttcaggactatggaagattatattatgatgtgtgtatatttttaatgtgaatttttgacagaattttttcattttctttgtgttaaatttaatataaatgaaattgtactttatagttttcaaaatattttaatgtatagtattttgttttacttaagtcacattataatcgtatgagctgggtggtatctccattgactagcaatatttataagtggaaattgacttatgcagctagggtaatacagataatatgtggcagacctgagccatatttagagttttttcgttccaaggtcagtgttcctttcattatgctacagctgcctcttttataatgagagattcatatatatttaaggtttaagtgtggatttgattcaacagagaatcatagattagatgatagttaaaagtttatgtcagtactttcattaaacaaaaaatattgttacagtgtgttaaacacaatctgtaaaattacttaactctaaaagtgccacatcatgagtgaaagctgatttttgtttgaaatccttatgcttttgtaacataagtggataggtacgggacttaggatagttttgggcttttaatttgtgaagacaggctaatttttatcagtgaactcttctctattcctttgccatttagcttcaatttggagtgctgggttagggggagggaaaggtaaggttttttcgcttttatacctctctctaacaagggaggaaaagtctttcagtatgaattattgagagaatattctttttcttttttaatgtggtaatatatatataacctaaaatttaccattttaaccacttttagttgtacagttcagtggcattaagtacgttcacattatggtatagccatcaccgttctccatctctagaactttttcatgtttccagactgaaactctgtactcattaaacaatcactccccactcccgccttctatgtgcccttgacaactaccattctattttctgtctccaagaatttgactattcgaggtatctcatataagtgggatcatatagtatttgtctttctgtggctggctacttttgatagcttaatccctatagcaacttcgtaaagtagatataatccccattttacatatggggaaactgagtctcagaggttttatattttgtccagggccacagagtaaattgtatagtctggattcaaactcaggtttctgactgcactgcccattttaactattttgactcagtgtgtttcatcgcttaacatggcggaaaaattgtaatggaagttgtgggaggtggcatgaggatgggaggggaatgtgcatattcatcatttttagttggggtgggaggcaatagaggttaagaagttaagggaagagtagaagcattttatagctgctaaaaaggtggatagtattataggtaccaaaagtgccccacagatagctacaaattctttagctggtatctgagatttaacaacatggatgtaggtgctcaccagagaggaagatgccaattaagaactcaggttataatttcagatagagctgtttctcattctgtaaccagaggcagagtaatccggcataagttactttaaactttggagtcaggaatatgtgatatttaggaaaaaaggatcctgtaattatgagtctcttttgttgtctcttccaagcagcgtatggcctattgggctttttttggacaagggcacctgagaagctccgtgtgatacaggagcagtagtacaatcatattggttctattacctagtcatttctgtaatactggctattagaaaaaatagaaataatttctttgttttatttttttcacatcattatgtgctatttgtcatttataattggattgaaattatttgatgattatacattatcagtatatttaagcgctagctatcctgggaagctattaaggtgttttggtacattcttttttttttttttaccctggattaaacttagtgactgatactgtattccttcacttagaaatattgtaatggaaaaacttgagtgagctttcttgctatcagatatattacacatacatatacacacatgtgtatgtgtgtatatcttgagagtagttttcaggtaggagttcatcttgggaatgacttagtaattttgaattcaaattttactgagtcaattatataagtgagttggacttacgaattcagggccagaaagattagagtataagcaagtttttactgaaatattaaaggttgttgatgcttttctgtaagataggagtataatcgacaagagtgatcattgacaagataacatagcaagtactggcaaaaatgctgctagttgacaaaatgcttttgtgtttgtattaggtccccagcagaatagcagaatggctctcttaaagggttaattgtatggaatcatatagaattgtacagaataataattgtatatagaatagcgtaagaaagtagggcttcttaaaaagctggattttgccaaaatagcatttaaaatgtttttaaaacttgttaactattttatagtgtaaatgtatatatatattttatgagatgggaatcatatttattctatctccccactccgttattcattaaaaaaatgttaaccgtctgttatatgtcagcctctgttgagccttcctgagtcagatcttaataacctggcaatctctgcccatcaggaactccccattcagaggggcctcactatcagccactaccacactgggtagcaagcactataatgggtatgcagaaggttctgtgggattcctgaaaaaaagcattgaatctagcctagggctgtgagagtgtcaggaaatatttctaagaggatgtttattgaaaggctagcattagtcaaagtggaagatggggcaagtaaagagtattttagccagagagagaatcatgtacagcaacatggaggcattaaaaggtatgatatagttggtgaactgcagtaaagttggtagggataaatctggcagattaaatacgaactatttcaagaacagccttaaatgacaacttgacctaggagataaacaatttttttttttttttttttttttttttttttggagatggagtctcactctgtcaccaggctggagtgcaatggtatgatctcggctcaccgaaacctccacctcccaggttcaagcgattgtcctgcttcagcctcccaagtagctgggactacaggcgtgcaccaccatgcccggctaatttttgtatttttagtagagatgggatttcactatgttggccaggctggtctcgaactcctgacctcgagtgatccacccacctcagccacccaaagtgctgggattacagacgtgggccactgtgcccgccctgagataagcaattttaagcagaaaagttacaccatctgaggtgcattttagaagaatcgttttggaaatcatatggagcatggagtaaagggggaggtagatccattaggaagcgattgctataacaatacaaatgcttatagcgtcatcatttttctacaccaatgcagtggtcatttcaggatgtagaatagatcagacttggtggcctaagtgtgaaaattaggatttttaaagatggctgcaattgttggtagaagttttagtcacagactttgggatacaggaggaggaacaggtaattttaaaggtgtaaggaggaagatgatgagtttagtttgagatgccattaagacctagcgatggagaagtttgggaggaacttggatatgtagcttttgagttcctggaagaagtctaggctggagatacagaaatgagaaaggataagtgtgaggaaactaaggctttaataggataagtaatttagctgaagtacacatgttagagctgaaatctgaactcaaggtttagtttattatttctctctttaaaaaaatagcgttattgaaatctgacattcatacagaaaagtgcacatatcctaaatgtgtaaatttgatgagttttcgcaaactgaacacaccagtgtaaccaagtacccacatcaagaaaaagaacattaccagcactctggaagcttcatatgtgctacccatcttgcttgatttttaacagcatagatcagttttgcttgtttttgctactaatgtatggcccatttggttttgcatcttgtatcatttgaaggcacgaaatagggataaagccattcttcttgggaatgtgcagggagaaagtgtgaggaaatcagagatggaagttcggggaatatttaaggtataggtggaatgagagtttgaaattgagattgaaaagaacggagacatatgagggaaacgcataaaggactgacattagcagaaatcaaggaaagggagttttgagaatggaagggtgagttaccatgccagatttgtagaatgaacaagaaggttaaacagggctgagttttttgttttttttttttttttgagatggagtctcactctgttgcccaggctggagtgcagtggagcaatctcggctcactgcaaggtctgtctcccgggttcatgccattctcctgcctcagcctctcgagtagctgggactacaggcgcccgccaccacacccggctaattttttttttttgtatttttagtagagacggggtttcaccgtgttagccagtatggtctcagtctcctgacctcgtgatccgcctgccttggcctcccaaagtgctgggattacaggtgtgagccaccgcgcctggccaaacagggctcagtttttaagaaaccatctgtgacttagggaggacagtttcagtggagtgaactcaagttagatgcagtgttttgggaaattgatagaagatgaggtggtggagatgtcaaatgtggacagccttcactggagaaaggaagcatagagagaagacttaactggaaggggacatacttttttttttttttttttttaacttggagaattttgcaaggaggggcaatagttggaataattttgggttttattgtgttgtaaagaggttttgtgaactccaaagtgttttaaaccacttttattattattatcattaaaggatgacaataatggtatgctacaggggacatggaaaggaaagccagtaggtaaagtggtttttagctttagttaggtgggtgttgaaagtgactgagtgtatgaatttttaaaaagtgattttgggatggattacacttgctaccttttgtcaactgatttttaaaaactttctgaattgtaggagattagaattaaagggatcattttgaagtgataactagaaaataactgtggtaccatggagaaaactaaattaataactgcccactctggctaccaatcaggctattagcctgtaaagcaaaagtttgatgggaaattattttttaactctcccttggttagctgacttttctttagaattgtatttctaaatttcctttctactttttaaattggtagaagggacaaatgagaatacctgagtaaaggccctatttacagagcacaaattgagttaatttgattagcttactagtactctttaaaatactttttattatttgagtaataaatattccaagaagaaaaatttagagatacagataagcaaaaatgaagaaaataaaaataaccatataatcttttagactttttaatatccatacatgcatatacaaattttgatatttaatgagaaaaacatcaaagccacttgaccaaaaagcacccttttaaattcgaggagaaaaggcagcaaaagataacatttgtgagcatatatcaatttccaagttccaataaatacctccctcaaaaacaagattaaaaaaaagtttaaattcacttattattcatttattcattaactacttttttcagcatcctgctctgtgccaggcactgtataaggcagtgggcaaggtaaaccctgccagaaaagcaaacagggcttttggcatagcgccaattttgtgcttggaagaagtccagtgaggctgtgatagtttctagaagcaaaaaattcagtagtgccgtagagtgtgtgtgtgtgtgtgtgtgtgtgtgtgtgtgtgtgtgtgtgtgtttcagggtagtaggatgtttttggaaaagtggtagaggctacagaaataagcaatgactaattcttgaaagccagcctaagaattatgaattcatcctgaggccagtggggcccactcttaagattgggcagcgacttgatccgagtttgttttctaccaacttgagaacaggaaacaatctgaaatactcgtttcattttacccaggtgtaataaaacacagaaggattgataaatacgttttgtcatttttaagaggataagcttaatctcagaggagagcaaatgcacatatagaaatgataaagtatggttatcgatgttctattttatctaatattttatggtaaaatttatattttgctctgtcaatagggaagtttataaaatgttgtgagttatcatttgtaaagcatgaattctttattaaaattatcttattatttaaaaatatacagtcagtcctctctgtgggttctacatccgaggattcaaccaatagtggattaaaaatattcgaaaatcaaaaatggatggttgcatattcactgatcagtgtagatttttcttcttgtcattaatctctaaacaatacagtataagaactgtttacatagcatttatattaggtgttgtaagtaatctagagatgatttaaagtatagggaaggatgtacataggttatatgcaaatgctacaccattttatgtaagggacttgagcatccattgattttggtatctgcagtgggtggggggtgaccctggaacaaatcccccatggatgtggaaggatgactgtatttaaatttaaaatttaagtaataaaaaagtcctatgttatatattactaatagtgtatttctacgtaaatctcatgattgtcttatcagagctttgaaatgcaactgatagtatttagggctatttattttttgttgtagttatcaaagatacaataaattaggtttatctctatatatttaatataatttgcaacatccagcatgagaggaattaactaaagtttgcagccattgctgttctaagcaaaattcttaagtgctttgatcattaatttagcatgcttaatattcatttaaaatcggcagtgaggagcatatgcaggtcaacttgatttttcttttctcttttttttttttttttttttttgagatggagtcttgctctgtctcccaggctggagtgcagtggcacgatctcggctcactgcaagctcctcctcccgggttcacaccattatcctgcctcagcctcctgagtagctgggactacaggtgcccacctccacgcccggctagttttttgtgtttttagtagagacagagtttcaccgtgttagccaggatggtcttgatctcctgacctcatgatctgcccgcctcggcctcccaaagtgatggcattacaggcgtgagccaccgcgcccggccaacttgatttttctttcgggaactggaataaagtgacattatttgaaaaatcttcaataaaggtaatgattttgatatcaattgtaagttagctagttattggtaggagagacaatgattgcactggcttccattttcctttgctggttgattatctatatggtgtgtactgggatttgtttatgttatggatatatacttcttgtctgttttgcttgtcttctgacaagtctaggagctttgaaatgtttaagaattgtgtatgtgttgtagtggcctggtgtcatttagaatatacctgagaaattgtgtcaaactgcaaactaaaaccaaagtgaaaaatagttttgccagccctttaagatattaaagattgcttagagatactttgttaatgttattcattttacttatcacatttttttcttagtatggaaggtttttttgttagtatgtaagtaatacaacaaattaagcaatggagtttttatctgtgtatttaaggaattataaaaggcaaagaaacaagtataggttaatgtcacttttccatatctaccaattcacttaagtagctttaacccaaataaaacaaagggtcttgactcttgattctgatcagaaaatgtcatccttttgtccatttactttaaataagtagttatttgtggtacaacttgcatatttctgattgtttctgtagttacctttgatttttttcatataattgcaaggctgatgatactttgaaaatttttggacttccttacctttgacagagaagagaatagttttgtatctttaaatgcatggacatttaactatttgaaataagttctatttagtattcagagccctattcagacaaaactagggactgtagctgaggcttatgggaagctttcaatttcctaagttatattgctacagccactgtactgagaaagaactacagtactgtctaactatggcatttggtcagatcaaggtgagttatatagaaaggaaaagggaatcaataaaatataggattaataattttttagattttgtaacagatacgatttgtcaacaaagttggaggattaaagacaacaattcctggggctgtttgattttaagtaatccaatctggatagattataataaattcacgttttttgaaatatatagtttactagtgagactatttcagtgttaagaccaatgagtttccgtctgtgtggctataatgggggtttctgaccttttttttttctagctgttgatgtattgatgggaatccctacaaccataatttaccatgactaagacattcatttttctgttgtttgaaagttagagagataagtatctctcttttccctctatatttgtttattactgtatgattagttctcttctattagtcaatataactgatttccaaggtatattttccatttagtggaatcctgagattgttggagccttcatatttttttccttcagtcatcttgccgattgacactaaaatgagcttaataagatttttatctattattggaggattccaggcctatttattttccctaggaaggctataatatttaacaaacaagtttattgaaatattttagaactttaaatcttttgaagttacccaaattggagggtcttacaactttgaattactttctaagacctctttccttccagtaatgagaaacatttattcaactttttaaaagacagaaatcatctttttaaaatgtactgttttctaattgtctgaaatgacaagagatcacttacccagcagtgcacaagacttccaaaatagctgagcagcgggtgaggggctagaaggcggggggtggtggtggtatctttttttaaaaaagtatgtttactagaaagggtataagatactttgcttttgttataggtgcacttgcacaaaactcattttaacctgtagtcacaatttcttctgtatgacccacccaaagtaaccaggctgcaaagcattataccacatataaaagcaacattcagattgcttgttttgcttttatttatttgcatatgtaatttattgtgcctgtgaaaaaaggaagttcttataaagagcaacaaaataggaaaaacaagcaaattgtcatttcttctggtagattatgatttagaatttaggtaaaaaaattaagtttgagtgattccatttaatcttggtagagttgtgatagcttatatgtaaaagcaaaatcattttatttaaaacattatgaaaagatgctgacagtaaatttacggagtgcattagtgttactattggatgtgttggaatccagactgtaaattattgttactctgttacataaagactactaatttttagtacatgtttatattgatttattcatattatagatcatggaataccacttcattttgaaaaaagagaattatagttttcatatttagaaactgagaaaggattttttaaaaatgaagaaacagatggtttaacatcatatgctcttaatttttgcatattttagtttctgaaataaatgtaattatggttttgattatgttttcctacttttaatgtagcatttctaggattactattaagaccttctaattaacataggtggatgatattagaggtaacctcgatttgatataagacagcaaatcacagaccatcttttgaagcccattttaaggccttgaaatccagtgcctcaatgcactgcagtgatgaagcagcagaagtttttgttctcctgacataattgaaatgaatataaaacttttcatttctctgtttaagttaatattattatatcaattatattattgtaatataatttattataacaatattataataaaagacaattctgtttggggtttatcttatcaccatcatatcttacataagcaatagaggagagaagcaaaattttgggtatgagtcttcccaagttatctacaagttaatggtttattgttcttaagggaaaggaaagaatatcttttaacatggatgataatctcttctatagatgtgttgaaacctggaaattgaagaaaatcctattaattgaactttatttgggtaaggtaatcgactttgtattgtttagggtcctttactgaaatggctactggaacacttgaagtaggtaaacatttttgcctgaagcttattaaggccgccaggaaatcttttctcttacttggcataagtaaagatatttttccataggatattgcccaggattcatttggcttggcagttgcatggattgttttgtgattgctttttgagggcaataattctgccccatgaaaatattagtcattattattactatttttttatctttggtcttctaaaaaagataaagggccgatgtataatttcttagtaaactgttaacatatttgaatgacccaaggaacataatgatgttctgctaatgacatcattctcatctttctgtcccaatgagatagatattgtactctattttgtggacaaagaatctgaggcaaaagcagttagaaacttaagggcacgcatttcagtatttatagaatctacattggaacccacttgttttcattgaagtttaatcgtatagagtttcagttttgcaggatggaaaagttctggagatctgtttcacaacaatgtgaatatacttaacactgctgaactgtgcacttaaaaatggttaagattgtaaattttctgtgtgcacaataaaaatatattagaaattattttcttttcatttgcttattaagtacgtttttagtgaagaatattctggaggtaaaatgttcatcatttggctcatctctcatccaatatgaaactgcttcaatttcatcacttaaaaggaacctgagtttctactttagtttggactgagctgtaaaaagtcttttctttcctttctaccagattgtatttctttttaaaatctagtcaatggaaaattaaaagataagatataaatcagaattatgacctataatttatattatgacttatattataccaagaacaaatgtatttgagaatctcctgcctttttcgctgaagctcaagtaaaactgtagatttttagatttttagatgtttttgactatgtaaacatttcaagaccaggtgtggtggctcaggcctgcaatagcagcactttgggaggccgaggcaggtggatcacctgaggtcaggagctcgagaccagcctggccaacatggtgaaactctgcctttattaaagttataaaaattagccaggcgtggtagcgggcgcctgtaatcccagctacttgggaggctgaggcaggaggattgcttgaacccaggaggtggaggttgcagtgagccgagatcgtgccactgcactccagcctgggcgacagagcgaaattccatctcaaaaaaaaaattcttttaaaagtacacttactctgtaattttggtaatgatgaagcgttcattttaaaaatagagtaaaaagtacttgtgatttattttcatgaaacaggatagaaatccctcatctcatttaattaaaaaagaaataaccactggtaaaatctgatcttttcctttctccaatacctgtcaagatttactttgtatatctgtattttctaaaattgttaccctatatcttttacattaaaaatagattaataattaagggtcaatcctttagaataggtattttaaattatgtgatttagtctatctagtgtatttgcctatttatataactatttattttgacctatctatataaccacttatttctcagtcaaccctctgtaagtgtagatgtctaagtctagcttatatataacttacaagttatatgaaaataccacattgtatctcataaatgtatacaattacttttcaatcaagaatattaaaaataaatataattaaaggttaaaaaagcaaaaatatgctgtcctagatttctcagtgcttttaaagtatgaaacatgttcattttatgaatcacaacctaatactcatagtgttaaatactatgagagtaagcctttaagtatagagtattgagttaatactcctcagttcatggcatggtattatcattggttcatgtcaggcctttctgctgtttaattgacattcattcatttactcattcatttattctctatacctgttcctcatttctacaacccccagccccataggaaatcatttagacctacccattttgctgtgtgtatatccagttcctatttctaattgctgcaaaggggatttactgtttcacattgttttataattgcttgaaaattcctatcttcacgttatttctttatatttttttaaagagagaagccaacctatttgaaggtaggctagttcagatgaactttttatgcgcaaatataacctaattcagtgattcataaaaatgagtaagtttaacactttgaaagtattgagaaattgaggacagcatatttattttttaacccattaacattataatttttatttttaatatttttgattgaaaaataattatatacatttatgtggtacaatacggtgttttgatatatgtatgcagtgtggaatgattaaatcaggctaattaacatatcacctctcttacctatcattttttatggtgagacatttgaaaggtattctcttaattttaaaatacagaatactgacttttaagactcaataagtaatttaaaaattaaacttcattctctattaaacatcaaatttagtttttctttgttactggttatagcattgcatagggcctcagttttagtagggattcagtagatgcgttggtttcatttaatgccatacccactaatttgttaattggcttggacatttgcgcaagttaattcatgcttggagctttaatattttaaaatgattcagacatcaatcaagcaaccagaatttattacaaaatctgtaagatatatagtttctagtttacattctcgatgttgacagctttcctcgcccaaattattgcatctgatccacactattattgtgtgtggtaagcatgtcaggcattatatccattttagtaaaggagaagttgagtcaaggcattaagtggcttgcacaaggttatatggctgttaagtcatagtcaggactataactgaaattttctgactcctcgaccaatgttctctataccaatgttttcaaactctgttatagaaggaactgaaggaggtgacataatatgaaatgaggacaagagaggccatcttagatgaaatgttttatttatttaaaaaaagatgctgcccttttaagtaaaactttgaaaatcattgcactgtattgtcgccgtttttgttttgaaatggaagtgctaagtcagatttgtcaatggtaactccaaaaagggataagaaaaagtcatctgttcctgaaatgcttgttgcatttacattatctatcttgtcatgtcactccccattacctttagaataaaacttagactaacggtggttcacaggacgctgaattatctggtccttgcctaattctgcagacacatctcttgctattttcccttttattcctgatcccccatagccttctttcagtccttgaatatgctagccctgtgacacctcaggacagtgttccctttccccagccctttctatggctggcttcttttgatctatcaggttccagtggccttccctgaccatcctttctaaagtaggtcctcccttattctccaccctgtaccttgtttcacttgtatcctgtaacacaaagtgaaattagttaattactagtagactctaaactccatgagtgcagggaccatgtttaccatgttttcttttgaatccttagtcactttgcctatagttggccctggttaaatatttattgaatgagcaaatgttgaatgaattatgagttatcaagagatgctcaatttatatttactgtcctctgagaaaaatctcaaattatacgcatttgatgaatatttccataaaatgattttaatgcattagtgcctaatagttgtagtcatgatttaaagaatgttgcatgagatttttttttttgaggtggagttttgctcttgttgctcaggttggagtgcaatggtgcgatctcagctcactgcaacctctgcctcctgggttcaagtgattctcctgcctcagcctcctgagtagctgggattacaggcatgtgccaccactcccggctaactttgtatttttagtagagacagggtttctccatgttggtcaggctggtctcgaactcctgacctcaggtgatctgcctgcctcggcctcccaaagtgctggaattacaggcgtgagccactgcacctggcccatattcttcatatgtgattaatacccccaacaatgttgtgaagttagtagtatattctactttataggcaatgcaacagacttagaaaggtttgttgatatttgcccaaagacacttagctagtaagtggcagaactgggatttgaacttaggtctgtttgtaactaaagtcggcactattttcactctattttgccgcttcctaaattaatgcttaggttctctggaaaatttgcttctgatgaacactttcctttcccaatgacgctggataaatggggtgttactgtaataaggtgctaattgaatggcgtacagagtaagtgcaaaagaaattaaaggaggaaaaggtatgtgctgaagtcatcagggaaacctcatggagcagctgtgggactttagttcattcaattaatgctgtgaaagtgttctgcatactggaccgtgtaggatgaatgggatataaataaatatagaagggaattgagggtattttagtttggagaaactgcttagaagtgttgtgggtatcctggaagcagtagggaggactagtgtgactggaagagaggatttatcttggagaaaagtgggatatttgttgaaaaagtagatgaggatgattgggggtatataaactatatagaatttaattttctctgtggttgctaagagcagtgtcattgtgggatacaataacagtttaggaacttcagttggtaatagtatgcaggttttaagtataatagtgcagcattggtagcacagtgaataacagtggcagttctggccctgggcttgaattccacccctttcacttgccggtttgtgagcttggaatattatttcacttactgtactgttgtttctcctctgaaatggaaattgaacagtagaacctttggcctgatcccagagattatgattcagtgtgtctaaggtatggggcaggaataccccctcctcccaaatcagatttagttacatctcctatgtggtcccggagggctctgtatttgttcagtgtttcttttctgacctcaggtgcaaaaagttgaattcatcaaactcctcagattaatgacagactatcagcttttggcaagactcctctcttgttttatttaaaatagttctcatttatccccagtattcattctaattctctgcctacatagatgttcgtactaatgtttttttgaatatgtctgtctctttaaaaaatatatggtgctgttttatgcacacatatttttaatttatataaattatattgtgctaaagatcttctgtttcttttttcattcaacatgttaaaatgccttttatgatagaaaacttcaaacagatccaaatgtagagaaagtatcaacccaccatgtgtccatcatccagcatcaacaattatcagctcagagctgatcttgcttcatattattaaccattcctcccctagtgcctcctccccacaactccacctctgcaaactgtattattttgaagcaaatctgagactttttaaaactgtatttcagtgccaaaaacatcaaaaaaccgctacccatttggatctctgtatatctgtttcataacttgtaactgctctaggtatgtcagtgaatgcacttaccacatctctggccctctggtgatggtcacctagtttgtctgtaatattctgctaccacagacaactttgattttcattttcatacatgtcctcttatgggcttttgggagaactttgatttttcagagtgggatctctggataatagggtatatatacatatacttcatttcactaagttttgccaacttgatttccagaatgtctgtactagtgtacattctcactaggagtacatagtagttctcttttcctccatttccactggcactctgtattaacttacattatatttttgccaatctttcatttgtaaagtggtatattatttaaatttttatttctctgattattagtgaggttagttatctcttcacgtatttgttttctgttctccttaagacctcccattcttgctgttttattatgcctaaaaaactctttccccttattcacgtggctcactcactccattcagatctcttcttaaatgtcatgtccccagagagttctgctttatctttcattgtctttatcacaacaaaaccttatattatgttatgtatttatttattttctctgctcaagttccttgaaggcagagaccttacctgtgttcacacctgtatccctagcacttaaaaaggtaagttctctataaatatttgttgaataaataaacatgaattggctatttatatcctttgtccattttgcctactcaataggagcgtcttgaatattctagacattaacctgtgttggttttagatgttgttataatttgttatttctgtccatcgtagctgcgtttgataaggaatccttaattttcaagtggttaaatcatcacgtcacaacatgtaaatcaacacattgtggtttgtgtttttgtggtctgaagaaatgctcttctaacccgatattacatatccctctccattttctatttgctttataattttatattttatatttgggtctgtaatttcttaggagtttacctttgtataggctgtgaggtgtggggggtgattttatttttcttcctgtagaatacaagcagtttgcacttttcctgctgattggtagtacacacttactatgtacgaattatttctcatatttcattgatcagttgtctatttgtgtttagtatcaatgttttttatacagtggctttgcactgtgttctaaagtctgatagggcaagtcctcccccttttaaaaaattgacttagcaacattcgtaataggaacaatcaagtagctaacctttaaaaagaatgcaaaagatcattatggagtaattatgaaactctattaaaggatatgaaaaaagacataactaatagaagagaattaccatgggatgacataatgttttaaagatgccagttctccccaaattaatttgtgtattcagtgcaaccacagtaaaaatttcagtaagattttttgcatacctcaacacacttactctaaagtttatttggaatttattataaatatatgttgatttaaaaaataaatgtgtgctttcatagtattatgctgtgttttttagtaattagtttttgcattcttatggatgggcagttgattgaaagcagcagagaagacagaagagagcagcagagttaagtgttttggttagaagtgatagaaattgtagtggtagcgcaagtggcacctcagcaaagaagcatagaaaagacagaagatagagaagtgaggttgttggataaatacataactccttcctcaactctggggaaatgaataggtaggaacagaggacaaacactagtctataatattgtccctgttgctatgtcttggtaatgatatataccgtgtctggtccaacagtctatatggagtacttactgtctggggcaatagtatctataggaggtattgagatgtagctcaataattgatacttgtgtaagtaatgatgactcagaaatcaggaagacctttaaatatattcttgatgttttgtttaaagaggcagagaaatgggtgttaatagtttcaataaaaaacagttaaagatatgcctgcacttgggttaatgcgcatcaatttagaggtatccagagctactcattctcccaactttcagggtcaaacttttactctgtgtgtttcttttatgtaccattgtgaatacttacaagctgcagatagaataaaactattctttatgtttttatggggactagaagcaagagaaaaatggagttgggggaaattaatttgtatactctactaacaacagtaatcaactacattgacatcattaactggtcattatgaatttttcctcttccagagaaccaagaaccttctcaagggacaaattactaaatatataactcttactaacaatgtataacaatttgggaagaagttatgtaatctcaaagaaagtgctaactactcatttgttaacttgtatagaaacttctgttattcaacgtagtccttttattcctaaatggataagcattaaaagagatttgtcttaatttactttcaaaaacttctttaattagcataaagaaaggaaagaagaataagagtttctggctttaagttaatttttcacatggagaatatatgtataaataattacagtatcatgttaatagatactggtaaagtgtctgaggtttcatcaaaagggaaagaaagcaattgtgctagatataaatcagggaaggatttatttgagctggaagtaagtagaattttgatattgtgattatgcatgtacaccagaagatggtgtgtcacagttttgtccattctctgatgttggatttttatgcatacttaaagggaagagacatactatgtgtttctgcaggtagcacacattatgccaggcccttcatttacactggtgtactttatacttaaaacaaccatgtgaggttaatcttactaacatcatatgatgaggaaacaaaggcttagagaaaacaaatgcatgctcaaggtcatgtaactagggactaaagttgtttctctgttgcaataatcttaggatcttcattggctaggtattatctgaatgtttccagaattctttagcagggcatgccattcttgtaaaagaatgctatagttgttaaatgtgagaaaggtaggtctcctagcccagaaatgagaattaagtggcaagatttgaactgttctctttgccctcattttgaaaaaaaaaaaaaacaaaattatactgaagagagtaaggcgactgaccttgagctggaaagcaaggaactttcacaatgtgcctgtatagttatatttcacttttggagagttgtagtatagttatcttagcagtatttttgacaaggctttcatcatgccatcaatacctgctgggcagggatctagtaagatcctaatgcttaattcagatgtaagccaggatattttgtattctttttgctgttgtttatttcccttttatttttcgttagcattttgtaaaatcttttagaaaattcaaatgaataatataggacctggcatatagcatttgggcagtagatgttagttgaaggaatgctagagtgtgtcagcagtgctaagaactaagggaaggaaagatttttttttgttttttctgtgtttagaccataacttttagtaaagatcagggtgccccaatggaccagtatagggatgaagcagcagagaaggtgtaatcaggaggtgatactcatgtgcatagagtccagtgtttttgaacaaattatccattttccatcagtgaacttggagatttttttgtttcatttttacaaaggcatttgattccttataatgatgctgatgaaatggttcaggaaactaaatgtcatgtctgtgatctcataatctgttagagagttctgttgttttagagaatttagttcaggttttgaatttgctacaggatagtaaggttttgattgccaatttttgaaaaggcttcatggctgcctagtttttgtttttgtttttgtttttgttttcagtttccatgttgattagttagtcactggatactgaactgctaaagaattagatttctgttacagattttggcattataaaactctttggtttgtgtataggacttggttggaacgtaaccttagtcggtttttggttctttgtattttgcttagtgtgtgaactggttcatgagctttttcatttgggtgcttcactgggacatcagtctgaagtagctacctgtaagatttttgtttgtttttgtttttgcttgttgtctgtgttggaagagttgtatagaagttaggaaagatattcggggacatttttaggtcgtgtgattctcaagcctgatctagaaggattaactagatgccttagtatgaagcatacagattggattgccatattcagatgctgtaactaaacatctcatcaagcagtagtaggtttatattttttatggtatccatccagacttgattaacagttgacagattttaggtttcctactattgtggctctttataaaaatccctgaaaatctgtatatctttggctttatttccatttagttttgtttttaaaccagtcttctacctaatattttgtttcatgttgattgtattacctagcaagcatgtctgtgattataaaaacaatatagtaaaaagaaaaccccaggttattgatgtgctatatatgtgtgtatactttaaacagacctagttttacttttatgtggaataatcaggaaaatgtgtgtaacagttcaacagtaaaatgaatcttaccagttagaaaatcaatacagagattcaagcttttcctctgcttaaatatctactgttccgtatgatgtcaaaccaaactgtgattcctaaaaatgcataactgatgacatttttaaagtagagcaaaaattttgttcagaagcttagaggcagagaggggggaagtgccttgatatttatctagtcagcttccttgcttttcgtctataaggtgataaacactagtgatgtctttgaaatcttgaagcattatttttgtgttccttttgttgaaattttatgcaaacatttaaacagaagctaatagtataacttgaaaagcttagcctatatgctgttttagcacctgaagctttagtgttctgaaagattctgacagcagtagtatgactttctcagaagttgtagcaaagaccatgtcattattttggtaggctgtgatacagattttaaattatgatacagacagtcagtattaaaccaagggaagaccatttggaatgaatactctgtttacatttatctccagtgcatggtagtggtgacacagtgtggaggtaggattggtagtgcttctagggccaaagaaggcttttaatttagggaaattctggagctgagaatggttgatgttaccagagtttataaaagaagtaaaaatctggatgggctctgagcccagaagtacaatctgagctgtatcatccatattttttattttctgtattttatgatgctttgacatcttggggccttgctggcttgcgggcagactactcctccagggctggataattcccagagatagcaaatgactctcctgtgagcattttcatatgtaaaacagccaatctagagcccatactgccagctacctcctttattgagctttcacagattgagccactatccccctaccctaacttacaccccagggccaggtaacaggcaactagggatggttcttacaccctggagcccactgaaatttctcaaaccagccagtcctaaactgtttaccctgccctgcattggccttttctgctgaaaaccataataaaggcttgtgccatgctttcccctgtctccttctgcctcctgactgaccctggtgccttcccatatggacctgtgcttcatggcatgcctcctcctcctagaactgcgagtaataaactcttcttcccaaggcagttgtctctgtgcctgtcattttatcacactcaaagaaaacaaaacctgggtacattttaagacgtgagccagccttcttctggagtaccctttgctgtctctggctaagcctcaattcaagctcataatcaagatggatagaaaccttgggcacccacagtgattccactgtcacaggaatttctcaatgtccacaccatgttatggatattaagaagcccatacaggacatctcttttgagaagtaacaggtttggctggatgaagttaatcatcagccctctgctttttcaggattggctttagctcttggaggaagcggggatgggcatggggaaaggtcaaacagtggtggctataagtcctggagcagctgctcatggctgcagaaggtgtggagccttctgctccttacgatttgaaaacaccccatgaatttctgtagcaggagtttattgtcatactttgtgttgaaacctgtggcaacctcgtctggatcctaatgcataaacaaggatgtttcactagaaacattgtaggaataaacaaaatgtttactgaagagtgatactgtataattctatcaaaaatgtacttgttattataaaaaatgtaaacgggggaaaatggacaaacccccaaaaatttagtgttcgttagttatattttaagtgagatatttatgtaagaggttcatagcaatatctggattagaaatgtccttagaaatttacattacaatttccgtggtccaaactacttttcatggttaaagaagttacagacttacttgcagtggcattacttgtagctaaatatcatggaagacgctaatcagtgcatttcttacttagatttccccaggaatatagtctcattgaatattgataaattgacaccctcttttcagatgtggcactcctgggaataactgaaatgtgaaacttacagtcttatcttacttgtgttaataaatttaactaacgtagaacagtatcagttcagagctttcccagtgaagctggtgaagccctcagcccccaccaacttcctaatctcttaagtttcagtcacgttcctttgaatgtagggatgtttttttcattaggtttcccacctcggcagcttgacctctgcttccggtaggaggttgattggtaactgctggataacctctgacatgagctagcttactttgcctgctttcaaaactactagatctttctctgttttctttctcttatcactgttatcggctattttttctcagcattcgaatgggtttttctttgctagcagtcactttgggtctactcattcctcttagccctctgaatcctatctctgtggtacattgtttatattatagctacaatgaaaaaccctgatagtttcctcttccatcctccttcttatgtcaattcctaaaatacatttccctgcgcataatgtgttgttatgagcttctttccctactttttaaagaaatattatttcttgttatttgcttaaaagtctgggtgggtattaaggtctatgattcagaagaaaaaatcttataaataaatgatgaaaaaccacacctagcatcctaagggcggtacaagagagttcccaggggcttacaaagttagaagtgaagtctgaagaggcaccagcatgcgtcagctgtatattgacaacatttgttttacgtggagagaccacaaccatgtatcctccattgattggctctggtaccttttaggtaggctttgtgaattgtttaggtgcaggttttatgtcttatggctggagagataaaatgccagaaaactcttcttaggaaatatgtagaatgaaaaagagcattgaaaatgtaagtagaatcatggatcttatttggctggggacagatggattgaagcagcaaaaaaggttaatagaagctggtagaaagtcttgaacaaatgtacagtaagttaaattttgtggggaccttggtttttcatatattatgcttgtttaaaatgggtgggaaggaagaaatgacagtattatttaattatttaaatgtcatatatttgatccctggggtctgaattgccaagaggtaagttaatgggtctggaatttgatttcactctataagtaaacttttactatttcttggatgcttctacatgtcatgtagaaggcatgagactcctaagtcagaggcaaaggaccttattactcatggcatagaaacagcatgagcattagcatattttcttcagttctccttgcctccaagttttatgggggtgatagaatatgttacggatagatgctgtacatatagtggactggagctgaggagctctgggcatggaggatccattgcttttatagtaagcaaggctgctctttgtcctggagggtgactacctcatttttcaaggtagttcatagcagacacaaccctgacaaacggccctggtaacaagtggtcaggatcttgcattctggccatacccagcaatatgtacaggattgggagaagacccatcaatgaatgtcttccagcaggttatattaatattaagaatcaataaatattcttctattttcttatgatttaaaatgatgaatattgtatttaaagaacaattaactgaaggaaattttaaaatgaaaaattcttctggtgaagttcaggccatgtatttccttaattgtataaaaattataaaacatcagcctcacctgtcttttcagagcgatacacacatacttgatgcttccctttcttaaaaatgatctgaactttaaatgtgttcatgtcacttttaagtttactttatactaaacttcataatagcagtgtacttacaataaggcattatgttaggtagtcatgatgcaagtagttttgggatgcttagtatttcatagaccctgaagttgaagaagtgatgctggaggataaaatggagtattaaggagttttaaaagaatacttaaggacatcagaaaaggttaatgatagaatgttaactgaaaaaaagtttatgtaatttgcatattcagcatgaaccctgagtttaaaaaaattatatacacaagtatgtgtgtatggcaaaaattcaaaggcagtgctgcaatatattaataatttacctggatggcaaaatttcttaattcttggtttctttgagcagtttgcaaattatgtaagcatgcattaatgttataattaggaaattttttaaattttgatttaattttatcagtgttttgtacacattttatcagtgttttacaagcacattgtttaaagagtaccagtcagataggcctatgaggcttgtaatggaggacgacagtggctactattacccttatctcatttcctgcttcttgtagacaaacaacttcaactattttagctgattttttttggtgtttattgtcataaatccaaataagtttatattgctgctacttgattttttttttgacgctatctattgacttcccacagtggaagataagaactctgtcctcttacctgtcctgttttttttttgttgttgttgttgttttgtttttgagacagggtctcactctgtcacccaggctgaagtgcagtggtgcgatcatagctcattgcaacctccacctcctgggcacagtgatcttcccgcctcagcctcccaagtagctgggactacaggctcacactaccatgctcagctgatttttaaatttttttgtagagacaagatctcagtatactgctcaggctggtctcgaactcctgggctcaagcaatcctcttgcctcggccttcctaagagttgggattgcaggtgtgagccacactgcacctggccatctatcttgttaatgtagtcacatacacatttcttgtcttcccatcctcccagtacagttattctaattttgattatatcagtatttaatgtttacatgattatgactaaatgctatttatagttttgccatgtagtagtattctatggttactttttctttcttgtacacagttttattttcagtggaatacttatacttgttaaaaggtaggtttgttttctatgaacatatcattggtttatccccaaactctattctgtttgtaaataccttcttaactattctattaatttcatgttcttaatgatgtagctctcagattcttctaacttgttctaatctacactggttgtttacctggttttggcatagttgttatcttggactctttattttccttagcatcctcatcatcttaagaatttctttcttgtgctggatcccctgttgcttgatttcctttttgttaggtcattattttggtggaacacattctcaagtagcaacctgagtacttggtggcttcttttgacctagaaaatcctactctgttctggcaattttattgagttagttcttttgattttgtctctccccctgtctccccagcccctcctgtctgtctctgtgagtgtgtgggtgtgttttagaatccccattttctttgatgtagtaggaatatggattgcccctctaattattatcttttctcttaaatattttccacatctttctattttggttttcctttattgggcgatttcctcagttttatcttccaaccctccacagattaaaacaattctcttgttactggacctcctacttaaaaaaaaaatccagttctttcactgtgcagaagctctttagtttgattagatcccatttgtcaattttggcttttgttgccgttgctttacaagcaacctatagaatgggagaaaatttttgcaatctatccatctgacaaagcgctaatatccagaatctacaaagaacttaaacaaatttacaagaaaaaacaagcccatcaaaaagtggttgaaggatatgaacagacacttctcaaaagaagacatttatgcagccaacaaacatgaaaaaaagctcatcatcactggtcattagagaaatgcaaatcaaaaccacaatgagataccatctcatgccagttagaatggcaatcattaaaaagtcaggaaacaacatgctggagaggatgtggagaaataggaacacttttacactgttgggagtgtaaattagttcaaccattgtggaagacagtgtggcaattcctcaaggatctagaaccagaaataccatttgaccagcagtctcattactggatatttacccaaaggattataaatcattctactataaaggcacatgcacatgtatgtttattgcagcactattcacaatagcaaagacttgaatcaactcaaatgcccatcaatgatagactggataaataaaatgtggcacatatacaccatggaatactatacaaccataaaaaaggatgagttcatgtcctttgcagggacatggatgaagctggaaaccatcattctcagcaaactaacacaggaacagaaaaccaaacaccgcctgttctcagttataagtggaagctgaacaatgagaacatatgggcgcagggagggaaacaccacacaccagggcctgttgggggatgggggcctaggggagggatagcattaggataaatacctaatgtagatgacgggttgatgggtgcagcaaaccaccacggcatgtgcatacctatctaacaaacctgcacattctggtcatgtatcccagaacttaaagtatgataataataaaaataataaaaatccagtttttgtttcatggttgcttgtattcttttatctctttgaaggttaagaatagtttttggaaattttcttctctttacctattatttgtttcttccaagttactctttttgtttgtttgtttgtttgcttgctttggtctctgtctttcctatttcaggctctccttaaatgtgtggtagtggttgttcactgatgcattctaaaaaaagttctaaagagtggagtagtagttctgtgcctctggatgaggcttgtagacttacgggtttctgtttaggataatctggtaggctgttttattggcgatgtacatcttttaagtgtcttattttaggctggtcagattccctagggaagactcttagtggatggagggtataaccctgcagtgatttggaatccaaatgggcagaaacacataaactttttctttattcttttcttttttagtgtgatatgcctgttctaaacttgccttatgttttttagtaataataagaccattaaaaaaatctccaccaagagaataaatctccaagtcttttgctggggttggggaggggtgttcccctgtttggagtgtggaggggtggagtggggagtttggaatcttacagatttttaaacagatttttttttaatcctcctgtttgtaaactttttctctcacttccagaggtacctggtactgcaaatttagccatttggagattctattatgtaatactaaccctatttgctcttttgtctgtttagtattcagattccttaggtttgaaaagtgatttaccataattttgttactgttgtttcatctggtggactcttcatccttgcaaatttaagccttaaaagaacatccctttaggccaggtgtggtggctcacccctgtaatcccagtaatttgggaggctgaggtgggtggattgcttgagcccagaagttcaggatcagcctgtacaagctggtgaaactccgtctctacaaaaaaatacaaaaaaaattagctgggcatgatggcgcatacctgtagtcccagaggctgcggtaggaggatcacttgagcccaggaggtcaaggctgcagtgagccatgattgcaccactgcactccggtctgggttacagagtgagaccctgtgtcaaaaaaaacaaaaaaaaaaaaacaaagaaacaaacaaaaagtccctttactttcattttggtgggacagtgtgcctgtaaatgtaagttcaacctaccatccttagccagaaatctgtaatctttatttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggccttgtaatctttattttttaaagacatgatcctttcccttttctaacatatgatagatgacaaaggcatattcttaactgttatgtggctggagggtataagccagcagtgctttggaatccaaacaggagcagaaacacataaacttttctttatttttgcccatttattagaaggtcttatgaatatccatctgtctattcacaagctctgtttcaggttagatctcgtatgacttacttagaccataatttttgatattttaactgaagagctagtggttaataatagctacaataggtaatccaaagaaatgtctgaagattcagtatggtgtttaaactataatactagcaacagtgataataaaaatagcttaaatagcttatagttgtgcactaagtgctaggcctgtattaatttttaaaatttcacaccaattttatgaaatagggactcttattttcctccctttacaggtgaggaaaccgaggcacagaaagattatgtagttttccatagtcaacatggctaaactaggaagtggaggagtaagaatataaatctctgtagtctggctccagaacccacactgttaaccattatgctaatctacctccatatactgttgggattattttggatgagataaaggttttatttttttttttatcatgtagagtgatcaattttgtctactacaatttattatctctttaggctttatttatcataaatagtatgcagacttactgttggtgatatatctgaagataagttgttaccttagacttttctggcatgtcctaaaaggctcaacttctttccctcttatacaatggatatatttctgataattctctcctattgaactgtcattgattcacatttttctaagattgcctcctgcttttttatgcttttatttaagcatatggtaaatttctggcaaagcgatgagctgtaggaaaatgtttcttttttagataaaatcaaatactaattattttgaaggtgaattgttatattttggtatatttggaatagatatttcattgataacttattgagcagaatcaactagctgagtttagtctttaaaaacataaaagcctattgtttcttttgttttagttctaagaaagatgctcttaaagacaagcacctaattatttaattcccttcctgcatcaagatatgaataaactactaatattatagaattaaacttgccctactttaggcttttataccctcttaactatttaagtttatgcctgaaagggaagaatcagatttgttatttttattgttattaaatgaactttaagagcattagatacggtagttatattccaatctagacacaaacatacagttccttgcctggctcttcaggatttatttatggtgatatgttaaaggtgctaaaaataattacgtatttatattaacaaatcttggaaaaagatttactttttaaacttgatttgcagatttctttttattcgtgctcccatgactgtaatgttctttccttcctgccaatttttgcctattccttatattaaaacatattatctcacttctttttagaattcatctgtgccttattccagttcactcttgtaagggtgatgcttgtgatcccctcagccctcatgtattcattcgtattatattggaggtaatgttttgtttctatggaaatgtgctttttagtttcctatttgtaggtttgtgcttgtcagttaagaataagttgttttcagttgaagtcccctctagttatttctacctatcagcccctcatattatactttggcttctaaaagaccagtatatattggacacagtaattccatagaaaaatgtgactaaatgttgtaactgtataggtccttatcatgacatttaaaaattcatcatcttcccatttctaaccaagaggaacactagcaaagctactctttatcacaagattctttctttgggattcatttggaaggtaaaactgatacaagatacaaaagcatatttatattaggatagaacatcagaaaacactgcctttgcgaggaagccacatttttcttccaaggtatctaattagacaatcctcgtctgtctactaccattacttaatttaccctttacacccattataattggaccatggttaccattgtgtcctataagcttgccagttcatggcagtgggaccaagtgaagttttatcaacagtttgagtttttaaaatagagttcactctcttggttttttttctcttctaatttaataagcagtaagtttgctgaatttgaggatactgtggcaagagccatctgtagttgaatattttagttgttaagtataaaaattcagatattcaaaagtattgaaaagaatttgcttatttttcttctcctgatatgcttctaattttttaaatttaaaatattgaattgagggaagactgcatcccagacaaactgacttctaaatagcatgcaaaggaatagttctgcaagtgttctacatctgctatgatggcttttatatatttattttcgttggacttttaaaatttttttcttttcaaaataaaggtttataaagaaactaataccaaaattgatatatttttaaaattctctttttaaattaaaagggaaaacatctcaagttcttagagatcactgttttttcctttctatatatatgattctttaaattcttagagctcaaattagacatgagtatttcaggtgtctaggctttctctttttccttcttggtcacacttttatatgtttgtgtcttttatgagatgtgagctagattaagatttgttgatatgctataaattgtgattaagatattattcaggaattattaggaactgcatataggtagagaagatggaaaaagctatgtatttgcttaatgacattatagaagagaaagtaggaaaggggaaggggtaaaatatggaaaagaaaggtgaaagagatcagaagaaaatggaaaaataattatttgcatagctatagtgggttatatattggcttctgtttcaatttatttatttttacttcttcttttctcattgagtttttaaattctagaaatgaaagccattacatctgctgcctttaaaactcccagactttaatagtgtcgactcaattatccattgagagattatctgctttgtgttttagcctttgcaaatacagctttcaagctcttattggcataagtaaacaaaggatgataaagactttttgagtcttttcactatttcatgcttacttttatactcctgtgtagcctggctcttccatcaaactactttcagtgaacctttagcctatattcaacatagatcagttatctcagatattttttcttgtaaaaaaatgtaatcacaataagagtttttctagtagatttaattgtctttaaattgacttttactcccacctctccctgtgtcctctaccttgggagtaaagatcaacacactttactgtttcttctgtatttatagtaccttacctggatcactgatactcaactcactcctaaagacttggaaaagtctttagctgaaaaagacagcttcaattgggacacattgcccatacatacagactaaagaagaaagggtacattttagaaggatttttcagggagagttgaaacattaattttctggttgtctctgatgaaaataaaaattccttctcctgcacaagggaatgataaaataaaaatgcagtgaatttaagaaaacacgaaacaatttttgtttaagcctgctttaaaaaaaatctgagagatgaatttctctctctctaacatgacgcattggtcagcaaagagttaataaggaaaattgaacaacttttcaattaactcattaaagtgtttctatattatattgtttaatgctttatcaattatcaattccagagaacttaaacattattcaaatacatatcaggatttaatctaaagtcaactctactccagtacaaagatatgtatctgctgtattgtactatatgcataactctttcatagcttatgtgactctatttaatcaattcctatttccttttctgtagagagagctccttgaaggcagagaccctgtctttgagctctgtatctttaagatttagccagtttctggaatataaagtattggctgaattcattattatgtgagctatcagtaatagctgtgtcttagcggggggttatagttttaaaaattaacagataaggaaatattgaccataaggtgctttaacttgtatgtgtatttaatttagtgtttaacatctggtcattagctctcatttttgaggaaaaacatgaggatcacttatatcttttctgtactttatgctctttttcttaaagcaacgtgtgttaagtaaattgcaaatctttggtgataacatctcctatttgcttaatattttgtatttttccaagcactttcccacacattgttaagttctatcctcacaacaacctgaaagaggtatggttaaggaaactgaggaagagatttatgccaaagattatgagtttaaagcctagaatctaggactcctgaatttctagttcgtttctattttgtgtttcccttacagccacttttgaagtcatttcttattgcctgttgtattagtttgcaagggctgctgtaacaaagtactaccaagtaggtggcttaaacaacagaaatttattgactcatgattctggaggcaagaagtctgaaatcaaggtgttggtgggattggttcctcctgaggactgtgagggaaggatctgttccaggtctctctccttgccttatagatgaactgaccaacctcaccctgtgtctcttcatgtcaccttccctctgtaagtatctctgtgtccaaatttctcctttttataaggacatcagtcatatttgattagaggtcagccctactcctatatgacctcatcttaactgatcacatcttcagtgaccttatttccacattaggtcacattctgaggtacgaggggctaggactctaacatatctttctggggatggaggcaggaacacacaattttacctataacatttaccttttagtaaatgaagccttactggagatgttgacttttctttccaagaacttaatagaaactcctcatttgatcctcactgctctgttacctctcagaggaaattaatttaatacccatgaaaggcatttttggcagaatcattcctgttttgttcctcagggccatagagttatctaatgattagtttgtggaaataacccgtatttataattttatttccctgaaattttcttaaatgagaatacataagattaactgagaactaagctcttctcttggggctaatctcttcaagtaagtctgtgtgtcacctcatgctccagctgtttttctgtgcatctaaatggcccacttccctagaggacttcagcagatgatagaagagtctctgaaggaaagttgagattaatcagactatcaagtacctagctctgttttgttttgagcatagtccataaacaaacggtaagaagattgcctgaacagtaagattcagaggtagacaaggaactcgttactgttatttagattaaattctgttgggtaactggcttgtttaactggattttcctttttgtatcatactttaaaaggaagaaataacttgtataaaatagtcttttctgggtcagtaggcatttaaccagatcccttatatgtatatgtatcaccaggataggacagtgattaatattgaagaaaacagtaatttttaaaaataattaaaacttttattttagatttgagggtacatgtacagatttgttgcatggatatattatgtgatgctgaggtttgggcaatgactgaacctgtcacccaggaagtgagcttagtacctaacagtttttcagccctttcctctatccttccctctcccctctagaagaccccagtgcctcttgctgctatctttatgactgtgagtacccagtgtttagctcccacttctaaatgagaatatgcagcatttggttttctgttcctgtgttaatttgcttaggataatggcctccagctgcatccatgttgctgcaaaggacttgatttcgttctctttttttatggctgtgtagtattccatggtgtatataccccagtccactgttaatgggcacctagattgattccatgtctttgctactgtgaatatgctgtgatcagcgtatgagtgcaggtgtatttttggtagaatgacttattgtcttttggatatatattcagtaataggattgctgggttgattggtagttgtgttttgagttatttgagaaatcttcaaactgctttccacagtggctgagctaatttacattcccaccaacagtgtatgtgtgttctctttcctccatagtcttgccagcatctgttgctttttgactttttaatataacatactcagggtgggtatgtttggttcccaacctgtccaatttaaaatgttttgccattttaagttttacttaataccagtattcatagtcaaataattttagatttttcctagagtttgcaatataaaaagtcaggaataagatgagggagctaaaggaaggacttgacttccaaagattctgaaatacaagagaaaggcttaaaataattagttttttacaattattaattagttgacatctaattgcgatgtagttaattggcttggtgtgtttatggctctttatcctaaagtatatatttaagtacctaaaaggatcagttaattattttttctttgagttgtttctggaaaattgtgtagaataaaaatatctcaaaatatatgtgtcctttaatattaaagcacttttgtaaagtatataacatttccttggtttgctacttatcactttttaagggggatctgttgctttccattactagatttttaagaattatactctattaattggcttttaaaaaactctaacattttatttgcagattaataagaggagtatagaaaaatttgttaaacatattttcaagtgttttcctctcccctatcactatgcacaagagtgttcacatatataggcactatatatactatttgttggatggctgttggaatgggtgggtaagtggatgagtaaataatatattcagatttgttgtatattatatacatgtaatatacataaaaacaaatatgtatatattttgtgtgttttgaatactttggttaagtggcttccaaagtatgtgctataaaaaccttctgcacaaaaaggtctccatagccaaatagatttggaaatgtgatatattatttttatgtcaagaaattcttaatatagattaacacgttaaatattctgagtggtctggaaataaagaaactcatttaaacttagcctagtatttcaataactaatgtgaatagggaatgcatttttttttttttttttttttttttttgagatggaatcattccccgtcacccaggctggagtgtagtggtgtgatctcggctcactgcaacctccgcctcctgggttcaagcggttctcctgcctcagccttccaagcagctgggactaaaggtgcgcgccactacgcccaactaatttttgtatttttagtagagacggggtttcgccatattggccaggctggtcttgagctcctgacctggtgatccacctgccttggcctcccaaagtgctgggattacaggccgagccaccatgcctggccagggaatgctttttaaatccctaaacaattgtataatattgtgtatatgtgtgtgtgcatgtgtatatatgtgtgcgagcatgtgtgcctgtatgcatatgtacattcaaaacttgggaactagtgggtttttatgtaatgtaagtggtagaactgaacagatgttggtagtatgtcagagaaatgggagccagtgatgttatttcataagactcataggtaacttggaaagcatatgtgagattagagtttttatattcgttagtgaagtagagatagtgaaagcctgccatactcctcaccaatcgtagtcatgtcatcattaattatatgcctcagtgaaaggattgagaaaaagagaacaaaagagcatcagataactaagaagaatccccaaccctgtacctcattggttgggtaacacaaatgccagtggaacctggacagtaatgatgatgtgactgttccacgtggctcagcttggccaatttcctcagctcctggtgttctgtggtcatgtccaagggactaaagcagcagtaaagctccatagtcagatgtctttgacttacccattttaggtagcaagtatcttcagctctgcctcattctatttactataaaacaaaatacagtaaggaagcaacctagaatttgttagtgggtacaatgaaaaagtagtcaccatattttggatctgcgcatttaaaaaaaagaaaaacattagtttaaaataaactgaaagataatctaaaataaattgactttattagtcttgtttttggcatttctcttttaagggaaatcattagtgaacattaataaatccagtgttatctattaggaaaataaatacaaagatttaaactcagtagaggaattgaatttaaacaactgaatttaaaaaataattgttttgacttttttcttttttttctttttttaaattttattattattatactttaagttttagggtacatgtgcacaatgtgcaggttagttacatatgtatacatgtgccatgctggtgtgctgcacccattccctctggacctccttggataacctgatgtgcttttcctgtctcagggaatcactattccaatgcccgattttgagtgtccatctaacaagcactgcagactgtagctcaggctgcctgagctctggagatcttcctgggttgctggcactgtctgtgtgtcctgtaataccatgactgatatatgttgtattcatggctgaatatcttcaaaataacttgtgtattctcaaagcttactttaaaatctaatttttaatttcaattaagttatttaattaattagaaaaggctatgtaaacactaaaggtttttataatttaataggcaaactgctttaccatttaatccttgattaaatattgaaccactttagcaaagtagccaccacacaaagaatactgaataagatatgggcaaaaaggaataaaaagaataaaacagacaaaaatccctcattaaaatgaccaacttgtctgttgtagatagtggggaatgtgtgtaatatctgctcttattcccagttgttggagcttgagtacattaagattgagccacagcatgagaaatcagagttcttttactgtgctgtagttcaatataaggcttgattggcaacttagtgtaggtcacagatctcttagctggctaaaggcaatgaagatactatgtagctcttcagggggacatagtggaaagtggcaaaaataaatctcaattttatccccctaaaataaaatgacagaaaaatgtagggacccagtttaaactggcatttggattctctgaaatagggattctttctattgggattgagcactagcagagagctcacactcaaatgtctggatgaaagtgtaaaattgagaagttcagtttcaaaaaaaaatagcattcctgcattttttcagaacttatggcattgtgtttcatatactttgtattttccgatgcctattttggagcttccattattttgtttctattgctttgcatgagagcccttatataagtgagattgagtagtaggcagattctatctatagcttttgtcctcttctaaatattacagaatttgtttgtttgtttgtttgtttttttgagatgggagtctcgctctgttgccagactggagtgcagtggcaccatcttggctcactggaacctctgactcctgggttcaagcgattcccctgcctcagcctcctgagtagctgggactacaggtgtgcgccaccacgcccagctaatttttcgtattttagtagagacgtggtttcatcatgttggccaggctggtcttgatctcctgacctcgtgatctacccgcctcggcctcccaaagtgctgggattacaggcgtgagctgccgtgcctggccgaatcttttttttaattaaaaaaattacaatagtgatttctttcagtgtgtaccttattagtcccatataactttgtttcagataatccctattaatgatacagttaaacatacattttaataatctgtgaaaacattaatgcaatattttctaaacttttcattaactactatgtattaataaattggcatcgttggttaacagggttctgaggtcagataggtttatggtatggtgcatacttatatctcttcttagagatttataatgtacattataatgtcaaagactcagagttgctgaagtaaataattatgttcagtccaggagtttctttaggtgccaaggatggaacaaagtgacaaagatgtctattcctttagtgcttttgtattttggagggcttgttttggtacaactaaaataaaaggccttataaaattagcctactcaaaatgttctcattttatttgagacatctttagtgggataatttagcatggtgcttggcacatagtacaggtgcaccttgttttattgtgctccactttattatactcagtagacaatattattttttacaaattgaaggtttgtggccaccctgcatagagcaagtctgttggtattattttaccaaggacatgggctcactttgtgtctccacatcacattttggtaatttttcttctatttcaaactttttattattattatatctattatgaggttctatgatcagtgatctttgatgctactgttgaaattgttttgggatgccacaaacctcacccacaggagatggagaatataattgataaatgttgtgtgtgttctcactgctccaccaaacagctgtttcccatctctcttcctgtctctgagacatgaaagtattacaattaggccaattaataacctacaatggcctctaagtgttcaagtgaaaggaagaatcatatgtcttttgctttaaatcaaaagctagaaacgattaagcctaatgaagaagacatgtcaaaagccaagatagactgaaagctaggccccttgtgccaaacagccaagttgaatgcaaagaaaagcttcctaaaggaaattaaaagggctactccagtgaacacacaaatgacaagaaagtagaatagctttatggtcaatacggagaaagtttgagtggtttggttagaagatatggccacaacattcccttaaaccaaagccaaatccagagggagatcctaactcttcagtttgtgaagactaggaggcaaggaagttgcagaagaaaattttgaagctagcagaggttggttcatgaggtgtaaggaaagaacccgtctccataatataaaagtgcaaagtgaagaagcaagtgctgatgatatataagctgcagcacattatccagaagatctaagatcattgatgagtgaggctaccctaaacaagagattttcagtgtagttgaaacagcagtctattagaagaatatgccatgtaggacttcacagctagagaaagtagccaatgcctggcttcaaaggacaggctgactttcttgttagaggttaatgcagctggtgactttaagctgaagccaatgcttattctgaaaatcctaggaaccttaagaatgatgctaaatctactctgcctgtgcactataaatgaaatggaacaacaaagcctggaagacagtacatctatttatagcatggcttactggatattttaagcccactgttgagacctactgctcaggaaagactatttctttctttttcactgctccttgacagtgcactttgtcacctaagagttctggagatgtgcaaagagattgatattgtttccctgcctactaatacaacatccattctgtaacctatggattaagcagtaattttgactttcaggtcttaattaagaaatacatttcatggccaggcacagtggctcacacctgtaatcctagcactttgggagccaaggtaggaggattacttgagtccaggagtttgaaactagcttgggcaacatggagaaacttcatcactacaaaaaaatattaaaaaaatttagctaggtgtggtggcaggtgcctgtagccacttcaggtggaaagattacctgagcctgggaggttgaggctgaagcacaccctgatggtgccaccgtactccagcctgggtgacagagcagaccatgtctcaaaaaaaaaaaaaaaaaaaagaaattgattttgtaaagctatctgtcataaatagtgattcctctgttgaatttgggcaaagtaaatttaaaattttctggaaggattcaccattctagttgtcattaggaaaatgtgcgacaaatgggaggaagtaaaaatatgaacatgaacaggagtttggaagaagctgattccaaccctcgtggatgacttggagggtttcaagaccggagttgaggaagtcactgcagatgtggtagaaatagcaagagaaccagaattagaagtggagcctgaagatgtgactgaattgctgcaatctcatgatacaacttaaatggatgaggagttatttcttatggatgagcaaagaaagtggtttcttgagatagaatctgcttctggtgaagatgctgtgaacattgttgaaatgacaacaaaggatttagaacattacataaacttagttgataaaacagtggcagggtttgagagcattgactccaattttgaaagaagttctactgtgggtcaaacagcatagcatgctacagagaaatctttcctgcaaggaagagtcaatcaatgcagcagacttcattgtcttatttgccacagccaccactgccttcagcaactgccaccccgatcagcccatagccatcaacatcaagtcaataccctacaccagctaaggattactacttgctgaatgcgcagatgatcattagcatttttagcaataaaatatttttaaacaaggtatgtacattttttagacataatgctattgcacacagaatacagtctagtgtaaacatagcttttatatgcgttgtgaagctaaaaaattcatgtgactcactttattgtagtgttcactttactgcagtggtctggaactgaacccacagtatatgtgaagtatgcctgcagttgcttaataaagaaatctttctttaaattttgttcagattgatcaaggatgggcagtgaagtacaaagacttcagaattagatttattggaacctggcaaatgtatgcagtgtattttttattttttgagatggagtcctgctctgtcacctaggctggagtacagtggtgcaatcttggctcactggaacctctgcctcccagattcaagcaattctcctgcctcagcctcccgagtagctgggattacaggcatgcaccaccacagttaatttttgtatttttagtagagacagggttttaccttgttggccaggctggtctcgaactcctgacctcaagtaatccgcccaccacagcatcccaaagtgctaggattataggcgtgagccaccgcacgtggcctacatgcagtttaaaatcaatgctgcttttccacccatctctttgccaccccttaacctgtctttattgctgaaaatgagttatttgttaaaaataggataacttttggtgttcatcctcttacctttttgttttgtgctatattgtgccattttttgcaactggtataaattaaaaaatatgaaaataggtagaacattcagataaaaatgatttattaaatccttgtagtacacatagcatcacaatctacattaggttgcctattttattgtttacacataatgtagaagaattaagcttgatatgccaaaaaaatcttaaaattattttttactataatctgattttgtggttggtacattttatattacagatcttttactttcagtgtattttctttgtagttcatttatattctatgttagtcatagtctgattattttaaatggtcacataaatttcccagtatcatctttaacattttaggagatagtgtcttaaaaaaagaaattgaatataaaattagttgggatataaaacacagtgtaaagaagttatttttcaaaagaatatgtagatgagattttagattattttaccatagaggcagataattatacttatattttcataatgtcaatatttattcagttgatatgtttcttcttttgtgcatcatttggatatttgagtaattattactggatttaggggcttagtacttacagcagcaaaatatttacttagtgttttaccttgcctatttggagaatattattcctttttaaagagtttttttgtggtctccagaaaattagatagcagagctgaaagcccaggccctgttttagtttgttcttcaaaattttgtcctaagtagttctagaaaagataagattaagaatatttgggctggtaatcatagtagttaactattatatttgcctttttatgctttatttcttgaaacagtggttttatttttgttgatgctaatctggttaaaatagaacattgggtaaggaatattaatgaaacattccatataaataaatactacgttataagttccaatacaagcaatcatagactattgcgataaaagcatacttaagaatatgtctgtttaagtgaatgaaataaaccaccagctaaaaacaaccaatctagacaattcagtctgaaagcatttctactacagtgagtcttcctttccctgctcctcagttttgtacagaaaaaggtcctcagccctccattttatttttctggctggttaagtcgaaagcatttatcactttaagttatcttatagtgaaaccagtgaaagatgatgtaacatttcaagtttcaactggacagccgaatttttgacagcctgtcttgggtagataacatctttggcctttgataaattaaaattattttaaaagaaaatcccactcatctcatattgcttgaaggataaagaaggtacttttctttctgatctctgaaatgccctgtattctttcttaactgatgacaggtacgtgtgcatcatggatggggattcttggagatgttggacttctccctgtgcccaacctccatccactttatttccacaggtatttgtcaagtgcttaaagtgtgccagatgccaggtgaggaatacggtgctgcacaaggcatgcaaggttcctgctccgtagcagtttatagtttcatctcctcatacttcgtgtttcttagtgtaggaaatatgaattaatcactctatatgctgcccccctctgcccacccagtgtgtaaataggttgcctttcaaaaggtggtatgtaaattagcttgtttggtacagggaacatagtcccggcagagaaaatattatgaattgtaattacattgccagatggttatagttgaactccagaactaacaactgtggtttcccattgtctttcagaatgagtttcaactgtaatctaaaatttagagaatctgcttagttttacaggcaagtccaatgcctagaagaatgttctttctcccacccccaacttccataccccttgaggagcagggattttttccatttcttcgtgtagctcatcggcagtgagagggaatttcttcctttacgtattatggtagtggcaaggacaagagagaaaagagtatcctctgcatctgtgacaggaaggagatacaggatcctgggagttaaagaaatgggttgaagtagttatacttggagacaggtatatataaaagctcattctgggcgtggagaatccttcgcacctagaaaaggaatgattggagttcagggtaaatggaatagtattggggtggagtcaggagtggggaagggtaggttggaactagagcggagtgtttaaccgtagtggcatgtagggaacaggaatctttgcagtcagcctaaccggggccttgagtttctcagatgctgcatgtgcaggatggatatttgcaagtcaggttctgcctgtactctgtttccttatattaacatttcctttttatcaataatatcattaggaaatatttgaatgtctatagagcacatggatcagtttttaaaatattactcatgcattttattaaattttctgataagtattagaatctttgaaatcttttcaagataaaaattatattattaagcagaatttaaaatcaatgtaaaataaaattccttaaagagagaagacataattaaataaaatccactaattaaacctcatttagtcaaagcaaagagagaagttcctagcaataataatctaaaaaggaaacaagatttacttacggattacaagcaaatatagaaaaatgacattagtaatatctaagttttcaaagtttattttcaacataaaatgtagagatttaaaagtcacccttgaggacagaaaaccaaataccgcatgttctcattcataggtgggaactgaacaatgagaacacttggacacagggcagggaacatcacacaccggggcctgtcgtggggtggggggaggggggagggatagcattaagagaaatacctaatgtaaatgatgagttaatgggtgcagcacaccaacatggcacatgtatacatatgtaacaaacctgcaggttgtgcacatgtaccctagaacttaaagtataataataaaaaatccttgaaagactaaaccagaataattcttaatcactttttggtgcgatttgtcttgcatttgctatgtaattactggtttcctaatctgggatatattgtaagaatacaacatgaagtacaaacattgcagatactttttctcagttttagtaagtgattttagatacttaattttattctttcttatagttggtttatatgtatatactcaagaatgaaatctgttacagtggcattttatcagtattttcctgattatttaaaatatgttcctttgaacattatctgtaattgaagctacattgcaaggtttagacctggttatttgagttttgtttctttgtttcttttagaggcagagtcttgctctgttgcccatgctggaattcagtggtgtggtcacagctcactgcagtcttcaactcctgggctcaaacaatcctcctgccttcctgagtagctagaagtacaagaatgtgccttgtacttctagtcgtacaggaatgtaccatgcccagctagttaaaaaaatttttttttgtagaggtagagtcttgctatgttgcccaggctggttttgaactgccggcttcaagtgatccctccaccttggactcccaaagcattaggattagaggcatgagccactacaccaagccttctttgaattttgaaagggaactgtcactttagtttggtggtggtggggtaagggtggaggatagagactgaatggggctcaggaaaaaggaacagaggctttttaaaaattgaaataaaaagtacttttactgtggatagaaaaaaaaaacttctaaagccagattaatgaggatgacttatctggaaaagtcagtccccaaatttacttagtcaatatttctaattgttaatttttgtgggtacatagtaggtgtatatacttgagataatgtgacacaggcatagaatgcataataatcacagggtaaatgggggtatccgttacctcaagcatttattcttttattttgttacacacaatacaattctacttttttagttgttttaaaatgtacaataaattgttgttgactgcaggtaccctgttgtactatcaaatgctgggtcttattcattctgactatttttgtacccactaaccatccttacttttcctcgccccactaccctttagactctaataactgtcattctactttctgtctccatgagttcaattgttttaatttttagctcccacaaatacctgagaacatgcaaagtttgtctttctgtgcctggcttatttcacttaacataatgtcctccagttctgtccatgttgttgaaatgacaggatctcattctttttttttatggcctacttcattctgtatatgcaccatattttctttatccatttgtctgttgatggacgctaagattgcttccaaatcttggctattgtgagtggtgctgcaataaatatgggagtgcaggtatctcttcaatatactgattttctttcttttgggtgtatacctagcaatgggattgctggatcatatggtagttctatttttagttttttgaggaacttccaaactattctctatagtggttgtactaatttatattcccaccaacaatgtacgagggttcccttttctccacatcctctccagcatttgttattgcctgtcttttggacaaaagctgttttaactgaagtgaggtgataactcattgaacttttgtttggtttttctctgatgatcaatgatgttgagcgccttttcatatgcctgtttgccatttgtatgacttcttttgagaaatgtctattcagatcttctgcccattttataatcacattattagattatttttctgtacagctgtttgagctccttatatattctggttattgatccctgttaggtggatagtttgcaaacattttctcccattctgcggattgtctcttttaactttgttcagtgtgtcctttgctgtgaagaagctttttaacttgatgtaattccatttgaccatttttgctttgattgcttgtgcttgtagggtattcctcaataaacctttgcccagtccaatgtcctggagagtttcctcaatattttctttctttttttttttttttttttttaagacaaagtcttgctccatcgccaggctggagtgcagtggcgtgatctaggctcgctgcaacctctgcctccaggttcaagcgattctcctgcctcggcctcctgagtagctgggactacaggcgcgtgccaccatgtctggataatttttttgtattttagtagagacaagctttcactgtgttggccaggatggtctccatctcctgacctcgtgatccacccacctcagcctcccaaagtgctgggattacaggcgtgagccaccacacctggcctcctcaatattttcttttaagagttttatagtttgaggtcttagatttaagtctgtaatccattttgatttggtttttatatatggtgagaaatagggatcttgtttcattcttctgcatataaatatccagttttcccagtgccatttattgaagatactttcctttctccggtgtatatccttgacatctttgtcaaaaatgagttcactgtagatgtatggatttgtttctgtgttctcttttctgtttcattggtctgtgtgtctgtttttatgccagtaccatgctgtttgggttactatagctgtgtagtataatttgaagtcaggtaatgtgatttctccagttttgttctctctgctcaggatagctttgcctattctgaatcttttgtggttctatataaatattaggaatgttctctatttctgtgaaaaaatgtcattggtattttaatatggattgcattgaatctgtagattgctttgggtagtatggacatttttagcaatattgattcttccaattcatcaacatggaatatctttccattttttttgttgtcctcttcaatttctttcatcagtgttttatagtttttattgcagagatctttcgcttctttggttaattcctaggtattttattttattttcggttattataaatgggattactttcttgatttatttttcagattgttcattgttgacatatagaaatgcttctgatttttgtatgttggttttgcttcctgcagctttcccaaatttgtttgtcacttccaatagtcttttggtggagtctttgggttttaccaaatataagataaagtcatctgcagacaaggataatttgatttatttctttccagtttggatgcctttatttctttctcttgtctgattgctctagctggaacttccagtactgtgttgaataacagtggtgaaagtgggcatccttgttgagttccagattttagaggaaaggcacattgattgatttgcatctgttgaaccatccttgcacccctgaaataaatcttacttggttatgatgaatgatgtttttaatgtgttgttgaatttggttgctagtattttgttgaagatgtttacatcagtgttcattagggatattggcttgtagttttctttttttgatgtgtctttgtctggttttggtatcagagtaataccagtcttctaaaacgagtttggaagtcttccctcctcttctatatttcagaataatttgagtagaggtggtattagttcttctttaaatgtttgatagaattcagcagtgaagttaatgggtcctgggcttttctttgctgggagtttttttttttattacagcattaattttgttacttgttattggtctgttcaggttttggatttcatcttggtgcagtcttggtagtttgtgtgtatctaggggaatttggccatttctaggttttccaatttattggcatgtagttgctcatagtagccactaataatcctttgtatttctgtggtaacaattgtaatgtctcgtttttcatctctgatttcatttatttgggtcttctctcttttattcttagtctgggtaaaggtttattgattttgtttatctttggaaaaaaacaactttttcattgatcttttgtattgctttgtttcaattttatttatttctgcttgatctttattatttctttccttctactaattttgggctttgtttgctcttgcttttctaattctttaagatgcattgttagattgtttatttgaagtttttctactcttttgatgtaggtgtttatagctataaactttcctcttagaatggctttcgctgtatcccacaggttttggtatgttgtgttcccattatcatttgtttcaatacattttaaaatttccttcttaatttcttcactgaccccactggtcatttaggaggacatttgttcaatttacctgtgtttatatagttcccagaactcctcttgttaccgagttctggttttatttcattgtggtcaaagaagttatttgatataatttcagattttttggaatattttaagacttgttttgtggcctaacatatggtctgttttgaatgatccatgtggggagaagaatgtgtattctgcagctattggatgaagtgttctgtaaatatctattaggtccatttggcctatagtgaagatttggcctatttgttgactttttttgtctgaacgatctgtcaaatgctcaaagagggttgttgaagtctccagctattattctattggggtttatctctctaactctaataatagttgctttatatatttgggtgctgcagtgttgtatgcatatgtatttacaattgttatattctttgctgaattgatcactttatcattatataatggccttctttgtcttgaaatctgttttgtctgatatacgcatagttacttctgttcttttaggtttctgtttgcatggaatatctttcttaatccctttattttcagtctttgtgtctttttagtgaagtgtgtttattgtacgcaacagatcgttggatcttgtttttatatccactcagctacactatgacttttgactggagagtttagtccatttacattcaatgttattattgataagttaagtacttactcctgccattttgttatttgttttctggttgtcttatggtcttctctttcttcttttcttccttcctgtcttccttttagtgaaggtgattttctctggtattatgttttaatttcttgctttttatttttttgtttatctgttgtattctttttgatttgaggttaccagaaatcttgcaaataatatcttataacccattatttttaaactaatgaaacttaacactgattgcataaagaaacagagaaaactagtaaaaactctacatttacttcatccccacttttaaacattttttgtttctatttatatgttattgtactgtctacatcttgagaagttgtagtttttatttttgatcagtttatcttttagtttttctactccagatatgaatggtttaaacaccacaattacagtgtcacaatattctatgtttttctgtgtacttaccataccagtaagttttgtacctttaaatgattttatgttgctcactaatgttcttttctttcatattaaataactccctttagcatttcttgtaggggaggtctggtgttgatgaaattactcaacttttttgggaaagtttttatttcttcttcatgtttgaaggatatttttgctggatatattattctagaagttttttttttttctttagcactttaggtactctctcctggcctgtaaggtttcagctgagaaatctgctgtcagatgtattagagctttattgtatgttatttgtttctcttttgctgcttgtaggattctttctttatccttgacctttgggaattgattattagatgccttgagatagtcttatttcggttaaatatgcttagtgttctataactttattgtacttaaatattaatacctttctctaggtttgagaatttctgttattattcctttgaatagtctctacccttatctctttttctaccacctctttacagccaataactcttagatttgccctttgaggctatttcctacatcctgtaagcatactttattcttttttctttttttctcctctgactgtatactgtcaaatagcttgtcttcaagctcactaatttgttcttctgcttgatcaattctggtgttaagagactctgatacattcttcagtatgtcagttgcgtttttcaacttcagaatttctgcttgattctttttattaatatttcaatctctgttaaatttatctgataacattctgagttccttctctgtgttttctttaattttgctgagtttcctcaaaaacagctattttaaattctgtctggaagtgcacatatctccatctctccattattggtctctggaggcttatttagtttgtttattgaggttgtgttttcctggatggccttgatgcatgcagttgttcatcagtgttcgagcattgaagagttaggcattgtaatctttgcaatttgggcttgttgtgcctttccttattgggaaggcttttcaggtatttgaagggacttgagccccaaacccaataaagctgtggttcttgcagacttgtagaggtactgccttgttggtcttacatgagatctggaagctttccctggattacctggtggaaactcttattctttttctttactttcttccaaacaaacagtctttctgtctgtgctgaggtgcctggagctgcgtgaggggtgacacaagcacccccgtggctataaccactgggtcagacatgaagctggtccagcactgggtcacacccaaggcctgtggtaaccactgtctggctaccacctatggttgctcaaggccctagggctctataatcagcagatggcaaagtcagccaagctaatgttctttgtttcagggcggcaagtttcccctggtcctgggcggatccagtgatgccattcagcagccagggcctggagtcagaaactttaggaatctacttggtattctattctgtgcctgagctggcacccgaatcataagacaaagtccttctcagtcttccctcccctttccttgagcagaggaatctccctgtggctcctattaccccaggcctgcagtgaatactgcctggctactgctcccttcaggacagtgggcttccttctgggccaggacaggtccagaaatgccatccaagagccaaggcctggacccagggccaagcaggtaccctactgtggccaagctggtacctaagctgcaagacaaagtacccttttgtcttccttctcgttttctcaatcagaaggagttcctccttgtagcaactacagctgggaatgtgctgggtcgcacctgaagccagcacatctctgagtcttacccaagacccatagcaagtactgcctggctaccactgctgattattcaggccccaagggctctttagtcagaaggtaatgaatcctgccaagactgggttcttcccttcaagacagtgggttccctacaggcccaggatgtgtctagaaatgtcttctgggagctagggcctggaatggtaacttcacgactctgcctggtgccctatcctactgtgaccgagctggttttcaagttgcaaaacaaagccctctttactcttccctctcttctcctcaagtggaaggaaggagtatctcctatagctttaagctgtgctgcctggggttgattgagggaggagtggtacaagtactcccttggccaccctggctggtgtctcactgggtcatatgccctgcacattcactggctttgagtccagcacagcatcaggacttgcccaggaattgtagtacttgtgttctagattgtatttcatgtttatttagcaccaaacactttagcccatggtggtaaagcttgccagaactcaggttctggccactgggctgggggattcccctctggctagggctggtctatatgctccctccatgagtgccaactgagttctgttcggtgttgctctctgctgtgacatgcagcactgagttccaatgcgaagtcccacagtcactgtgctctccctcccacaatggcacagattctccgtaccatgcggccgctgccgggtgatcgggtagggtggcatcagtaattcaaaactgtcttttctactctcttcagtgctgctttcagtgatccgaagttaaaaccaggtactgttatgactcgtctgatttttggttcttaggaaggtccttttttgtgtgaatagtcattcacttcggtgttcttgctgggaggacaatgggtggatgcttctatttggccatctttctccacttcccattttgtcactttttcttttcttttcttttcttttcttttcttttcttttcttttcttttttttttttttttttgagatgaagtctcgctctgttgcccaggctggagtgcagtggtgcaatcttggctcaccgcaaccttcacctcctgggttcaagcgattctcctgtctcagcctcctgagtagctaggactataggcacatgccaccacacccggctaatttttgtatttttagtagagacggggtttcaccatactggccaggcttgttttgaactcctgacctcgtgatctgcctgcctcagcctcccaaagcgctgagattacaggcatgagctaccgtgcccggccccattttgtcacttttttagtgacttgttctgtatttactaaatacaataattactggctttttaaattcactatgtcctatgaaactataacctcagaataaatcttaatataaaaaatacatttcctaagattttgcaagttgattttaggtatttaagtactttctgtcttagatttgtttataaagtgaaaagccatatacatgttaaagggccattaatttagtaaatattacattttattcagtaaatttacaatatgaatttgatttacattaaaaatatccaacagatcttcacttgcgatcactgtaactaggattaattttcatttcatctgtaaggcatacatatttcaatatgagatgatcattttggtgacatttaatgggaatttggttgataaatgtggctctttattttaaaggaataactggttcagtgaaatagtaaggctatctggattcaattaaaaattaacctgagtggattaagttgatttcttcttttgttgaagttgattcctacctttcttactgtctaaccttttgggaaattttttgagaaaaatgtcaagacttatcccatgtgctttgaagaattttatttacatagcgaactgaggaagattccagttaatgtacttttggggtattctgggggaattatttacaaagcaaataatgatattctttgtgcattatttctaaaataaatggaaggttttctaggtttagattaggcagattaaatgtgatttggatagtctattttgtggaccacccagtggctaaaagtgcccttggctgtttattgcttaggtatctagaaccccatctgttggggttttggaattggctgtctattcagtaaagttggaacctctttccattaagtggtgaaaacacctgtgcttcctaccgcaagaacaaaagaagttaatatagcccatctgcaggtgctacaagtattaacagataagcctccccttctctggttctataagtagggcaacttctttttaattaataaaatttattttttaaagcagtttaaagttcagagcaaaattgagtgtgaagcaccgagagttcatatatactccttctttccctccacacatcctgcctgattatccatatcttacatgtgccacagtggtacatttgttacaattgctgaatacattaagacatcattatcatatatagttcaaattagggttcattcttatatatcctatcagttttgacaaatgtatcctatatattaaccattgtagtatcatactgtattagtctattgttatgctgctataaagaactacctgagactgggtaatttatgaagagaagagatttaattgactcacagatctgcagacttaacaggaagcatgactgggaggcctcaagaaacttaaaatcatggcagaaggtgaaggggaagcaagcaccttcttcacatgcagcaggagagagagagcgagtgaagggggaagtgccatacacttttaaactatcagatctcgtgagaactcactatcacaagaagaacaagggggaaatccagccccatgatccaatcacttcccaccaggcccctcctccaattccccatgagatttgtgtggggacacaaatccaaaccatatcattctgcccctggcccctcccaaatcttatgtccttctcacattgctaaatacaattatcccttctcaataatccccctcaatagtcccccaagtcttaactcattcagcattaactcaaaagtccacagtccaaagtctcatctgagacaaagtaagtcccttctgcccatgagcctgtgaaataaaaaacaagttagttactccaagatgcagtcggggtacaagcatcgggtaaatgctcctgttccaaatgggagaaattggctaaaacaaaaggactataggccccatgcatgtataaaacccagtagggcagtcattaaatcttaaagctcccaaataacctcctttgactccgtgtctcacaaccagggcacaatgatgcaagaggtgggtcccaaggccttgggcacatacagactagttttactaccctaaaaataccctgtattctgcccattcatccctctgtctctctgaacccctggcaaccactgatctttttgctgtatccatagttttgccttttccagattattatgtaatttgaaccatgcagttcatagccttttcagattggcttctttcacttagtaatatgtgtttaagtttcctctgtgtctttacatgaccaactcatttctttctagtgttgaataatatttcattgtctagatgtactacaatttatttcttcatttacctactgaagaatcttggttgcttctatgtattggcaattgtaggtaaagctgccataaacatttgtgtgcatgttttcatgaggaaataagttttcagttttttgagtaagtattaaggagatgaattgctggattgtatgttaagaatgtgtttagctttgtaagaagctaccaaattgtcctccaaagtggctgtcccagtttgcatttccaccagcaatgaatggaaattcttgttgcttcacatttttgtcagcatttggtggtgtcagtattttgaattttggccattcaaatatttgcatagtggtatttagttttaacttgaaattccctaatgatgtatgatattgagcatctttttgtatgcttacttgccatctctatatcttcattggtgaaaggcttttttgttcattttttaatcaggttgttcattttcttgttgttttaagagttctttgcttattttggatcaacagtcctttatcagatgtgttttttgcaaacattttccctcattctgtgccttctcattctcttgacagtgcctttcacacagtttttaattttaatgaagccaaacttaccagttatttctatcacaaaatgttttgtgttgaatctaaaaagtcattgccatatccaaggtcagttaagttttctcctatgttatcttctaggagttttattgttttacattttcatttaggtatatgatccatttttagttaatttttttgtgaagggcacaagatatgtgtctagatttattttgttgcacatctatgctcaattgttcaaacaccatttgttcaaagactatctttgctccattgtattgcctttactcctttgtcacagatcagttgactatatttatgtgggtctgtttctgggctctttattctgttccactgatctacttgtctattcttcagtaccacacttctttagtactgtagtcaaatagtgtcagtcctctgactttattcttctttcagtattgttggttattctggggttttgcctctttatacaaattttagaattaattttttgatatccacaaaataattgctgggattttgattgggattgcattgactctatagattaagttggaaagagctgacatcttgatgatattgagtcttcctctccatgaacatggtatcgctctcatttacttatttcttttttgatgtctttcaacagagttttgaagttctcctcatatagatcttgtacatattttgttagatttatacctgtgtatctcatttctagggtgctaatgtaaatggtaatgtatttttaattttaaattccacttgttcattgctagtatgtagggaagcgattttttctgttaatcttgtgttctgcaaacttactataattgtttattagttccagcaagggtgtttttttgtttattcttttgtatttctacatagatgattatgtcatctgtgaacaaagacagtttgatcttttcaatctgtttgccttttatttcctatttgtgttttattgtgtcaggtgatacttccagtacaatgccaaaaagcagtggtaagagggaacatccttgacatttttatgaccttagtgggaaaacttcaggtttttcaccgttaaatatgttatctgtaggttattagatgttcttcatcaagttgaggaagttcccctctatttctaggttactcagagttttttatcatgaatgggtgttggattttatcaaatgctacatgtatggatgtaattgtaatttttttcttcagcctgttgatgtgaccacttatactatttgatttttgaatgttgaaccagctttgcatacctggaataaaactcagttggttctgtgctgtataattcctcctatacattgttgaatattttgttgaggatttttgcatctgtgttcatgagagatattggtctgtcatgttcttttcttgtaatgtctttgtctggttttggtattgatagaatgagttagaaggtattcccctggcttctattttatgagagattgtagaaaattactctaatttcttccttaaatatttgggagaattcgccagcccacacatctgggcttggctctttctcttttggaacattattaattattgattcaatgtttctaatacaggtataggcctattcaggtggtctgtttcttcctgtgtgagtttggtatattatgactttcaaggaactggtctatttcatctaggttatcaaatttttgagtatagaggtgttcatagtatttattattcttttaatatccatgggatctgtagtgatgtcttatctttcatttcagatattagtaacttgtcttctctttttttgtcagttagcttgctagaggcttatcaattttatttatcttttcaaacaaccagcctttggctttgttgattttctctgttggtttccttttcatcaatttcattgatttctgctcagattttttcctctggcttattttggatttaatttgcccttcttttccttagtttcctaaggtgaaagctaagattattgatttaaaaagtttcttattttctaatatatttatttaatgctataacattctctctatgcactgcatttggtacatttcacaaattttggtaagttgtattttctttttttttttttttttgaggtggagcctggctctgttgcctaggctggagtgcagtggtacgatcttggctcactgcaacctctgcctgttgggttcaagcgattcttccgtctcagcctcccaactagctgagattacaggtgctcatcaccacacccggctaatttttccatttttagtagagatggggttttgccacgttggccaggctggtcctaaagtcctgacctcaggtgatctgccctcctcggtctcccaaagtgctgggattacaggcatgagccaccgcgcctgaccatattttcatttttttagttcaaaatatttataaatttatcttgagatttcttctttgacttgtgtgtgtgtttagaagtgcattgtttaacctccaaatatttttggattttccagttatctttatggtattgatttctagtttaattcttttgtgtctgagagcagatactatatgatttctatccttttaaatttgctaaggtgtgttttatggccccaaatgtggtttgtcttagtgaatgttccatatgaacttgaataaaatgtatgatctgttgttgttggaagaagtagcctatagatgtcaattatatccagtttattgatggtgctgttgagttcaagtaggtccttatggattttctgcctgctggaaccgtccatttctcatagaagagtgttaaagtctccaagtataatacaatagtaggttcatctatttctccttgtagttctatcagtttttacctcatgtattttgtcactctgttgttaagtgcatacgcattaaagttttttatgtcttcttggagtagtgacccctttaccattacataatgtccctcttattccagataggcctccttactctgaagtctgctttgtctgaaattaatatagctactctggctttcttttgattggcattagcatggtatatctttctccatccatttacttttaaactatgggtgtcttttatatttaagatgggtatcttgtagacaacatacagctgagtcttatttttttgatccactctgacaatctcttttaattggtgtagttacaccactgacgtttaatgtgatggcattagtttgagttctccaagaaacagaacctatagattatgttatatataattatatagattatattataagttatatataataaattatatattataacataattatatattatatataatatacacatatacatacatgcatatttattattatgagggattggctcatatgattatggaggctaagtcccacaatccttcatctgcaagctggaggcccaggaaagctggtgatgtagttctagtccaaactcagatgcctgaaaaccatgagagctaatggtgtaagtcccagtttgagtctaaaggcccaagaacagggtggggtggcagggccaggtgttgggaacggtttctgtttgagttcaatgtccagagaactaggaacagcagtgtctgaggacagaaggtagatggcccacctcaagcagagagagaaaatttgctttttttttttttttccacctttttattctattgaggccttcaccagattggatgatgcccattcttattagtgagggcaatcttttttactcactctaccaattcaaatgcaagtctctcccagacacactaccatagacataaccagaaatgtatgatgttttaccacctatctggaatcccttaccctagacctgtaagacttaaccatcacagtgattattgatgtagttggattaatatttaccatatttattactgttttctatttgttggcacttgtactttgttcttatttttgcctcacatacttgtttgccttttgtagttgagcattgtatatgattccatttttctccttttttagcatatcaattatgcttttaaaaaacttttatagtgtttgctctgaagtttgaaatatacatttttataactaacccaaattcactttcaaataacactataccactatatggttagtgtaagtaccctattatagcaaaatattactaattccttcctctcattccttttattgttgctgtcattcattttacttacatataaggatacgtatataagcatacataatcaaatacattgttgatattttactttgaaccaactatctattaggtcaatgaagaataagaaaagtagtctgggcacagtggcacatgcctgtaatcccagcactttgggaggccaaggtgggtggatcacttgagataaggagttctaggccagcctggccaacatggcaaaaccccgtctctactaaaaatacaaaaattagctgggtgtggtggtgtgtacctataatcccacctactctggaaggtgaggcagagaatcgcttgaacctgggaggcagaggctgcagttagctgagattgtgcctttgcacttcagcctgggcgacagagtgagactccatctcaaaataaataaataaataaaaaattttattttacctttacttattcattctataatgctcttccttttttaaaaatgtagacccaagtctgacagatgttaatttctttatctctgaaaaatttattttaaaatttctttcaaagtaggtctgctggcaacaaattttcaatttttatgggtctttatttcacttttgaaagataatttcacaggatatagaattctaggtttggcgttcttttattttttttcctctcaactctactttattcctgcgtacatagtttccgaggataagtcagatataattcttatcttagcttttctgtagataaagtgttttattcctttggcttttttcaagatttttttctttatctttgattttctgaagtttgaatatgatatgcctaggtgtaggatttttttgtcctttatcatgcttggtgttctctgagcttcctagatttgtggtttggtgtttgacgttaatttggaaaaattatcagtcattattgctcagatactacttctgttcctttttctctttcctttcctactgcttttttcattacatgtatgttaaaatttttatagttgtcccacagttcttggatattctgttctttttatttattttttgcagtctttttccttctgcttttcagttgggactgttcttgttgagatatcctcaagtttagagattcttccttcagccacatctagtctactaatagacccatcaaagacattccgcattttttttacagtgtttatggtctctagaatttctttttgattcattcttagaatttccatctctcttcttacattatccatctgtccttgcatattgtctacttttttcattaaagccttagcatattagtcatagttttaagaaaattcctgattggataattctaacattcctgccatatcagaccctggttctggttcttgttcagtctcttcaaactgtacatttgccttttcatatgccatgtaattttttcttaaagccagacatgatgtgctggataaaaacaattgctgtaaataggcctttagtagcttagtggtgttgtgttgggggagggaaagccttttatagtcctgtgataaggactgtgtcttttggtgagctggtgcccctggactgagcttcatcagtgctttttttttttttttttcacccttaaggtgggacaagatgtctggagggggctgcaattggtatgtccttttcctcaggtcagttaggttctgattaaaacccagccagagtatgctgtggcaaaatagttcttcctgagagcagacctggttaggaacagaatacactgtgtattcaaaaatagtttctttatttctccccttgatagaggcattagggtatttttctctgatacttagtgtgagaaccagattgggttcttagaaataaaacttgcaaaagtgtggaggcctctccagtaactggttccccgtggagtttttttactcttggacttgtccacgctgagcctccagcaatttatcaattacagattagattttccttccctggcgctgattcctgcagagatttctgctcagggttttttgtttgtttgtttgtttgtttcttatggtaagctgtgattctctatacctgcctgtctcttcagttttggagggcagtggtttgccctgtgacctcacttattttatggagctaagaatagctgttgatttttctgtttgttcagctttttacttgttgttgggatagattggtgatttctaagcttcttatatgctggactagaaactggatgtccaataggcaactttttatgctttggggcacattagttttataaataatttttctgccactcttaaagagtattgaaatttgggggaaaaggagagtaggccttaaacgaatattattattctgagactaaagtaaacttgagaaacagatggaagatcataacactttaccctgcgtattaattactgagtgaccttgaataaattttgaaatcttcctggctcttaatttttctgatagagttatgaggactaaagagccaggcttccttcttttccttttctttcctttatctttttctttttctttccttttccctttcttcccttcctttcttctttccactaacatctaccaggtgtcagagaattgctagggatgcaaagataatttgtatttttttctagtattaaattctaaaataactagctactatactcagtcataattatttatttgcgtaatttctataacaaagatacagtagttctacaaagaggggaaggagggggtaagagaggatggtagttaggaaaggcttcacggttaagaaatactggattaggctcttcaaggaggaggagccattttcctggtttagcaggaggggaaattctaggcagcagcatctggaaaggtaattagctgtgaaacgatgctgttcatttgggggactgttcggtgtggtttcaacatgaatgtgttacgtgggttgagatacggaatgagattgtagaaagagccatcgctaaatctaggaagaccgtgcttgcatatttacatatctggcccctctcctgtagatatgaaggtctaccgatgatggggaagcaacttgaagagaataacactttcacatcatcttttgacttcactatggaaaggagcaggaataggagaaaagaagaccacttcaaatactattataatagtgacagtgaggacattgccaaataagatggttatgagccatagactataaaattcaaaatacttagtgactggttggatatcagttaagagtaagaaattgagcgtaactgtcaggtttttggtttgagcagctgagtggctatggtgtcattaactaagaggcagaacagagaagcgatggcatttaagttgcctgagggactttcaggtgaatatgctcagtaaacagttgaataaatacatctgcagcttttagcacattgagttggacagaggtttagtagtgcaaagattggctgttttctattgactgacgtagtgggtctgaggaaaatgtgtggaatgagaagaccatgaggtaaccttagggaatgttgatattttaggtctacgtagaggagaaaagcatgtaggaagaacaaaggaatgatttaagatatgggggagaacaagtagggagtgatttgatgttttaactttgagggagtcataatgatgattaaatacactaaagaagtaaactaaaacaaggattgcacagcaatcagtttgggcagaattgtgtggaacttgtattatgggaaggctaccaagcacccctgatttatcaacacatttactagttaggatttcattaggttgcatataacaaaaaacgtaaaagtaacaggattacaatttatttcctcttaaataaatgaagtttgaaggttgagaatccagagataagctggcagtttcgtgaagctgtctaggtatctattccacttgtaccgttttattttggcatccctaaaatggtatattcttgtagcccaagatggaggctgaaactctagacatcacacctgtcttacaaactggtagctggatgaaggaatgtagaagagtatacaccctgtttaagtcttcccacttcaatctacaactctttggccaaactttaggcaagtgaatgtacccagttttaagggagatgatgggggactattattttttagctggggaacaatgtgtctagctaaaaatttggtttcttaccactcagtggagagaccctggaggcaacttccagtttctgcaatagaagggattaaaattgtgtgtgtgtgcatgcatgtgtatatgtttgtgctcagtatatgtgtttggggaagagaataccttattaaggctctgtgcttttggttaatctgctcttttggagcttctatggtatttctcttggaaattactgtggataatcaaaagggaactgttaaaagatataggaatagattctgcgcacaacagtactttgatctgcaatctattctgccttcaaatacatttaattatgcaaatatttagggcagtcaattaagaaaagtaggcctttactaaaatattttacttacagtctataaattacgttttgatatgccaagaaaacactgaagtggcatagtagtctggtttagtaccatgagcctattagaacacattttctatttagatgactttgtaattgtcaatattagtgtaatttatccctttcaaccgttttggaataaaagtatgtttttttaaattatagggtagattaggttaaaaggattcaattaatataaaatgtagaaattatctgctctttgaaaagctaacatctgggagaattaggaaggaataaatatgtttagaaattgcataatattttagagaaaagttttatactgatatacctcttactgtttaatgattctaaatctagttgctccgaatttgctcatttaaccaactgtcattgagtcaattgaataagctttgactggtaggaccacatatttcccatagatataaattggcttggaaactttggaacattggtctacagtgagccatggggaaccacacagacttatattgtgaagaaatagagtttatcttcttaatatttgagtggaggggtatgtggtgagagtggtagcggttgtgctagcagttgccttaggtttaactttgacgtgtgagcttgccacttcttggtcctttacttggtcccaaagtgagatttcctgggcagtataatttctttgagggaaaatactgaatcatgatgttttatagtatttttctagatatagtagactaagcttcaggaattatacatccttaactcttctactcactagttctgttactcttgaaatcatgtattccctctgggccaaattttagtaatgataggattaaataatcttgtacttaggagatattttaaaggttatctggttcaaacctctattcaatggatataaagctcctgcaatatgcctggcttcaacctgtatttttacactttcattgattggacacttctatatcccaactcccaaatggttcatttctcagtctgtaacatttttgaatagctctaatggttacagacaaggtctttggtatgtagtattgagttaaaaattgccttcttatcattttaattcattgatttagtgccaacgtctttagccatgtgaaataagaccaagccctctaatacctgacaacctattaagtatttgggccttttctttttgcaggctatgcatcactgacactttcagccatttctcttgacttgtctcttttctcctcatctttgtaggactattacctctttttttctagttcttatagtctattaatgcattttaaggtaaaattagctcttttggcagggcaaatacacgattaattcatcttgaatttgcagtcaactaaaacctgtcttttcatatgggctgttgttaagtcatatttgtcatcctttacaagtttttttgattcaagcacaggattttacattggtttttgttaagttagtcttaatggatttagtgcagtatttcagagttccctattcttttgggatcctaattcaggaatataaatatattagttagctccttagttttattttcaaatttggtgattatgctgtgattgcttatccaaaatcaaagagttagtctgattattttcatctggacttagggaagtcaagacgtcttagcttactgtctttttatttggtcacccatgggtgctaaatgcttcttagtgcaagtgattagaaagtaaatatctggaccgagtgtggtggctcatgcctgtaattccagcactttgggaggccgaggacggcagatcactacctgaggtcagaagtttgagatcagcctggccaacatggcaaaacctcgtctctactaaaaatacaaaaattagccatcgtggtggcaaggcgcctgtaagtcccagctactcaggaggctgaggcgtgagaatcgctttatcctgggaggcagaggttgcctgagggatagcacgagactgtttaaaaaaaaaaaaaagaggccaggtgaggtggctaacgcctgtaatcccagcactttgggaggccaaggcaggcagatcacctgaggtcaggagtttgagatcagcctggtcaatatggtgaaatcccgtctctactaaaaatacaaaaaaattagctggatgtggtggcaggcacctgcaatcccagctacacaggatgccgaggcaggagaatcacttgtacctgggaggtggaggttgcagtgagtcaagatcgtgccattacactccagcctggacaacaagagtgaaactccatctcaaaaaaaaaaaaaaagaaaaagtatctggagattaatttagttgaagcatatgtcgtgtttaatcttttcttcccttgtctatttttctctttcatttgttgattattttggcttcatatgtggagatcatcttaaacatttattttagacaaaaataatggaagaatcagaataattttatctaaatttgaaaaatatggactattttcttgtatttaaaaattttctgggtatttgcttatgattttggttactaagtttttgtgttccaacagttttcatagtaacctaaattttaattaggaaatgccatgtagatgaatatcttttcaattatatgtgcatataaggcttattttactgtaagttgaaaaataagagaattatgtgaaaaattcttagtaagctgctactaattaataatttcatatgtggaagcattatataagctataaaacactataaatataagttgctattactgttttgtagtaaaaataatataatggagcaaaatctttcttttgcatattgatagtgtagaagaaatgtggctcaatagtagaatattttatgaaaccattttattactttcaagtacatagagaattttattttggcaaccactgtcacatatagtgtagataattctttcatgctattattctttccttaaaaatccccttttctctctgcttatcccatttcccttaattcctgttaaagcccttttgtgaagaacctcttccatggtttcttcctattcaacattcttgatgtttttattgcctgtacacctgtcacatgctcctttgtattattgatcttaattttaattatatgtcttgtcccattagcaaatctgaaaattacttaagggcaagatttgcatcttgtttttttcttaagattttgtttttttcttaagtgctggaacattaatagaagcttactaaactgttgatggtgattagcatagtaagtgtttattcataaactttctcaggatgtttgaaaatggtttttgtttcaaacatttgatgtttagaattatccttatggtactaaattgttaaactctttcttggagtaatgatgcatcccctgaccatattgccacaaattctgaattagtgggtcttatattaattacatttcattggttctcagtactttacacaaagtagatgcttaagagttgactaatgaagagaggaataaacagcctcaaagagcaaatgttgttgatatcttaatatattaaactagggctaagaagtggcttaatgcccagaggaaaaaaataccctgtgattctgattattttatttggagcctttaaaaaatagctccaaataatggtttttaaaaatgattaccatacatttctatcctctaaaatcagagggaaaagattatcctgggtttttcatgaattgggattttcctttgaccatctgcccacttccttcagtggtattagagttgtggaccctgtgtctataggtgtattcatctgaagcatttcttttctgttctgcctgtgtcctaaggagtacaggtcggatatattgctgaaattagcaatgagaaaaactcagaattcatttggagaaagtagaaaatggattataagcactggcatcacttaatggtgaatattaatgtgcatacttaaatatgactgatgaagtaggtataactgaagacatcaccgaatgtgtcacagctagacgagcacagagatttggctagaattaaggaaggaataggggaaacattaaagaagaaggtaaagtggatgggaaaggaaagcagatgtaaagcaaagtagatttaaatgccaaaatggcatgtgtaaagatcacaaaagagaattcacagggggaattaaggaaaaaatagtggtaaagcgaggaggaaattataaataagttattttcaatgcttttccttgtcagaggaaaaaaactttagaaagctttaaagtattttcacgggatataaaatttacattatttagaaagaagatgttttcttggttatagtatgttgacataacttattgttacagtaaacttgttcatctgtacttgaggaaaatgttacatgtagataatttacagtaagattggagatggagataggaactttactaagtttagaaatttttttcttgatacagaaaaactgccaaatatagaaaagcatagaggagtaggaagcttcattacccattgtaataacttttaaaataaattttaacttttaggttcacagcaaattgcgtggaagatatagagatttcccatattctttctgctcccacacatgtgttacctccacgtttatcaacatcccccaccataatgatacttttggttataattgatgaacctacattgaagcctcattattactcgaagtccatagtttacattagggttctctgttggtggtgtgcattctatgagttttggcaaacacatgatggcatgtatttaccattgtagtagcatacaaggtagtttcactgccctaaaaatcctgcattctgtggctttcatccctctgaccccctaactcctggtaaccacttatccttttactgtctctctatacttctgccttttccagtatgtcataaagttggaatcatacagtatgtagccttttcagattggtttctttctcttagtcataagcatttaagtttcctccgtgtcttttcataccttgatagctcatttcttttttctttttcttttttttctgccttctttttttcttcatttcttctttaaaaacaaaaaaaaggggatacatgtgcagaacgtgcaggtttgttacataggtatgcatgtggcatggtggtttgctgcacatattgacctgtcctctaagttccctcccctcaactctcatcccccatcccccaacaggccgtggtgtgtgatgttccccatcatgtgtccatgtgttctcaatgttcagctcccagttatgagtgagaacatgtggcgtttggttttctgttcctgtgttagtttgctgaggatgatggcttccagcttcatccatgtcccctcatttctttttagtactgaatatttcattttctggatgtactacactttatttctccattcacctactgaaatcatcttgcttgattccaagtgctgccaattatgaataaagttgccaaacatctgtgtgcaggtttttgtgtggacataagttttcagttcatttgggtaaataccaaggagtacaattcctgataagagtatgtttagctttgtaagaaattgccaaactgtcttccaaagtggctggaccattttgcattcccaccagcaatgaaggaaaatctctgttactctacatcattgccagaatttactgttgtcagggtttgttgtaattactttgcaaagttttattctatatactttcattactttttacatatatgcaaaatagtgtaccataatttaatcatttctatttagttgaacatacaggctacttccattttgtcttttactgtcagtaaaaaaccctatcataaaaatcctttatatgaaactttttatatacttttttctttagaataaattccagaggtagaactgtactgagatggtagagacacagtttttaagtttcaaaattttaatttaagaacacttggaacttggctaaaattattcctttgggaaataatttgtaaagataattttcttttctgtctttaaattttctgtacaaatgatgaggaccttgactaaatataatgtaaaatgtaacaagacctttattaaagacactaatttcaaatgaatattccaaaatttttttgtaaaaatatttaatattattgactgattttagtaaactttatgctttatttacctattgtctggtggtagtgctgttatacaattaaacggaggaaaggccatttaagtagtaattcaactggctaaaaataaccagcattgaatattaagaaacatgaaataaattgtttataaattaaaacatgagtttaacatggttaatttcagaagtaaaaatgcagttttataattatgtttagtttctttttttaacgaaaatttactttggattgagataagtaggctggataaaatcttacagcctagtcatttttaagctacttaggaatatttggttagagtaactgtgttttggctattcgtatttgaatgcatgaagaaatgttaattctgtgttaaaactgaacaattaaaatttatttgaaaaaactttttttcctttttcctgtttttttttttttttttttttttttaaacttccatataagctctatctttaagtctactgggtagtgctgaattgatgcattatatttattggtttgcatttagctcccaggaaatttctatcaacagtaattgtatcttagttaagtattgatacccactgtgtcctcccagcacgaagcagtgctaattttctcagtttggaaaaggtaactcattacctgttacagcattattctctcaggtggggaaagttagggttgtctgattggctccaagtataactgcaagtatcctttgattgataaaagtaactgttctaggacattttgccatcagttgaattctataagtcaaccgtttctctttccattgatcctacttcaaaattagacctataacctactagaaaactgtgaactcttcattgtgtcacagaataaaaatgcttaataagaaaatatggtgacaaaatttttgttattatattggtgtttctttgtgcttcatattgttttctctgtagaggtaacaattcaatacaattttagtaatttgggcaagtctttcacccacttaaaagttatacttcattcctagtatcgccttttttttgagggaggtaacttatctttacagtaatgatactgtaaagtatctttaagctactttctagccacattagtctggctatagttacatgttgttaaaagcttggtttgagttgttaaaattacccataattgttagaatgagtccatatagtagctttactttaggactaagttagccctgcctctgtatgaacccactggtctctactgaatgctcttggtgttcaatgaggtctttctactgagtagtcagtggttttccagccctgtgggagcaatggttctttgcctgctctagtaaaggaacccctatatggattgttggagcgtgtgtgtgtgtgtgtgtgtgtgtgtgtgtgtgtgtgtgtgtgtgtatctgtatcccttctgtctggtactctgcctcataaattccagctgcctcagcctcctccaaatcttggtctcaactcaagagactgttgttctgtatttggatgtctccgtccttgtactgtgttctggaatttgccctgaggcaaaaagctaggatgatgataggactccacctattttttcccctttcatcaaggtattgctgggaagcattgccttttgtcccgtgtctaaaaacagttgtttcctatatccagtttttagttgtttacagcaagaggtcaaatcccacattctcctccatggcatgagtggaagtctggttctggtgttaatttttatgtgaaaacattgaaatagagtacagcaagacttccaaggttagtcaacaagtattaagaagccaccagtgtcttgggaggatataaaggacaatatgctctctgtgaggataacacagacagaaagtaaagattatgacaatctgtgtatatcaagattccatagaaagtgggagcctgtgtataaaggatgatcttcaaattggattgaagtagagcaaatcatattaacaagtgcacccagcacagtaataccaatgtatactgctaagcaagattgaatggaaatttttactaaactctatagataattatttataatataacattgatttaattagtttttaaaaatttacatttttatgcctttgcccttttcagttctccaaagttgatagtagtcattttaattttgaaattgcctttctatatgaggtaagtgtttacatttctggccacaccaaattatttaatcccaaacctacatgctcagtattacttgtttataatatatgacatcaatgaaacatcagcaaagtagtacttttttatgcccaactatccatctagttgttaaatttttcattgatgtctctgtctgtgttaactaatgcaattattcctgttctagaacattactaatgctcagttcagtatcttcattatctgtatgtagtatgtcagttatctatttctctaaaactcattgaaaatataaaaaatacgttataagtgtgtttaaaacaaaggctgggtattcatgttatttggttccattggcagagattttgacactctgaatctgttttttagcttaagtgttaataatgaggaacttaaaaaagacaatgttaaaaacagatttctaatttttcacacctccttaacagcaggttgcaagcgctttgaacatttgatcaggctgatcctgtttcactgctataactactcacagtcttatgagcagcctttcaaaagctgccaaatgctccttactgctcttcagctggctgtgatccagctaactattggcattttgtcacctaggaatcacatttggacattgataagtatcattggtccacactggaattatacaggaataagagaggttcttttctagatctaaaatgactccaaggctgggcttggtagctcacgcctgtaatcccagcactttgggaggccaaggcgggtagatcacctgaggtcaggagttcaagaccagcctggccaacatggtaaaactccgtctctactactactactaataataataaaaaattagccagacatggtgcctggcgcctgtaatcctagctactcaggtggctgaagcaggaggatcgcttgaacctgggaggcagaggttgcagtgagccaagattgcgccactgcactccagcctgggcgacagagtgagactctgtctcaattaaaaagaaaagactctggaagatctttaggaaaacctaatctattttacgttgtctatatctgaggcttctctagtgactgataccgggatttaagggtgtaggataggaagtggaattcagatgtaggattttagatatatccatccatcagtgctgtgtggcagcagctagaccattctttctaaaataccccttccatagccctctaccttcattttattatttattctctagccttgcttacaaggaaaactacaaaccactgctcaaagaaatcagagatgacaaaaacaagtggaaaaaccatctatgctcatggatgggaagaatcagtatcattaaaatggccatactgcccaaagcaatttatagatttaaatgcttttcccattaaactaccattgatattttttacagaagtagagaaaactattttaaaattcatatggaaccaaaaaagagcactaatagccaagacaatcctaagcaaaaaacaaagctggagccatcaagctacttggcatcaaactgtactacaaggctacagtaagcaaaatagcatggcactggtacaaaaagagacacatagagcagtggaacagaacagagaacccgaaaataagactgctacaactatctgatctttggcagacttcctttatttccttttaaaaggaaataaggaggaaagatgcttttgaggatctttttaataaaacacaacaaagaaaacaccaaaaatctgtcaccccaattaaacaagccaatttatttctttctaaaaaattcctgtttgtgtatagaaattagaaatcagtgtgaacgaattgtttagtaacttccatgttgtcgaacagtatggtatttaattgagaggctgaatcagaggatgctgtgctaagataggtatctaaggggagatcttaaaacttttttccttgaatgccttgaatagaagaaaccaaaggattctacaaatgcctatgtgtggtctgagagagtcattaatgcattcaaaaatatttattagttacctactattttaggagctgaagatacagagattaacaagaccaaaaagggtgcggtggctcacgccagtaatcccagcactttgggaggccaaggcgggcggatcacttgaggtcaggagttgaagaccagcctggccaacatggtgaaaccccatctctactaaaaatacaaaaaaaaaaaattagccgggcatggtggcaaatgcccatagtcccagctactcgggaggctgaagcatgagaatcactagaacccgggaggcagaggttgcagtgagcagagatgccaccactgcactccagcctgggcaatagagtgagattctgtctcaaaaaaaaaaacaaaaacaaaaaacaaaaaaaaaagttaaaaaagtacatacagagataaacaagacagaaaatgtacattatagtagtttaatttcaagagaaattaggaagagccatttttggaagctgttattttactgtctcttctctacctttgcacatatagtgaattaactcaaagaattttaaaattacaaatggggatgcattaatttgcatgccttatttttatatgaatctttttagttgctcaatgttagaaaatggcaaaatgctaacaaaatcatttgtcccattgctaaagttggatgttttcccatattaaatggctacttttcagtttcaaccctacactttctttgaatattaaaaggataggttgcaaaagacaggttctttaataggtaatagacagacctaagtagaaaagtagatataggatattatggtcaggttgacagatgtggccatttattgatagttagatttctcattgtataggcacttatctaatgatatttatgcatagttcataactctgtgtacttcagtattgtgaggcataatcaaatgttgtctagaactggcacacattatatatagtacattttctgaaaagttttgtgaatattaaatcatacggttttataactagcacataaaatgtaaggaaacacttgatgaatcctgttcacaaagttaaaaaatcttttctgtgatacaaagtcatatctactttaattgttctataaattgggattaaaaataagaccattttattagctgacttctgttaaataatgatttgttatatatagtcgtattatatacatacatacatacggacatgtatatatgtagaaagagagttaggaattagctgtgagctaataggtaattaaaaggcagtatttaccttttatttatgtgtttcttggtaaacttgtttgtgaatccacaatactgtcttagaaaacttacctttaatatcttgcctatctttcttattttctaccaattctaaattttagagcattatatttaacctcaaattagataactagaccatagaaagaattgagtaaagtaagatctttactcctttcccagactgtacattcattcgtttacaagaatggttcagaatctgtaattagacacttaagtaacagtctctgttgtagatacctaattagttaaatagttcatctgtcctagtactgttagatgatacctgttggcaagcatgtaatggattttgttcatatgaatggaaagaattcaggtttctttcttagaagttgtaattttcttttttttctttttgtttctgtttttgagattgagtcttgctctgtcacccaggctggagtgtagtggctcgatcttggcttgctgcaacctccgcctccagggttcaagcaattgtctgcctcagcctcctgagtagctgagattacagatgtccaccaccatgcccagctaatttttgtattcttagtagagacggggtttcaccatcttggccaggctggtcttgaactcctgacctcgtgattcacctgcctcagcctcccaaagggttgggattacaggtgtgagccaatgcacccggccagaagttgtaattttcataaggtaaattggaaataattttttttgtttgtttttgagacggagttttgctcttgttgcccaagctggagtgcagtggcacgatctcagctcactgcaacctctgccttccaggttcaagcgattcttctgcctcagcctcccaagtagctgggattacgggcgtctgccaccatgcccggctaattttttgtctttttagtagagacagggtttcactatcttggtcaggctggtcttgaactcctgacctcaggtgattgacccaccttggcctaccaaagtgctgggattacaggcatgagccaccacacctggccaattggaaataattttatttggtgatatggcaatgacattttctcagattttaaaattcatagattaggcagagagaagtcacttaagtgcttattcaatgaatgtatctaagttctgtattatatttgcatgcagaatgaaattagaccctcatctcataacgcagacaaaaatcaaactcaaaatagactgaagacttaaacataagacttgaaaccataaagctactagaagaaaacataggtgaaaagcttcacaacattgcttttagcaatgatttcatggatatgacctcaaaagcatagccaacaaaagcaaaagtaggtaaatgggataatatcaaactaaaaagcttctgcaagagaaataatcccagagtgaagagacaacctagggaatgggggaaaatatttacgaaccaaaccctgataaggggttaatatcaaaaatatgtaaaggaattcagacaactcgatagcaagaaaacaacccaattacaaagtggggaaaggacatgaatagaaatttctcaaaataaaacataccaatggccaacaagtatatgaaaaaatgctcagtgtcactaattatcagagaaatgcaaattaaaaccaaaatgaggtatcacttgacacctgttagaatggctgttattaaaaaaaaaaagagagaagtgttattgaggatgtggatgaaagggaaccattgtacactgttggtgggaatataaattagtacagccattatggaaaacagtacggaggtttctcaaaaaattaaaaatagaactaccatatgatctcgcaatcccactctgtatatccacagggaatgaaatcagtatgtcagagagatatctgcattcccatagtcattgccgctttaatcacaatagacaagatatggaatcaaccttagtgtccatcaacagatgaaggaaaatagactatatatgcaaaattgaatactattcaacctttaacaagaaggaaatcctgtctttaaaaaacaattttttaaagttccaggatacatgtgcagaatgttcagatttgttacgtagtatacatgcgccattgtggtttgctgtacctatcaacctgtcatctaggtgttaagccccacattcattaggtattagtcctaatgctctccctcccctgaccccccacccctcaacaggctccggtttatgttgttctcctccctgtgtccatgtgttctcattgttcaactcccacttatgactgagaacatgtggtgtttggttttcttttcctgtgctagtttgctgagaatgatggcttccagcttcatccatgtccctgcagagaacatgatctcattcttttttatggctgcatagtattccatggtgtgtatgtgccacattttcttgacccagtctatcattgatggtcatttgggtttgttccaggtctttgctattgtaagcagtgttgcagtaaacatacatgtgcatatgtctttatagtagaatgatttataattctttgggtatatacccagtaatgggattgctgggtcacatggtatttctggttctaggtccttgaggaattgccacactgtcttccacaatggttgaactaatttacattcccaccaacagtgtaaaagcattcctgtttctctacagcctcaccagcatctgttgtttcctgatgttttaataattgccattttgactggtatgagatggtatctcattgtggtgatttgcatttctaatcagtgatgatgaactttttctcatatgtttgttggctgcataaatgtcttctttgagaagggtctgttcatatactttgcccactttttgatggggttgttcgtttttttcttgtgcatttttttaagtttcttgtagattctggtagacctttgtcagatgggtagattgcaaaaattttctcccattctgtaggttgcctgttcactctcatgctagtttcttttgctgtgcagatgctctttagtttaattagatcccatttgtctattttggcttttgttgccattgcttttggtgttttagtcatggagtttttgctcatgcctgtgtcctgaatggtattgcctaggttttcttctagtgtttttatggtttgaggtgttacatttaagtctttaattcatcttgagttaattttttgtaaggtgtaaggaaggggtctagtttcagttttctgcatatggctagccaatttttccagcaccatttttatccccattgattgtttttgtcaggtttgtcaaagatcagatggttgtagatgtgtgatgttatttctgaggtctctgttcttttccattggtctatatatctgttttggtaccagtaccatgctgttttgtatactatagccgttttgctatactatagcgttatagtatagtttgaagtcaggtagcatgatgcctccagcttagttctttttgcttaggattgtcttggttatacaggctctttttttggttccatataaaatttaaagtagttttttttagttctgtgaagaaagtcaatggtagcttgatgggaatagcattaaatctatacattacttagggcagtattgccattttcatgataatgattctttctagccataagcatggaatgtttttccatttgtttgtgtcctctcattttcttgagtagtggtttgtagttctccttgaagaggtccttcacatcccttgtaagttgtattcctaggtattttattctgtttgtagcagttgtgaatgggagttcattcatgatttggctctctacttgtcttttgttaatgtataggaatgcttgtgatttttgcacattgattttgtatcctgagactttgctgaagttgcttatcagcttaaggattttttgggctgagacactggagttttctaaatatagagtcatgtcatctacgaacagagacaatttgacttcctctcttcctattttaataccctttatttctttctcttgcctgattgccctggccagaacttccaataatatgttggataggagtggtgagagagggcatccttgtcttgtgccagttttcaaagggtatgcttccagcttttacccattcagtatgatattggctatgggtttgtcataaatcactcttattattttgagatatgttccatcaatacctagtttattgagagtttttaacatgagatgttgaattttatcgaagtccttttctgcatctgttgagataatcatgtggctttagtcattggttctgtttatgtgatggattacatttattgatttgcatttattgaaccagccttgcataacagtgatgaagccaagttgatcgtggtggataagctttttgatgtgctgctggattcggtttgccagtgttttattgaggattttcgcatcgatgttcattagggaaatcctgtcattttgacaacatggatgaacctggaggacattacgttaagttaaatgagtgaggcagaggaagacaaatactatataatctcacttatacagtcagccgttagtatctgtggattctgcattcaaggataaaaaatatttggaaaaaaataaaatcaacaataaaaaataatacaacataaaaaagtataactgtatagcatttacattgtactgggtagtagagtaatctagagatgatttaacatgtacagaagaatgtgtgcaggttatgtgtagatactatgccattttgtataagggacttgagcatctgtggattttggtgtctgtgggggtattggagtcaatccccgtggatactgggggatgcttgtatttttgatcccaggttggttgaatccaaccacacggaacccacagataaggaggctcagttgtatggaatctaaaaacattgaagccatagaagcagcatagaatggtggtcatcgggctggcagtagggaggattttggagatgtttgtctaaaataacaaaagttcatttagattaggaatacattcaagagatctattgtacaatgtggtaatgtggtgactatagttgttattaataacaatgttttatatatttgaaagttgctgagagagtagattttaagtgttctcaccacacacagaaaagataaatatttgaggcaatggatatgttaattagcttgatttggtcattccacaatatatacatgtatcaagacatcatgttgtatattatgaatatttatatgacaaaattttatacaatttttatttatcaattaaaaaataaagtttctgttctgttgtcaaaattttattttaaatagctaaatcctccttccctctaaaaaacctgactaaaattaagtcacacaacaaactaggaaaagaatttgcagaaaataaaccagagatttaatatttttatatagctgaataccttcgatatttgtttagagtgccacaaagtttaatcttttactggtgacataaagctaccattatgattgttgattagaggacagtactgtaataagagttgcccttaggccttctgagggaggcacagggatatttggcccaactccaagttggccatactagtttcactggtttacttagtttttctgccccattcctacttgttggacttcatctgttacttcttatttttgttaatgtttctaccagtagccattactcttatttccttatactctttttctacacacattgtatatatttggggagttttaattttagcaatgaattatgaacatttcttaatatcattaaacattttgcaaaaatatatttccccatcacatgtatttatcataatctaattatttcttctttctcagatatttagattgccagtttttcactgctataattttgccccaggcattattataaattgtttggctttctgattctttacaatagtattttagaataaaaattgctgggatataaaaggatataaaggtttagtatttaattttttattgcttgtttatttctttctaaataggaaatataagctcaggggaagtaatcaaacaaaagaaaagttatgcggtaaaaaattctccctcttattccaggcccccagtctctaggaaaaaaggcctgcaataaaagatactgtttgaactcaaatgattccatgagcgtgggaagcatgggagtgacttgttccagtgcttgtatgtacatacaatatttctgtaatacagatgagagcatactatacaaactgttctgcacttaaaaaaaaaacttatgactttttcattttgccatgttattttcctgaaaagctgcaccatttacacgttcacatttcacccttataggcattgaatactttaatgtttttaaagtttttgctacattcattagtgaaattttgaaatgcttatgactaggaggttgaacagttttttttttttttggagttacttacaggccatgtgtaaccattcttcctatttgaatttccattttcttaccttgctcattatttaaaaattaagatcttcataggtcttcatatacatgtcattttatttgtgctctttatatattaaacatattagcttgacataaggctatatgttatgtcacagatctcacaaatcaccgctaaagaacttactcatgtaaccaaataccacctgttcccccagaaacctctttatatattaaacatattagccttgacataaggctatatgttatgtcctttattgctttttaattttatttaatttttgtagggacagtcaacagttgaacacttttatgtattttttaaatttttatatatctggccaggcgtgatggctcatgcctgtaatcccagcactttgggaggctgaggtgggcggattaccaggtcaagagattgagaccatcctggccaacatggtgaaaccctgtctctaataaaaatacaaaaattagctgggcgtggtggtgcacacctgtagtcccagctactccggaggctgaggtaggtgattcacttgaacctgggaggcagaggttgcagtgagccaagatcgcgccactgcactcctggcacagcctggtgacagagcaagactccgtctcataaaaaaaattatatatctttaattcccttctaattgtataatttttaaataaaaaaaaccccttttgttagaatcatgcaaagtaaagagtaagtggggtcctcctactcttaaaaaatagaagattaaactgaagacctgttctaatccaaattactatagatattgaattcatgaagcctagttgaaggaatatttgactgtcagaactggagaccgatacaattccaattctggaattttgtcaatgttggttgatgtttccagtctgcctccctctgcatttgtgagtacacgtgtgtgtagttgagggacagtgagtctagtatccatcacatgtgtgggtgttatatgatgacctcaggctttggcttttctctgtgttcttcccatcttaatctctacctctgttcttatttttaaagtttaggcgcctgtggtgaccaaggagtaaagaaggtgctgagctgtaccagatatattttgcatttcgggctttggctccctctctagaattgttggtcatcattttgataacttggtcactgatatccagtttaaaattagaatgaaatgaagataatttaaagatgtatgatccattaatcattgataggctttttcattaatcaatgttttttaaaaacgactggttctactttttgcagctgactcttactgtatttgttaatttgtttctatgtatttagatcacattagctactctgctaaatagccactctgtattttaataaagtacttaaatttcttaaagatgaaaaaaaggaaaaggaagatgttaattcaaaagtattactgttcaaatatttgtatattcaatatttatctttaaattttcactgtctagtaatccaaataaaatgttgcctttttctttatatgtatatttttaagacataagatctggctttattgttcatgctggaggacgatgatggatcatagctcactgcagccttgaactcctgggctcaggtgatcctcctgcctcagcctcccaaatcagtgggactgcaggtgtgagccatacaggctaatttttaaaatatatataagtatatatatatattagagatggggttttgctgtgttgcccaggctggtctcaaactccagggctcaagctatcctcctgcctcagccttccacttcctgggattactcccaggcatgagccactatgccctgctcaaaatgttgagttcttctgtttggtgatctcacgttactagacatggcaccaagctgtgatttacctgcatggatggacaatgtcactcccctctgccggaatcatttgtgttcaaacagtatcttttattactgttccgggctgttcccccagaactttctggacattcttatttctggtgaatcagtgtccttttgtcgggagctaatgggaaatacataatctgaagctacagcaaatattatagctcctgctcttgctgtgactcctggtggttcctccagagcaggaaggaggaaagaaaggagtggcaaatgtgggagagatagtgtccttagaatccaatacatgatttggtaattggccaaaattataacaattgttattacttactgtgctttctaatccttttgacaatacaagcaaaatactattcttcctatttgacacatgagaaaactgactttcagggaaattgtgttccattcaaggtgagcaaaaggtactatgaaaacagatggagaaggtgaatttaactttggacgtggtcaatttaagagagaaacatatttttagaaacaaactgactaggtccagtcgctcatgcctgtaatcccagcactttgggaagcctaggcaggaggatctcttgagttcaggagttcgggaccagccttggcaacatagcaagaccctgtctttaccaaaaaaattaaaaattagtcagatgtggtggtgtgtgactgtagtccaagctgctcgggaggctgaggcaggcaggaagatggctatgatcacaccactgcactccagccagatgatagagcaagaccctgtctcaaaaaaaaaaacaaaacaaaaaacaccaaacttaaaacagtagtttagtttggagaagtaggtttggagcttgggacggaagatgtcactacagggataggtttggaaaatcctatacacagaggtgataattaaaatattggagattggttctatccatctgacaaagggctaatatatagaatctacaaagaacttaaataaatttacaagaaaaaactccatcaaaaagtgggtccaggatatgaacagttacttctcaaaagaagacatttatgcagccaacaaacatgaaaaaaagctcattatcactggacattagagaaatgcaaatcaaaaccacaatgagataccatctgatgccagttagaatggtgatcattaaaaagacaggaaacaacagatgctggagaggatgtggagaaataggaacacttttacactgttggtgggagtgtaaattagttcaaccattgtggaagacagtgtggcgattcctcaaggatctggaactggaaataccatttgacccagcaatcccattactgagtatatatccaaaggattatgaatcattctactaaaaagacacatgcacacatatgtttattgcaacactattcacaatagcgaagacttggagccaacccaagtgcccatcagtgatagactggataaagaaaatgtggcacatatacactgtggaatactatgaagccataaaaatggatgagttcatgtcttttgcagggacatggttgaagctggaagccatcattctcagcaaactaacacaggaacagaaaaccaaacaccacatgttctcagtcataagtgggagttgaacaatgagaacacatggacacagggaggggaacatcacacactggggcctgtcggtgggtgagggggtaagggagggatagcattaggagaaatacctaatgtagatgaggggttgatgagtgcagcaaaccaccgtggcatgtgtatacatacctatgtaacaaacttgcacgttccgcacatgtatcccagaacttaaagtataatgaaaaaaaaaaaagtgatacagtgaactttggggacttgggggaaagggtgggaggggggtgagggataaaagactacaaattgggtacagtgtatgctactcgggtgatgggtgcaccaaaatctcacaaatcaccactaaagaacttactcatgtaatcaaacacagctcgttcccaaaaattctatgaaaaaaaaaaattggagattgctgatcatgtattatggagtcatcatggcagtagacttaattagttgttcacccatgcattgctccctgacaccctttttggagcatagattctgattgcctgagaaccattaattttgttcaaaggagattgcagaacatgaatatatgaggtagcattatagataggttttctcagccggatcccacttcatcaccctgttggtaacaatgagctgccacagcagattctaatggtaggaggatgggctcacacccttagaagatacttcagaatctccagttgaaacccttaccccctgttattctcagttccttccaatacattttttagaatcactgttttagacttatagagagagaaagtgaggactgtcacttaattttacttgtaaataggtaaactttttgtttcttaggtactaaagaaaacttagaagcttctaactatattacccccgttaatatgaaaaagaagacgttacaaggaggtaactcacttaaaggaatggggtttattgaaaggacacagccacagatgtaccctggccttgaccgttctgaagtctgttctctccataccaggcctgtcatggtgcccctgcttcattcactctctgcctctcactttcaaattccccaagcttggtggaccagctttattgttcagccttttacttaggtgtggatttctttcctatgctaaccactggtttggctctaggcttagggtttagaagccacatggaattacctgagtctatgtttttttttcaggcagtggggcagaactgccactggcaggcaattttgaggttccacagcctatccaagaagattttacaaatattatccttttccaagatacaatttgccatcatgggcactgaatcatgcggtagagttgagagtcactagtggagggaacaaggtgtggggtatgtgtttgaagaatgtgtgataagaatcaccagcaggattgtttgaaactacaggaatattccaatttcctgtatcccttatgatgtactttgggtgataagccacacttccacagggagatcctgctactgaaaggagcctgctatatagcttattgtgttagggtaggaaaaagagttgagaagcactgatgtaggaagtgtcattcaatttgaatatgtttggagatgtttctaaattacattcatcctcactgtcaataacttactttctatgagtaactttaacaggtctactctctcaaggtgtttagtagctacagaataactctcattttaagtatttggcaattttggaatggggaaagaattaaatggacagagcaactgaatttgtacaagctttctcttttcatgacagatgcatgatatgttttcatgaaaataaggaaaatactcatttttgtaaatgccatcaatctttaacagtcgaaaatctgcttggcaagagaagtggtacaactataaccacagaattgtggttattgttacattgtattgtttactgtaaacctggttcaatattggtaaatatagtgtagcagaaactgaactgttgtgagctatctgggcattggtccaagatatcattaaaaatactgcctcagactaatttgggtttatgaataatattttgttaacagctcaactgaaattgagccacatggtgtagcttcaaaattctgaatccacaagataatgagagtagtttgtgtatacaacacattgaatattctatatttgaatgaaaaatttatacataattttgttaacctttaaactgtaagctcccatatgcttaatatgatctgatatctttaaagtttacataatgctgtagtttgctgtgaatttgaatgccttataaactaaagtattattggcttaacaatcaaatctaaagaataaggagaagttgctgagcaaatattaaaatggatattcaacgcaagttgtggcatatgtttctacaaacagctagagtttatattaacattcgccaaaaagattgaaggacataaagtattgggaaagttcactaacttaattcatttcttttactaatgaaaggttattatgtcttcaaatgggatttagagattattaatagatatagcaatgggaatgagcttatgataagtgagatgattcaagaaaaaatctctatatatttcttgccaagaaaaaatacatttgtctttttcttcatgtgctacttttaattactttaagttctttctgaacatacatgtattattaataattcctattgaaatagtatgggaagggtttatttttggtcactgttagtgtgtaagatatttcagcaatggaaagatgtgcattatttaaagaatgaattttaatattcctcttctcaataaatattttatttgttttccaggttagcactctacgtatatgaatatctgctccatgtaggagctcagaaatcagctcaaacatttttatcagaggtatgttttatatattttctgtattgcattttgatcttatataaatgaatggaaaacacactataataattatttgaaaaaagtttgttatgtattatatagtgaattcctagttatccgtatacatagtatagtttttatagattatgtataagcatttttatccccatgccacttctgtgccactcaatcttctagtcacctttccagccattttctctttttagaaatggaaagtaatattagcatggcaacaataatcaagaaagcaaattttaaaaatttactctaaaaaatttgtgagagttataaaccctcaaccatatctctcactcgaacaatatcataattttggaaaatgtggattttgtttattttgtatggatgatcgctgattgattgtagttagaaaacattttaataaccttatttcaagttcttctctttctcttctccaccttcactttctttctttttttttttaatttcaacttttattttagataaggaggtacttgtgcaggtttgttacatgggcatattatgtgatgctgagatttagggtatagatactgtcaccaggtagtaagcatagcagccaatagattgtttttccattcatgttcccctccctccctctcacctctagtagtctgtagtgtctagtgttcccgtgtttatgtccatgtgtgctcaatgtgtagctcccacttctaagtgagaatgtgcagtatttggttttctgttcttgtgttaatttgtttattattatggcctccagcttaatccatcttgctgtaaaagacatgatttcattcttttttaggctgcgtagtattccatggtgtatatgtaccccatcttcatctaatccaccactgataggcacctaggttggctggaatttgacctttcttacagtggtgcttgtttgtctcctatgtatatgaggatgatgaggattttattgagctctgttatgtgccaggcatacaatgtgccaaggtattttacatatattatctctaattcttataagaaatttgcatagcaggttatattctttccgttttactgatgaggacaacaaggctcagagtgtttatataactggctcatggccacagagcttagtgagttatggaactagaattcagacttaggtctatgttaatcccagtgcttttggtttttcctctatatctgtgctgtccaatatggtaaatactagccatatatagatttttgagcactggaaatatgatgcaattaagaagtgctatatgtgtgaagtacagtattttaaagacagtgtgaacaaaagaatataaaatattaataattttaaaattttggtcatacattgaagtgataatattttgcctatattaggtaaaataaaatatattactaaaattaattttaccttttctttttaaatgtggctattaaaagtttttgtggctattagaagttttaaattagataacacattatatgcctgtatcaaaatatcttatgtaccccataaatatatatactactatgtacccataaaaattaaaaattaaaaaattttaaattatacatgtggctcttatttgtggcccatgtttctatttctgttggacagtgctgcttgaaatcgtattatctctggtgatctcaccagtttggtccccagcacatcaagagcacaacagacaactcattgccaatagttccctgcctgaggtatagccttcttgagatttagctgcagctcaaagtaaacaaacgcacacaaccctcactcttatttctaattaactagtatatgtgaactggtagggcttatttgcagataaggaattttagaggtttagccagaacatgtaagaactcagttgttttactatagaaggaatatatgcagtataataaaaatttgatttcaaaagtttattcaaatcaaaacaaaaatttggtgtatctgtgtttcatgaaatcattagttagaagacttagggcaatgacctttctaagtcgcattcactgatattatagaagaagtgattgagattgcaaaaaggatgtctttttgtattcttaaccactgtcaacttacagtgtcttaaaggaatctatagtgcactctggaaatttaaaatttttgttttaatgcagtagaaacttaaaagatttaatgatctccttccttgtatcaaggaccattttgaattggctcaattcacttaatcctggaaggttcccaaaactatattttcttaccaacattgtaagatattagatacagtgattattaaacctcatcaaaaaagaaaaatgttgctaacttattcaaggacgttcaagtatttggattcaaatgcattatgtggattaagcaaataactagatactagactcctaggctttgagctcagtggaaaatgtatatacagaatttctaggactgtttggtggaaatgaaatcagaatttcagaagagattcacacatattgacaagtatttgtcattatttcattttctctggctgcattttgaatacaaaaactgaggatttctcttaattattagtctacctcactttcacacgagacgtcaaactgaaaacgaactattatcaccaagaagacacattatttctagactttggagataagtgtatgtgattttcagaactattcttcactatctaggctgccaaactctgaatggtgctgtaaaaatgcattatcaatacctaaataaccaatgtaggggaatggctaaattaattgagctgtaagtttttaataatgtaaaataataagttagattaatttggacttatgtagatagacttccaaaacattgtctagtaagagaagaaagccaaagtatgccatgtatctggaaaccctagtacataaagtaatactatatatttttgtgggtacatatttatgaatataaagtatagtatgaatataaagtatagtaaaagttctgaaagaacttacatgccagactagttgttttgggagtggggacattaaagggttcaaagggattttatccttagtcacagaattcttttaaacaaggaatacatatattatttgtacagttatttaaaaacaaaactaaagaagagaaaatatattctcgtaaattatctgaacttaaaagatggaagcctggagatagatttgtgataagccattgctgagtacatcctagagttcttgataatttcagttggttaaattacaatagtttgctatttcctccctcacattttatgttctacagtatctagctgcttgggttttcctgtataccatggggcttctgtcatctgggctttactcagtggcatattccctctgcctaaaactctcctcccctctccaccttagaagtagcttttcctagaacggttttcccagggtttcacctaaggtgatagtacaatctacagggacctgcacatgaagacctttgcatacatgccaggaagttggactttatctttggaaaaagggagcctttgaaggttttaaagtaaaaaaaaaaaaaaaaaaaaaaaaaatgacatcatcaggtttgtactctggtgtcttggtgcccttttgccctaaccatggatggtaaaaaaaaaaaaaaaaaggagaatgtaatattttagagaatgtaataatttatgttgagggttgctttctctctgagtttctcttcgatcaggcagaaaatttgaggccgcttattgtagaatgacttcttaactggtctgagtagtaaaaaaacaatcttacctaaatcctccctagtctacccccaggtttttacctaaatcaaaatagttccatgggaatgtaaaatagggagacttacttatttgagttggttattataataaaatggaaatgattgaaatggcaccaattgttatcaattattataacattatccaatgttctcaccctggttcaaggagaagtagaccacttcttccaaatttgacattcttcctctggatagatgaggctaagaaggaccgtgatgttaatgagctcttctgaatcaggttttactgtgctgggtcacttctttcattagtatgggcttgttcttttgggtgaagttgcgagaaggccaactggaactccaggcattatctgaacaagcaagatgtgtatctcagctgcccaatcttgattttctaaaaatgcccttgtcctgggctatcagaaattggactgctcttgatggcttttgttatcagtcagaagagtggggcacattattattaacccagtcattttttcttaattaaaagaaaaaatggactaacaatagaaataaaaacatttctctaactaggttgtgccaactagctcagtgttacctctgattcatgatagattttaaaccactacctgaatccaaaatgtagtttatgtgacttttcattttttttttactcccaaggggaaaaaatggaatattatttagagatattctcaatacaaagcccttcctctgcttttatctttgttattcttcaacatttaataattacaaacagaatgctaaggaatcttctttccaattctacattaacttttgttactttagattcattagaagctatcctttttctggtcatatcatttcgttatacaaagataatggctgctcttccttgaagttttgcatggtattcatgtctcagaatgaggctcaatacccttaacaaatgaaattaagaattagagttttataaagattctagattttttccctttcttaaaatttttgcattatgactaccccttctttgtcataagttagccaacaagttagcctgaaatagaagcttaaaaacatctaagggattccttcttcagattttattaggattgctaaattattgagcatcatagactccaaaactctgttctgtttgccttttacctatatgaagagagaaaatattaattagtatttcctaaccagtctctcgaactttaattttgaggcaatatagtataggaggtaaaagcaattgctttgggccagacatcctgggtttaaattatgttctacatcttatttactttctcagtttcctagttataagatgatgataattgtaacaatactttagttatgctgtggtttaaatgagttagtatatgcacattgcttataatagtgcctggcctatagtaagtgttcaaaagtgtcattttaaaaaatcttgaccaactttttttctatcttgtatagtttcttatttaaacaaaaatagaggcataaatatgtgcctgatgtgtacatgtgcgttccaagtgtctgtcacttggatggcccataatcctactgtttggtgttactctttctataaaaatgggtccagctctaatccctaatattgtagattgttgcaagtcttctccagtatctgtgagcctttattgggtgcttagggttcttgtactgtaggttcttgctcttgttgagtgattatagccccactctggttctccctcttatggtctatcccttttttatgcctgaagttttctgtttttctcatgatttcagaggtccactaactcattgctcttttgtatgaaagattctcacttaaggttgagggatagccaaaaagattaggcattgtacagtataggcaccaacattaacttgaatactagacataagctaccttaaattctgtggtctccttgctacagggaatttttcactaagctgttttcctcagcatgcctttgccttctatcttgttgacttctcataacctctctcatttttccttttctgaatccttccagacccccgagcttcttcctaagagaccatgagcaacttcctaaattcttgttacatagaaagtcaagtatttgttttcctctctgcattcttccttttgcaccattcctagtggcttctgtctttctgtgtcaaaaaaataaaaacaaaaatagaaaggatccattaaggagttttcccaataagaggtagtcctctttaggaagacttctttcattcttctaaaagaaagcagcactactcaataaaactttctgtgattatagaaatggtctctaatctttgctgttaaataaggtagccactaattatgtgtgactattatgagctttaaatatggctagtgcaactgaggaacattcagttaacttaattttaaactgaaatagccacacgtgactaccgagtatcatgttgaacagcacagttttagatgatctgcttcaaagtatagtcagctttttcttcctgttaaacatctattgcctttaattttttgaattaaaatgtaaaaatttgggccaggcgcggtggctcacgcatgtaatcccagcactttgggaggctgacgcgggcagattgcatgaggtcaggagtttgagaccagcctggccaacatggtgaaatcccgtctctactaaaaatacgaaaattagccgagtatggtggtgggctcctgtaatcccagctactcgggaggctgaggcaggagaatcgcttgagcctgggcagtggaggttgcagtgagcccagatcgcaccactgtactccagcctgggtgacaaagcaagactccatctcaaaaaaaaaaaaaaaaaaaaaaaaagaaaggaaaaatgtttacttcaatttcaactttttttacatttggtttagtatatagatatactcatgcttctatacatgagagattttagaaaattggtgggaacagtaggttatgtctaaattagaagtctcaggaatttagtctagaaagaaacttacacataggtatacaggttattttcttaacacaggaattggttttattgttttatggtattaaaagttattctttggatattggtttaaattaaaaattatgaaaggatttatgggtactatgaaaagtttggaacccatcaccttcaaacctgctgctgcattgttggagatgctgtggaagtgggtctggatctgctgaagaggtcccacattgacaagactagaacccccaaaaaggtactgccggcatccagaatcgtgctatcccggcttcacttttggagccagaggcaggaagcttctctttttcctgttttttgatctcctgctagtgtctcctgatggcagaacttaacaggaagccaaatggcaaggaggttaggaaatgtgattttcagaatcccagccccaagtatagaatggagtatagaagggtgggtgtagggctgagagataataggtaaatgaccagtataccttgccagaagcaaataagaatgaaaaattaagcaaatgtgtgtgtgtatacctgtatatatttatgtatgtacatctatatcattttttcttttttgtacaaatgttagcttatacaccattctgtgctttaatttttgtttcacttgttagattttggaaattgtgttatattggttcatgaaatgtcataattctctttttatggttgtagcatatttcattctatgaaatgtgccatgatatagttcactagccctgtactgatggacatttaggtgtttccagtctctttcaattaaaacaatgcttcaatgaaaattgttacatatatgtaaaatttcccacatgtgaccatcagatagtatgtattttataattaaaccacaagacatgtctttttcctattgatataccttttgttcatgattcaatgtttggttttacatttatgaagaaatgctgaaaatgttagatcatatgataaaaacagcatattcatagacaaggccatgaagtgcagaatatggcattaggaatgggccttgagatttacatgaaagttaaaggagaatacagcccctggctggtcaaatgacagaaggaagtgaggtagataattaagcagcaaaaagccttaggactgggcaaatacacattgatgctgggataatggaagaaaaagaaacagaataaagagaaaatgttattggcaaagatgccacccaaaaacctaaataggcctgaagcccacgaaactcaatacaacagaaaatacctcttcagaaacagcagaaaatttgtttttaacatgactgctgacatttaggaatattttctggccattcctcaataccacccatcattaattcatatttgctaaaaaacaaaattaaactacgtagaatataatttaaaatgaaagtcctccttttccctattccagataatagttgtaggcttgatgtgatttttaaaaatgcacacacacctacaagcacacatatgtatgtatacatacttttttttttccaagcagaaaggttttatgctatacataatattctccaaccttccaaatttccatcttgaaaaaccagtagagcatgattctctttccaggtagctgtatttcattctttttaatgatagcacactgttctgtagtatgtaagtatcaagatttattttacagtcaccactagtgaatgtttctcaggctgtttctaattttcatttttttctaacaatactacagtgaatgtggtttagttttctacaggtcaggattctattttggctcttcttgagcaccattttatgctttttttaaacaagtggtatctagaatagtgatccatttggacttagcaatattcactgtgtaaacacagaccatctcttctgtggacatacctaaaacatagctttaagtgtggttcattcaataactataaaagggtggattttatgttaacttcagtatgatggacggaagttttacctgcttctggcacagacttgtaatttaaggagagaaggatgaatactatgtagtaaaaaatattgtgagcatgaaatgatgatatatgtgatgcttttttagtttctctgaggaataatatgatgtaaaactgtttaaaatacaaatgtattacctcaggcttcttctcataaaagaccatatcaaatacaaaccatataggtagtttcctttagtcctttatctcccgagacagctggagatggactgtggaagttgtggaagtgcatgaggggaggctgcttagtaaggatgaggggcagtgggtctcatagactgtgagtctaatcctacctcccgcacaccctggcattgaaacctagtcatgccattttcactcctccataagctatgtcacattgttcttttaactgagtatagtaaaatctatttatttcacagtcatattatgtaaagtcaagatgaactgagatgaaacataaggacagtactttgaaaaatttgctggtcatatgattaggatggttctagtgattaggaatattagtgtgtctgagtacgttggtgagggtttatttattcttatgttctttcaagaagataccaactagtgaaaaagtggtaagagaaaagtttgagagaaggatgagacataggtttttgactaaattataattttagcaggacatcagagtttttgagagaaggacgagacgtaggtttttgactaaattataattttagcaggacatcagagtttttgagagaaggatgagacataggtttttgactaaattataattttagcaggacatcagagttttgtttctcataaatctcattaaatattatttcttattttttatgaaccaagataatataaaatgtcgatgaactgaaattatcagataaaagatggcatacatatacaaattatttgtattaccacttaggataattaaaattaggatctggcctatatttatatgatgtgttctggtttattgttcatatgtagtttttctaacttcaagttccttaatccctggaatttttccttttagcacctcaaaatggctattacattattattattatcaatattattatttttgagacagagtctcactctgtcgcccaggctggagtgccgtggtgctatctcggctcactgcaatctccgcctcctgggttcaagtgattcttctgcctccgcctcctgagtagctgggactacaggcgcacaccaccatgcctggctaatttttgtatttttagtagagatggggtttcaccattttggcttaaactcctgacctcaggtgatccacctgcctttgcctcccagagtgctgggattacaggcgtgagccactgcgcctggccccatttctaatcttcaaaaaatttctcttattttttgagaacaaattacttgttttacttcaaggttcccatttatttatactttatgtacttaagaactctgaaaatgcaaccaatttcagtgattttaatgacacttaacttttttcatctttttattaaagaggatttttggttgtttctacatttaggaccactttctgagttcctgttttaaaacttttaaaaagtccttttgggataagaattcctaacttcttacatagtagatgatggaaagaattccttgaatttttttgaaatctgtaattacagttgttcacttcttagtagtattaagggcctctgggcatattttactgattggggtattgttacataatttttatgatttaagctaaaaaaactaaggcatatacttatgcatagagttttttttttttgagatctttctggatctccgtatttaaagttgtaattccactttactgttttcctgctctttctatcccccttctctgcttagttttccttcactgcatttgtcaccttctcatataaacataatttacttttttgtttgtttctttgtttgggtctatcttccttactgaggtgtaatttccctaaaggaagggatttctgtcttttgtgtttactgctatccagtgcttagaaaaggcactgtatgaatacttattcagacatccatgcaaaagtatttagtcagaacttttacttttttagagatattgaccttgttttaaatttttattatagtaaactctaacttagctgaaatgtaaacaattagaaagttaatatcagcaacttttaaaaactcttattttatgagagacttatgtcttcttctgcccacaccctcaaatcacgaatttatttaaaaactcaacccttaaggtataatttgaagtcaaaatattaagcctaatctcttgcaagtttctgggtgagtggtgataattgatgttcatattgacagtaataatggtggttttttgtgccttaagatcctgaaataccttctgattcaataaaagaaacagaaagaaagaaaagaaaaacctcaaaaatggagttagctttagaatgatattttaatggtgatctgaatttggtatacatgataactcagtgtaacagggcactaattctgaaatgattttaaatagaagcttaattttctgtttaaatgattcatttttactttttccatttatgctaggagcatagacaattgttgcttagttccaactctgattgttcctttttcctagttacatgtatggtttccagcaagatgaaaactattctgattagtaagttaaaattgtttggcacaaccctaaatactttgaatatttttatatagaatatcactggaattttgtgggtgctggtgacaatgatgatgtaataaagtttttacagggataccctcctaggtaaaagaaaaaaaaaataatagcacctaacagttaccaggcacttactgcatgtcagttactccttttttttttttccctctgagacggagtcttgctctgtcaggctggagtgcagtggtgggatcttagctcactgcaacctctgcctcctgggttcaagcgattctcctgcctcagcctccagagtagctgggccactgagcccggcctgtcaattactctttttattttttattttttatttattttatttttttattttttaaatcaggttatttattttttgctgttgagttgactgagttccttatatactttggatccttttttttcaaatttattattattatactttaagttttagggtacatgtgcacaatgtgcatgttagttacatatgtatacatgtgccatgctggtgtgctgcacccactaactcgtcatctagcattaggtatatctcccaatgctatctctcccccctccccccaccccacaacagtccccagagtgtgattttccccttcctgtgtccatgtgttctcattgttcaattcccacctgtaagtgagaacatgcggtgtttggttttttgttcttgcgaaagtttgctgagaatgatgatttccaatttcatccatgtccctacaaaggacgtgaactcatcattttttatggctgcatagtattccatggtgtatatgtgccacagtttcttaatccagtctatcattgttggacattcgggttggttccaagtctttgctattgtgaatatcgccgtaataaacatacgtgtgcatgtgtctttatagcagcatgatttatagtcctttgggtatatacccagtaatgggatggctgggtctcaattactcttttaagtgattttcatgtactaaccagttttttcctcacaacaaccttgtgatataggtgactattattaaccacattttatagatgaggaaactgagtcacagaagatttaagtaactttcgcaacttcacacagctagtatgtaggaaagttaaagtttatgcccatatcccattctgcttaaaatgaagatatttttaatatttttaccttatgaaaggatatttgaagtgatgtatcagtgagaatacagccacaccaattaaaagcacgctgagtgtttcaacagagaatgtaatatgtggaaatagctaaacagattttaaagaaagcaacaacagcacacagaagttacataaaatcaataatttcagtgagcaatcactagggctgaggcaccaaaaggaagagcttgtggttatcaaaaaaattggaggagaaatctcagggagctgaatcttagacctctaaggagagggagtgtgggactgctgttacttgaagagctcaaatttacctttaacctctgaagagagatattgcccagctgtgctgatacttctgagtggcacaaagagactggttctggttgtgtgggataaagctagaatggaaccagctattgtcacagctattatcactggatgaactgctgctggggtcaccctcacaggaatagtaagctaacagaaaacaaatccatttcccctcttcttacttccagtctccctctagagcatctcttagtttatgggacctaacaggaagccatttaatgaaggacaaaggtagtgtatggatctccagtctcagcatctgaaagaccacagaaagatggatttaaaactgaaagactagagctttataactggcacagtatgaagcaaattcaggaaaatagtggtgacatctctctgagactaatccagtcaacaaatcacttgtaaaatgagtacttgcaaaacttgggtaaaaaatatcatgaaaatgatgaaaaattcaaatattactatagtattttaaatggggatattattactttgtaatatgtgtggaaaaaagtattattaggaaagtaatatctcttttattcattttagataagatgggaaaaaaacatcacattgggggaaccaccaggattcttacattcttggtggtggtaagtatcctttattccatttttactggcttgatgatgcatttcaataggcctgtactatacctgtttatgatttcatgcttcctttttattttttcattttctaaaattttctggaaggtagcactttttaaaaaacccttaaaaaccagcactagtgtaatttaacttaaatatactactattgagttcaactggaattggaaccagtgtgtggaatctccaactgtaagtacaattctgtaacggcttgggatgccataacaaaataccgtagaataggtggcttaaacagcagaattttacttttcacaattctagaggctagaagtacaagataaataccaggatgatcagtttctggtgagggctgtcttcctgacttgtagacagtcaccttttcactgtgtccttacatattggggagagcaagctgtttgtgtctttgcttataagggaactagtcccatcatgatggtcccactttcatgatctcatctaaacctaaggatttcccaaagaccccatctccaaataccatcacattggtaatgcccaccccctcaaatcaggaatttatttaaaaactcaacccttcatttcaatatatgaatttgggagagagcagggcttggtagccttgactctctgattgtcaaactagttataagattgctttcaggctgggctcacgcctgtaatcccagcactttgggaggccgaggcgggtggatcacaaggtcaggagatcgagaccatcctggctaacacagcgaaaccccgtctctactaaaaaatagaaaaaattagccaggcgtggtggcgggcacctgtagtcccaggtacccaggaggctaaggcaggagaatggcgtgaacccgggaggcggagcttgcagtgagccgagattgcaccactgcactccagcctgggccacagagcgagacaatgtctcaaaaaaaaaaaaaaaaaaaaattgctttctacaaagtgggttatcaagttgtcaatgttagacttctgtataggtaattataagcgttggcatgccattatagcttcttcaaaccctcacttttcctcttggggagattgggaatgggagataataatctgattggcatcttttatgtaataggtcaatcttgttccaaaataacagctactcatcaaactcaaaactcccaagaacaaggggggaataagttacaaataagcagttagtgaaataagtttatcttcattttcttgtactggaaaagcatattcatgagaaatagtgacctgatacagtgctcaacagatactgaactaatcaaatggatttttttttttttgcctcgaagaagttatgttcatacctttatatttctttgtatttctgccacatggtagtggtatcttttaaagtttcatttattcataggctttgagcctgtttctccatgcaaacctagaaggtttattgcattctctcaacaaatacttactcagtgtcttgtatgggccagatactatgcttgatactgtggacacaccagtgaataaaacacacacacatccctaccctcttgttgataacagtctatagggaaaacaaataacgaagtaagcagtgagagagacgtatttgaaggggatatgcagagtgccatataggcacatgccaaatacatttcacctggaagagctgatatctaagccaaggcattaagtagatataagagttggccagaaaagcatggagagatagagaagggggatgttttggatcaaccataccatgtgcagagacttagaggtgaaaggcagagagagtatagcacatgggaagaaaagaaagaaattcattatgttggaaattgaggtgatagagtgattagggatgaggctgaatttgtaaactgtgaatttgaattgaaatataaagagaatacaatgcagtttttaagcaggagagtaatactgtttatttacatcttgtcaaagaaaagagtaaaactctgtaaaaaatttgaaaagatttattctgagccaaatataaatgaccgtggcccttgacacagcccttgggaggtcctgagaacatgttcccaaggtggtcagggtgcagcttgatttcgtacatcttagggagacacgagacttcaatcaaatacatttaagaaatacattggttcaatctagaaagacaagactactcaaagcaggggcttccaggttatagtagatttaaaaattttctgattggcaattggttgagtttatctgaagacctgggatcaatggaaaagaactgtctggattaagataagcaattatggaaagcaaatttcttattacgcagatgaagcctgtagcaggcttcagcgagaatagcttgtaaatgcttcttatcagatttaaagtctgtgttgatgttaacactggagaatataatgaggcaagtcccactcccacttcctgtcatggcctgaaccagtctttcaggttaaatcttaagagtgccctggccaaggaggaagtccatttagatggttgggggaccttacaattttattttaggtttacaatcttagccatgtcactctagttctatagaatagataatggatggaacacgaataagtccagaaatagaggagcacttagaaggctcgtgcagtaaggagtagagaatggttacttgaactagtgtataatcattgcggagcaagagaagtagaaggatttgagggatataagcttgaagtagaaatggtaggatttggtgaagagttcagctgttaaggccctgtgctgaaactgaaatacataccatccaagtggagatgttgagcaggcatctggttacatgggtctgatgtttaaaggagagggaaatgaagctgggtgcagtggtgcgtgtctatagtaacagctactcaggaggctgaggtgggaggatcacttgaacccaggtgtttgaatccagcctgagaaacatagcgatacctcatctctaaaaaaagaaagagagagagagatggttgaatggtattacccatgagtggggagggaaatgagccttgtacagaaaccttgcaatattaacatccaaggaatgaggaggaagaagaggctgtaaaggagaaagaaggtggccaggtatggtggctcatgcctgtaatcccagcactttgggaggctgaggcgggtggatcacttgagatcaggagttcgagaccagcctggccaacatggtgaaaccctgtcgctactaaaaatacaaaataagccaggcactggtggcaggcacctgtaatcccagctactcaggaggttgaggcagatgaatagcttgaacctgggagacggaggttacagtgagctgagatcatgccactgcactccagcctaggtgacagagtgagactctctcaaaaaaaaaaaaaaaaaaaaaaaaaaagacagaggctcagctaaaaaggtaggaggaaaatcaggagagtgtagcataatagaaaacaagaataagtgagggttttctgaaggaagaagaaaggtcagtagtgacaactgtgactgcaaggtaaagtaatcagaatgcatatgtccttttaggatttagggaaaggccatcaatgacttataaagctgagtaatgggctaggaaacaagaatgtttcagattcagaagtgactgtgaaggtaggaagtgggaaatggtatatagtcaactctttaaaatggttcatctatgatgagaaatgatacctggaggaatagtgtaggttagaaaaagaagtttttcattttagatgggagagacattagcatgtttagtgtttaagagaaggagacagtagaggggcagagtctgaagatacagggagagaggagattttaatggtttaaaaccccatacaaggcctgagagaaggaggtccaaagcacaaatgctgggaagtgagaggggagaggaccatctctacccttgtggcaagaggagatgcaggaatgtttgtaggtttgatgtcaagaagttcatttcttctattcctaataaaatactgttccttatatgtccctgcctcctgccaatctggaatatatgcatagggctttccttctgaatttaacaatttttggaacctagattaaggtccttacccctaatatcgtatcttcctcaagcctgccactaactgtctaaatgcatgaggaatttcccatggagtattttgcatttgactggaagagaggttggaatagaagacagaatagaaacgaaagaaaagtttagggaatgtgcaaataaaaggaagcgttgtaaaaattatagtacatttgttcttgggctgttattacacatttaataatgatgaacactatataatgacaaaagaaatgcgtaagacattttaacaaagcaggacatagtgttgcatgtacagtgtagcataaatgggtattaagagaaaaaaaataatttgttttaatatggttggattacagatgagattttctttctgcaaatatttccattacttataagtagaggtttcccctctatcttcccaattttctacagtatgatcatggtgtgtgtggagttgcagggtgaggcaaggagaaaggaaaacatgtggattcagtgtctcagctccactacttatcatttcagcaaggttttgttgttttcagtctcagttttaccatctgtaaaatgatgatgagtcaaattgatctagggttcaaaaaattagttcttattctgatagcttttctttttcctctgcaaaataggatgtgagggtactgagggtggtggtggtggtgatgatgatgatgaatttttaagagagtgaaggatagtctttaaagaaaagtttgaaataattctaagtagacccagagaaagaactgagtaggcgcacacacaaaatattgccaggcagtgtttaaatcctagttaatattgtagcttatgaatgcattgtgatgccagtatgcccaggaatgtgacttttctgcagcagcaattggtagtccatgtatttacatggacaagctaggtggggtgttttttttttttttccatttcttctattaaaagaatttcttactcagtacggtttacactcgtctcttagcatctttaagaggaaaaaacaaaagctctctttgagtgccatgcacgtggtttccttggaacgttatttaatgccatcatgtttttaatctttctcctgaaagcatgccatactagaagtcctatggtgagtggaaccgcacttggtcagttgtggttgtgggtttcccctgtttgtctcacatatgtagggcaggaacaggtgcggtcttttggttcagagttgttccaacggttcactacagttaagcaccatcattatgctgttttcctggggtttaagactggcattttgtaaatagtataaaattcaaattttctttttatatagtatttatgatatccagatctagcctgtcaatacttaattttttttccaaatgtaattgagtgtcctcacctgttgacaccttttcattttgtgtgtttccagtgaagtctacaaatggcataagagaccattttaggagtctgacttggatcagtgggttaacaaagtgacgattttaagagtgttctattgtagcattaattttgtttcttacacctctttctcttttacatgctttctcatgaatttaacttattcctacactgtagatgtttggtaataacttactcaatactttggctttttgcttctgtagctttttttttttttttaaccttagctgtcagacggtgcagcttttaaatgtgccatttttttcctttttctgtggctcttagattcaggggatcccttcttccatggcgttggtattttaaataacttaatttttactcagctgtagataccaaataagtaagtaatgggcacataaatatttttagattatatttgttcagtttaaatctagtacatgctaaatatataggtacagttttttaatgttttatattttttcccctaaagctactgacatactctttgagatgcctccttcatctatataaatcaatgattcttaatagttttgaagtcatggggtcctctgagaactgatgagagctatggatctcatctttcagaaaaatgcccagatcttaagcttccctgattattgtgtttcgctagccattaccatgggctttaaatccagcagatgcctgaccttcttatccttaactctttcaacctggacttcataatctgtgccctaggttagggattcaggactctaataattgttgcctttttatgttgaccaggaaagctgttgctgctgttgaggtctacatgattaggataacatgcattcttcaggaacttactgcttgctcatttgctcaacctaagagtccctgctggatggaccagttgttaattttatgacttcttctcatttccattttttaatagaatattttaaattagaattgttctgttgtttaagccttttcaccaaatatttacagagtgcaaaacttgttgtcctcaagggaataaatagcaggaaagataaacaatttaaaagtattaaagcagaagtatgtactggtttaataataatgtattatagacttgatatttgctaagagagtagatcttaaatgttcttaccagacacacacacggacacacaaaaggtactatgtgaggtgatgaatatgttaattagcttgattttggtaatcattttccaaagtatatgtatatcaaaacttcacattgtacatcttaaatatatacaatttttatttgtcaaccatacctctataaagctggaaataaacttaaaaaagaaatatgtactggttataatagcaacacaggagcaatactcactttagcttgggagagttagaaaaggcatcatagagaaagtgaatctgagctgagctgaaagttgagtgagagaagggtaattggagcaaggaataatgtgaaatctcaaaagggatgatcatacactcaagtaatgacaggtaatttggtatggaccagttcatctataggtccagtattaggaagtgataaaatataaagagacaaaagcaggggacagattatgaagtcctgcttacattaaggatttgggactatatcccaaagattttaaaccaggtccctgatgtgatcagatttgtgcctttagacactcagttggcatcaacataaagatcgattaaagagggtccaggtgtggtggctcacgcctgtaattccagcactttgggaggccaaggcgggtggatcacctgaggtcaggagtttgagaccagcctgggcaacatggtgaaaccccatctactaagaatgcaacaatttgctggatgtggtggcgttcccctctaatcccagctacttgggaggctgaggtgggtgaatcgcttgaacctgggaggtggaggctgcagtgagctgagattgcaccactgcactccagcctgggtgacagagcaagaccttgtctcaaaaaaaaaagatggattaaagagggttgagaaaagaggcagagactagtagactcgggggaaaagttggtgaagagtgggagtgtttgaagatgtatgaaaaagagatacatatgacatatgcaaaataagcagaacaaagtgccagcgagatgagaggcaaaggcctcagaatggaagagggggaatttctgtctttaatataggatagagaaatttgtgtgattgactttctggagcttttttcccttgtttctaatgtgatttccctaatcactttttcttttcctttttagtttatttaccccatactcagcatcccagtttataatacatttacctgaatcaaatcccctctgaaaacttgcttcttgtttgtactttttgttaaacattcccaactcttacattagttccagaaataaaaatgccaataagcttctttcttctgatgttaatgtgtttttttacttgtgcaattttaaaacataggcttttaaaaactttctatttaaagttttaattgcagaaactatagctcttgatatgatgccttttataactctcatatctcttgatatagtttggctgtgtccccactcaaatctcatcttgaattgtagttcccataatccccacgtgtggtgggagggacttggtgagaggtaattgaatcatgagggcgattcccccatgctattctagaaatagtaagttctcacacaatctggtggttttgtaaggggcttcccccttcgctcagctttcattcttctccatgctgtcgccatgtgaatctgccatggattctaagcttcctgaggcctccccagccatgctgaactgtgagtcagttaaacctcattcctttataaattacccagtctcaggtatgtctttattagcagcttgagagcagacaagtacaccttttttttttttctttttttgagacagggtcacccaggctggagtgcagtggcacaatcatagctcgctgcagcctccatctcccgggcttaagtgatcctcccacctaagcctcctgagtagctgggactaaaggagcatatcaccatgcccagctactttttcatatttttttgtagcgatgaggttttgctgttgttgctcaggctggtctcaaactcctgggatcgagactcactcgcctctgcttctgcctgccaaagtgctgggattacaggcatgagccaccacaaccagcctatacctcatttttatttaacaaaataaaaatatagagcaccttttaaagtgactttggtcccctgtatttatatcctgaaatcaaatatatataacattgtagagaaaataaaatataagattattctaagaattctgtttctttcacctggtggtggaaagtccaatcttgtagtatgctagcactctaattattttagaacctaatgaataatatcaggtatagctaagaataaccaaatacccacaggaaaacaagtgcaatggcattagttagctcactagaatggtataatatttataattggcttactggtttttactcatctggtatgtctttcctataacaggcaaggtataataactatttgagttgggttaaactaagcatcgtataagacagtgtaggtgacaacggggctagaaggaggaggctgataagagtgagaagggagaaaaagtgttagcaagagagaaggcaaaaaacataggccatagagaacaaaactaaaattcagcatgggagaagaggaaaggcatgtggaatacagaggaaaatttggtggggagagaacattgtaaaaaacggagggaatcttcattaaatgtaaaggactcaaaagaaaaatgaggcaaatgttactcaagttaattagaaaactttttatttcgctatactagctatatgagactttttctataatatttttagtacctttaagcttcttttaaaattacttttgcgtatgtcatctctttgtctctgtataaaacactgtaaaatacataacatttattttctctttttacataaatcaaaaaactatttgcccaaggtcaaatttagagttagaattcaagttcctgaattgtaaccagtgctcatctcagtaacacatatttcttaatcacagagctcaattcagtgtcccactattaataagtcattaattacatttcccatttgagcattgtgagtggctaattccaggcagtgtatataaatgggactcaaaagttttctcttctgagtcatgtctatattgaggcatccacggatccctggcagctgcatgtagggtgagggggtggttgccataggatattcaggaaatgagttggtgcatggggtcaaaggtaggctaacaatgtgcttgctgtcttatctggtacagatatccatcccactcttataatagctgatgctgctcagactgctggaactgtagaaacctgcccataatcagaataaggagtcttgcattaagaactcttaaaaccacactcacgttagaaacaaaataacgtaataattaaaaggctcaagcccagctctgccactgtgtgactttaggcaaattatttaatctaatttaacctaagcttcagttccttcatctacaaagtggggataataattagaaggattagatgttgaatatgtgatacttcgtatatgatgcttgtatagtacttactcaataatggtaactatcttcattatattttaaaatagaaattgatttctaatccaggagtattgtgagaattttataaaagtgaagcaaaatttaatgctttcatttttaaaggtattaagtaatgctagggaataatattaatacaagttatacatatggggaagttctaagatgaagaacaggtacatacacatttcatgtgaaactgtttttggtcttatgaatggataggatagttttcttaaacagagattgtcagtaactaacattcattgatatatttttgggacaaagacaaatgacttccttagttattaagacttgagcttataacaacgtggcttgttcctcagaaaaaatgttttccatggcgttttattgttttgttctgtcttttaaaaaatttttgttgtcgggtagtcctagatctggccagtggcataagttgtataattatgttagcattccatcttctgggacacatctggcatgtttattcacccttgtagacttctctgacaaccattttgctttctgtgttcccttgagatattaacaagctacctaagtcatttcaacttacattctcaggaatagagggagatacagtgtttggttgagaatcttcaacttgggaatgccgtattttctcttgatttatgaggggaagattttaataataataaatgatatgagatcaaagacttcaatactttgtaagttttgcttctctgtattcagtctgtgtcttcatttgtaaaatataaaattttcacttgtttctgcttgggaataaagagtgtataaaactctaaagtattattcatgatgatgaacccattacatttcaaggataatatttgctttcatgtttaatagttgtaggattagaggaactgagaagctccttagtcaccagcatctcaggttgtagaggggcaaagtctgcatctttagaggttcaaaattttctgagcttggccctcttggagataaaggaacaagtacagtggatcatcagaatagcttactaaagtacatcagaaaaatccctcgacccaagcacaaatcaagtattgctatgaaacttacctaaactaaaagtcctacttcttcctctaggagataagtctacatttttgtatactaattatcacattgtcataatatcagccaaaagcatttgttaaaaatattagtgaaatttttatatatactatataaccttacatcaagttatgtagcatatataggtgaagtgagcaattttgagcaagtgagcaattttgagcaagtgagcaattttgaattcatcactagttttggaccaatagtcacatttgtgccatggattacatacctttttattttcttgggcagtgtatggcagcatattatatagacgtggtatttaatgcatatttgaaatattactggaagaaaatagtttttaaattttttattcatgaaggtttatagaagtcttctggttttagcctcattattttctaaataaggctataacattatagttaagtgatttgtctactagctcacaaaaccaagcatggattaattgcagaatgtggactaaaatcatatattttggtcttactacagcctttgttgttgatgtcatgatatggccaattgttctcaaatattaggatggtattataccagtcactatataggttgagcatccctagtctgaaaacctgagatccaaaatctaaaacttttgagtgccaacatgaaactcaaaggaaatgcttattagagccttttagaatttggattttcagatttgggatgctcaaccactaagtataagtataatgaaaatatttcaaaatcaaaaaaaatttaaatctgaagcacttctggtcccaagaatttcagataagggatactcaaccttgttttacaaataggcaaaatgtgatcgaattttctaaaaatgataaaattttgaaatgtctttcctacctgtgattcttagaaggaggaacatacatatgcttaataaaatagatggggcatgtgttaaaacttgaatatcatagcactaaaactaaatttgtatttaatttttaattaattttatcatgtaaatttcataacatatcctagattattatagacttaattatgaaactctcctgatgagtagggcttttttaaaattgaagatttactgatctttagaatgatagaatagacattgtaaatgtatggaaaataatacacacttgtcctagacactaagatatgggacctacctagcacaaggcttgccatgagacatgtttttaaaggctctatttctttgcctatgttaaacaagatcatgtataagcaatacaggattctcagaaacaccacctataaaattatcctcttttaatcacttgttttataatctctaaggttggtcttataaatatttgaccttccactaaatccataaaggcaaacatagaaatagaagtagaacaatgttactattataagataaatatttaatttaactatatatttagaaataattatttctgatgtttatttaataactcttagggcatacgccaacaataaatcaataaattatttccccccagtccattgtgtgaggtaatcttttaaaagtactacaatggaccgggcgcggtggctcaagcctgtaatcccagcactttgggaggccgagacgggcggatcatgaggtcaggagatcgagaccatcctggctaacacagtgaaaccccgtctctactaaaaatacaaaaaattagctgggcgcggtggcgggcgcctgtagtcccagctactcgggaggctgaggcaggagaatggcgtgaacccgggaggcagagcttgcagtgagctgagatcgtgccactgcactccagcctgggtgacagagcgagactccgtctcaaaaaaaaaaaaaaaaaaaaaagtactacaatggaattataaaagtaatgcaattggaatacttttcaagagaggtcttctgttacttgagtggaaattagggaaattaggaaagaagaagagatattatattgtttgtcatataatgctgcatgtaatattctttgattaaatacagtttaaagactacattacaaaacttcggttttaagatctttgaagttctttaagaacattactgcaatacactgtaatgcataacacacttgatccaggtgaaaaacttttagctgtatccttatctacgggttttattattcccagtaaggctgcaaggatttcagttataactttcactctcctaaaaatattgaaatttatttaaattatttttgtttttattgttttctctgtatttactgcttattatagaaattgagaaggaaataatgtcgatacgcagtttttcacgtttttccccgctgaaggtaatcttactttactgaattaattatgaacttaactttgcattgtaaggcttacagaatgttttctcctagctgagaagagagagagagatccagactaaatgaatctttgaaggttgaaacaaaaagtctggcttcagtttaccaagttttgttgtatcctcatcgtgtgtgcccttaccacagtgacctgccttaaaaatatatatgcattttaagctttcatgcaaactaattatagtgttgatgatattattgataacattcttgttatatgtcagacactgtgcatatatggtataaattttatcttctcagcaaccccattttatagaggaggaaattgtgtttctgatcagtttaagcaacttgctcaagggctgtcacagctggtaatcagcaggtctggctctgtctcagatatgtcctgctccagtgcctgtgctcttaactacttgtcttaatctaccttccacttttataggtgggaaatgtggaataaaaaaataactctatcgataattgtaattgcctttatttatagccaacactttaaaacatttgctttcctgatttttgaatccttgtatgtgctcattgttaatttagtagatggaaggatgaccagagctgtatgttttgtaaggagcataatttttcccccccagtctgcttcacttcccactgttcttgaataggagaaaaaaagaagtgttaacaatgtattttctttttttttttttttaattttttttttttattatactctaagttttagggtacatgtgcacattgtgcaggttagttacatatgtatacatgtgccatgctgctgcgctgcacccactaactcgtcatctagccttaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcaatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataggcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttaatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggtgactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgaccagtggtttgtggttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcttctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttgcagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcccataaaatgagttagggaggattccctctttttctattgattggaatagtttcagaaggaatggtaccagttcctccctgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagtgatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttcatctttgttggtttaaagtctgttttatcagaaactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattggttgatgcggtttcttcctagtctcgatggtctttacattttggcatgattttgcagcagctggtaccggttgttcctttccatgtttagcgcttgcttcaggagctcttttagggcaggcctggtggtgacaaaatctcttagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgaccgttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcattcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgtaggtctgttggagtacccggctgtgtgaggtgtcagtctgcccctgctggggggtgcctcccagttaggctgctcggggcacaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggtgggcgcccctcccccagcctcgctgccgccttgcagtttgatctcagactgctgtgctagcaatcagcgagattccgtgggcgtaggaccctcggagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggaggtgtagaccggagctgttcctattcggccatcttggctcctcccaacaatgtattttcaaagttactaaactattttggtaactgtggggaaaaacaccattatttagaaaatacatttgtttaaacaatataatttaatggtcagggtattggcctatgagttggacaacaaaattatctgtaaaaaaatcaatggaccacttgattccttaattattaaattaggatattatttactgtttctattcttcatgggaaaattgtgaaaagtattacagctactccaatcaagtgttttatatcatgtaaacagccagttataagaatgacaatttttaaattattgctataaatttttttttataaaagtcttatttagcatttctgaaagatggctagatggtaacactgttattgcatgaagagccttgcttgcgtttaagtctttcagatagatatctgttctgaagacaaaacattttgtataaagaaaaacatgtcttctacttttggaattgtgatttctcatattggtgttgtatgattttcttaatgttaccatgattacttttttagtgtattttgggatctctactgtgcagctccagagagacgtgaaacatgtgaacactcaagtgaagcaaaagccttccatgattacgtaagttaacatataattttacaaagttacactgtcagttttctgtttaaccactgctcttaaaaaatacactggctcatctattcttttgttttggtacttaagaaattgtttggtctcttttttcttgaaaagtaggttcataactttaaatgtgaaatagaaaggggcatttgagtcttgttaaagcttaggataaagcgtaggcctaattctaagctattaaagaaatttcttatctttaagcatgtctgatttgtgaaatttcagattttatgaaaattaaatatatagtaatttttttattctacaaaaacattcattataagatttctgtaaatgataaatttctcccttgcacataagatttttgattaaatatagaaatactctattcttctccttttataacttttggttatatatcataaggctaaatatcttccctgctgaattcacttccccaaataaaatttattgtggattaaaggaaataccagacaagagtagaagattctgtgcaaaaatgaaaatgtaattttttttttaattcttaaggaacggcagtggagtgtccttggcttgagcatttttttttagaaggactgcaaatctgattttagagagctgatagtatcagaaagtagaactgtgaaaagaaaaaaaacagtgaagataagaatgagaagatggtattatgaaggggctagggaaacatgtttgcagaactaaccataaaagagggacagattgagtttaagatggaggaaatcaagtttccttggttgggaggaagtgaattggggctggagcctgaggaaataactgatagtaagtacctaaaacttaaccatagggatacttgtcaagtttgtggaggctggcatcattctgtgtaaaatgccttaaaaaccagaaccagcgctcaaaagggaaaaaagaccttgttcttccaaggaaaataattcagccttagactgaagagttagaaatggccagaagaattataccctccaaaatagcatgaggaagagcatgcagacttacgggaagtgaaaatcttggctacctggcagggactgtgcaattctttttttttttttttttttttttgagacggagtctcgctgtgtctcccaggttggagtgcggtggcgcaatctcggctcactgcaagctccgcctcccgggttcacgccattctcctgcctcagcctcccaagtagctgggattacaggcgcccgccaacacgcccagctaattttttgtatttttagtagaaacggggtttcaccgtgttagccaagatggtctcgatctcctgacctcgtgatccgcccgcctcggcctcccaaagtgctgggattacaggcgtgagccaccgcgcccggcctgtgcaattctttaaatgtgtactaaccttattcaagtgagagtgcttgtgattacctcatctgacattgattgtactcataaagcttgttacacactgaacaatagctcttggggaacaatctgagtgaatgggatgctactgcaaataaaaagtagagaaaaagtagataaagcagggcccaggacatgggatttatctgaacaacctcattttccttttttacccttggttgacagaagaaataaagcagagatctacccatgaagaatatgaggaattggatagagtggggtaccccatctcatcttttccttatactaagagatgcgtgccttgatttggcctgtcagtcacgggagatattgtctccactaattttgacaactagatggcattagagagtgccagtgttctactcttaaaggagatacaatatttgatagcctacattttaagaaattaatcatataaatacttttccaaaattgcattctgtagaaagatgtaccctactgttcaacatggagatcttaaggggaaaagtgaactaatttagcagctctttctaaaagccttggataaatgatcatcgttgtcatcgtcactttcatcatcatcatcatcttgcattcataagacactttgaaaatttcaaagtattcacacttattagctttagaaatacacttaaataggttttggaaatgagcattagccagaggtaggagtaaaattcgagtagattttaaaggaggaacaaccccttactgtgtaatttggtccttggaaaatatagtttagaaaaaaaatcagtatttgaattttataattcattatgaatattagcacattgtgtcagatgtttaattttaatttaaatattagttttaagagatttgatttattcttggatgccatttttattacatcttaaaaccaatttcttttcatggtaatacatctctgatttgttttttaattggaggctggtgaaaagatagagtttgacctacatgattttatattacaattggatttttaaaaatacattaatttcttttatggtaattttcatgaataggatttcctaaattcttaatagtagataatttctgaaaatgattaacaaatttatttctaacatgtaaatataatagtttgaaagacttggggaagaaaatggaaaacacaggaacaaacaataagattttggtaaaattctagaatgttatattctgcatttgagtttattacagaattacttctataatggtaattaatatgtttacctactgaattttaaaatactttaataatttaaaataaagtactcaagaaagcattctaaaaaatactttcttcagtagctgcgtttttagcgttaaaaatgttcacttgcatgtataaatgtttaaaattagtcttattattttatagttacttcttatctataagattgaatgaatattgacacataaactactttttaaaagaaatactggaggcataatgaggtaaataatgaataattctgttaatttaaaataggccaaaatgttaaaatgactatcttttgatattgggataatgcatgatttttatttttgtctatgtatattactgtattttccaaatatctgcaattattaattatttcacattcaggaaagttactttaaaacagattaaatttcacctttcagttagttctaatcactcttctgagatgggaaactaaaaaacttaatgaaataaaatttaaatttaccatgttacatgcacaggcatttagcatttcttatgaaagacatctgttgttttttgtatgtgcacatattgagagacatccataaactgaatagttgtaattttcagccattctaaaatttatttttaaccacgttactgaggtatgattgacatacaaaaagctgtacatatgtaatgtgtaaacttgatgtgtttggaaattagtatgcacccatgaaaccatcatcacaaccaatgccataaacttatctgtcacctccaaaagttctcccctttttgctttattttttcccttttgtggtaagagtacttaacataagatataccctcttaagaaatttttaagtacacaatacagtattgttaatcatatgccctatgttgtacaatggatctccagaatgtatttatcttataagactagaattttacatagatatggatttctgaaatccatgaagaaataaatgaagaaactaatgtggaaaagagagaaacagaacaggatgactttatttaaagttcattttattgtaaaaataatatatattttttcaaagtatgtattttaaacatcataagcacccttctctcactgaaatatttttaaattataatccagtttctggtaaatgtgaaaagatgataatggaaagatctttattccttactattttcatgctgatgttacactgcctgtgattgctgccaatagtatcaaaaaatttaaaaaacatgatattctttcaaaaatagcatgcatttttaacttacaattggagatgtaaaattcataaaatttataacttactatgggagatgtagaaatcatagaaaataagttaaagatttttttaagtaaaagtgtatctaaataccttagatttgtagagtcatatttttatagccacttgtttactttttatccagcttcatttaaaatgattgtattttggcaacttggaaaagtgaatatatctcttacttttattcttttccctttgatatgaaggaaagaaacaaaaaatcattagcaaaactcatctttcacttacccgaaactatagatttgaattattatgttgtcttgtttttgatgggggttgacaactgagattagaggtttatatcttttttaaataaataaaagcctcacaatttcaagtactatgtctttgatggaatgtatactatgagataagtaatagttacttagccagaaataatggatagagctataatgatgtgacactctattttgtgctcacaagactaggttatctgtttttgtttctttgtttgtttgtttttgagacagagtttcactcttgttgcccaggctggagtgcaatggtgtgatcttggctcaccacaacctccgcctcccgggttcaaccgattctcctgccttagcctcccaagtagctgggattacaggcctgtgccaccatgcccggctaatttttgtatttgtagtagagatggggtttctccatgttgatcaggctggtctgaaactcccaacctcaggtgatctgcccacctcagcctcccaaagtgctgggattacagttgtgagccaccacgcctggcctaggttatctattttcagacttcatgaaatgtctatagattttgttgcatttatttttagtgttaatttcttttattctacatatacgtcatatgctttccattgtctcttgggtttaaaatcacaaatgactactcctataatacaaggaattatttgcagccagccacagtagatagttcttatcagttcccaaagatcaggtgctttaaactctctagaaggaaagactcagaatctcttgtaaaagaaggtacagatattttcaaggtggatttaaaggttttcttaccaagtcaaacttaccttaaaaatgtatatatttgttaatatctttttaaagaagacaagggcacaactactaacaaatgtaactatgctgtaggggaggattatccttgagggaagtgattttggtagacataatttaggatcattcttctgacacaggatttttctcagtcactttgcaagctggggacctctggctggtgatgccacctctccccccagtcttgctcagccgtgctgcctgccgcaggaagcagtccacccactcggcccacctacacaccagctcagtctgtggctgggctgggcatgccccagcccgactgtgttatagcttatacctgcatttggcggttcttgagttcttgtcccgcatccaagaagaatgaggatacactaacaattgaagggtgagaagggcagagaagaattttgttgagcaatgaaacagttctcagtggagagagtatgcaagggtggttgaatacctggaatcgggtggtttctctcccagtgtggctgagcccagggcttttatgggctcagaataggggaatgcattctgattggtttgtgagtatgcaaaaaaggttaaaacaaagacaccactgaaaggtgggcacaacagtgtaaaaaaccaattagggaagggtaggtgtatgtaaaatagttgaatgctgaggatcaaacagagaaaaatgtgccaaatgggaagacagcttctcaatctagtctgtgggtttgacctttagcttggctttcaggctttaaactgtctttggcttggaggtggggtttcaccagggatgcactgtcacttctatcatttgtttattaactttttttgaatacctatttatgtacaaattacttggattgaagctatgggaggtgcaaagatttataaaaatttctccctttaggggttcataatctgtttggaaaggtatacgagctgtgtacatcaagagttaactgctatgagtgtaatacagataataaccctatactgtataggtttaaatgctgcaaatgtgcactggcttttgaatgatgactaggatttggataagacaagtgctggggaaggtgtatcagagaaactggatgaagttggaaaaatataaggtatatttaaggaacactaagctgagctgtttaactagagtagaaaaatcaaacacagtatcagtgcttagctaacagatggtagaattttaaaactgcaaggagattgtgaaattatcccactgaaaagcagtttcatgctgaagtccctgaattcctggagcattgtagaagggccatagatcgtgcctaggaatgagagaacacccaatcatagaggttcttggcctccttctcttttaaccaaagcatttcagttctcctctatccaaattccttctattttctctttctaattaaattgaatctctatataattagttacccatgacataaatgactcttctttttatcctctttattcttctttacctccaactagttatcaaaacttccaaatcattgcctgaacactgtcttttcctctgtaatcccactttggatgccttaggtaacgtcttcatcatttccaaaagcattaaaatagctatttctgcatctgactcaaacccccacccccattctagaattctcaagggttcttggttaactcttgagtaataattttcattaaaaaaatcttttattcatttacaacatctcaatccattacagttcaaaaacttttaaaaagtttgaaaactgcttattttagtcatttgaatagataagaaatctggtacctggagaagttaaggacatgtcattgtttaaagactgagtgtggtttaaccatgaaaatttaggttttccaaattctcattagtacttttccaactacactggatgaaacttttgcttcatctgccatagtcattttttagcatattcaaaaaataggaaattatattttaggatggtgaatctgagggcatgatgaggactgaagaaaggcaaggattaaaggccaacacagttaggaggctattctaatagtgttgatatacgctgaaaattcagcccctgaattaaaatggtgacaaataaaatggaaaataatgaatgagaatgaagaagaaaagagactgtctagttgtaagtattgaggaagagagaaaaattaaaaataatttgtaattaatgtggctgatgatatgggacttgtgatatgcttagcagaaatctgaaattagggaggaagaacatagagaaagtggattaagggataagagtgggttaaattaatgaagtagtaaagataaaataagaattgaggcctggggatagaaaggtgtgaaaaaggctcacatttaaggagtaataggaaggaagagactagcatgaaaacaagggaaaatacaacttggtgagaagtaaatacttaccacactaggtagactgacttggatagcataactgttatgttctgtaacccagtacatttcccaaagctgttcactgtttcagaatgcttccagctcgaactctgcatcccaaggcaactaatttgtttggtgtgaacatagtatcttgagtacctaagatattcaaaagctgtttgtggttgttgaagcaagacttgagactcaaactatgtcaatggctgaatgatttttgtagggcacaatttcattttagaaagtagtcaagtattgtataagggggacaactggattcaaatttaggaaaaaaaattaaatggacttaaatgatccatggcttcttccagaagttttggaaacttagattaataggtagggaaatctctcaacatattagccctttcttcaatgtagctatgttttagcaagcatgtattgaattaccagttaagagcagtgtaaaaattctcataccttagggaggtaagcatatttaaagcctgtaaaaatacatcatgttcaatttgatagcctagtggtttgtacttaattggcactcaataaatatttgatgaaagaatggctggataaatgaaagaatgtacattcttcaggcatactatttctgaatgagatgcccccaattctgcgggaacattgtaccactcttacgtgattctttcagtattacttcttgctttcctttgattattatcttgtcctgtttatcaccttagctcatccctcattctcatcattatcctatttttgccattcctaagatagatatgagaagggaaaataaaggaaaatatcttagaaatgaggtcatattatagtttttattatggacaaaagcccaaatacataaaggaaataggaagtcttcagatatcacaaaatgacttctatcttctttacaatagtacaccttaattcagcgtgtatattagaaactatggggatattttccatatgcaaatcttatcacaaatcttatcatagctgtaatacacaaggctggctttttactttttgctctagcctggaatatccttgtgaaacaacattgggaacttgctataagttaattctgtggaacctgttttatcatgggccacctacctatatagccttatcttttccagaccaggaatataaccactgatcttttctttccattgtcaatttttcctctcacaggcctacgcctttctttttgtgtaggattctaacttcattcactacagagaaatacaagaggtagcaataacactgggaaggctaaagaggattgggaatctcaacaaaattttacatttggaatataaatggaagctacctgtttttgtctccacattcacattcttatttatttaggaagttatggggagagtcaagtgggtggggcattgtaagttcccaagtcattgtaagaatgatttagaatatattcttgcttaatttctatcttgtctggatgagcgttcagacatctttgagttcagaccaagataggattgacctgacaccactgctaggtctggtagaacttgtggtttccttggaaccctcttactttctaaatggtctctgtgggaggtcacaatgaatgggagggcactttcctagctgacctcagaggttctcccagctattcagctgccttttactgcgtagttttcatcagcttttcacttgctgggtctttcagactaattctacctttgagagaaactaggcttttgtgttgctgaatgtttgggtttagtttcctcagtgcctgtgaggttttaatagcaggtgttacttagggaactttcctgctttttaatactagtttccttcagttactcttagccaactcctagattttcctggatcaaaattgtgcatctagttggatgaatttctctttcttatctgagagatgctcatttccagaataaaatgattcatgcctttcctcagggaccaacctgtttgggtctatttcccagatactctttgaatctgttctcaaccgtttttcccccatttaaattctgttaaacagtagtcaaccttaacaatttccaccagtgggaaaagttaggttttcttctaatatttctgcttctgcctctgaaagctctcccatcattcaggggaaaaaacaagctctgcgtctatagtgagtactatcccagtgaaattatgaggctggctttcagtgctttgcctggtttgcttttcattcaaactactaagttaaaatgtttttcccttcttttttcttaatttttgaagtgttaaagtaatagcaagactaaattgaaacaaataaattactctgaagttaaaaaatcctagtaggatttttccccttattttaggaagtttatgaagtgataattgtatatagtaattcaaacatatgtatagttcttacgggtttttagcccctgtctggtgcaaagggcagcagatgcttacctcactcatattgaaagactagaatagtaataaagggagatggatagggaactagagttgatttatttaatttagattgttaaaagaaagaaatttaggactttttaaagttgaactgcgattcctgtgtagcccttttaatttttttgtactgataatggaagttaattagaaatctaaagaaggaataatttatcatgtcattaaatatttctagaaaaaagtttgtgcatattttttcttgagtaaagtataagaagatagacactgtacttattttactatagtggtgctgtcaagaataagagcataagaactctctctgttgagggagtcaatgaattgaatcagttaaaacagatttataagggtaaacagtaattcactttagggttttaatttttgtagtttagatattctaagctagtagggaaaatattttttaattaaactggtccaaaatatttaaaaataagcaaaaagtaaatttttgtgaaatttgacatctttggggagtttcaattaacaaatttctcaactaatattttcattttcaatggaaaatacactcttataacatattacatgttcaatactgtctaaaattatctcatcccttagtgcctctaaaacatatgaaacatttaaattttaaagaaattaagattttgttttgtattatgaattgaaacacttaatttaaggtctttgctgccgctttacctggaagtgacatcgtggtagccttgtggccaaattgaacttactctggatattaaaaatgtaagcaagactgtgcaagctaatgcatcatgtttatatttgacagataattagtttatacagtttaaattaccatacctatcttcttttctttttttctccatgggggattaaaagatttttgtttgtcttggatcagctaaaaatttttacaatgcagaaggataaattggaacttgctccctactagtcatgtccaataattctagaaagtacctcactcccattttcatattaaagttgattttctcatgggttttcctaccattactttaatgtggtcagtacaaagcacaccacattttggctaacttagttgatgatgatgtgataagagtgagtgtaaacatttaagaatttcttttcaggttacatgtcaagtgatgtgccaggaaaaatcttgttgttttttgctatatgaacacagcataggactactgtagaaaaaaaaaaaaaagaaaagaaaagaaaattcatgaagccatcactgtagctatgccagcaggcatgaaaaccttttatctcatgtaaatgagattgctaaagaactttacaatgatccacttccccttaatgcatagtaaatatagaatttttatttatgattttctttataacattttcttttcacttgcctgtatttttctaagtagtctgctcccctgttatacttcttggaatgtcagtagtacagcgtttaatataacatgtattttttccctcagtgcaatgtggtcaattattttcaatgatggtttgcatatattttcttattaggctcaaattttgtttgtgtaaattgtttagaaacactaaactattcagaaggacattcagaaccttatttgtatatgctcattgtatttttcaaaattatagtataatatagagaccatagaactattttttataaaatttaactagtaaaaacacaataagtattcagataattcatcgtaagacgtgaacctaataacgaatagttgtcataattttctagtatcttttaataaatgattttagtacattctttttatggtatatattactgtcactttagaatagttgtcattagtttaagcctcaacagtttttaccttgagcctgatcagtattttcatatgcattgtgactttttaccttttccaaagatggtgacagtacctgccatgcaacatgctcttctgcaatgtgatcatgccagtctattgaatctaggctggtcttaatgacttgcttgtaatagaatggagtggaagtgatggtatgtaacttctgaggctgggtcagaagaagccttgaggcttcttccctggtctcttggaatgctttctggctgtgccttcttgggatgctctgtcttaaaaccatgtcaccattctgtggtaagtccagtcccaaataaacagtttaagccttccagtaatgtgagcctagccttctaatcatctgagcctaggcactagccacctgagtggagaaacccctggcagtttgcgtcttcacaaatgagcagacattatggagtctgcagacagtcattattatctccattcattgtccagagtcctaaactggagaacccatgagcataataaaaggttatttatttctaccactaagtttgggatggtctgttacacagcaataggtaatcataacagaatttaatattggaagtggggtgttgctgtaacaaaacctaaagtgcatgggaccagctggtgggtagaaagactgttcatgaagcttggaagggactcatggagactgatggtgagggattgaaagacagtaatcacagtgttatttgatacggaagtaagaagatctctgttatctagtggtagcaaattttgtaaaaccatcacccagggtaacatggaaaatagaaaatgaaccagtggaccactaatgaaattatggattggcaaaggagattaccaggcagaatatctaaagtgtcagctgtttcttttagccctgtctcatgatatatggatagagaaaactgagctaaaaacggaattcttgttttcaaacaaagggttctcaagcaaaaaagggcctcagagcaaaggtcaaatgcagaccagagttaggaaaatgcggtctcagggcagagatgaaactaaggtgtaactataaaacctttgttaagtcctcaaagatttgaggtggtgcctcatagaacctttcagacacacaaaaggccatccaagtatctttaggtcatgcctcctagttcctctctgttaaacaaaaggtcttctaataatcttaagggctttattccacagcagcctcacagggagcccaaggtagagaaggacttctgcctgagtgagtggatttataaattgatgcatagaagcttataaagttttaaaaataattatatttataaattgatgcgtagaaacctataacatttttaaaagaattatatcagtctggactaagagggaccaagacaacacacattgaaaagaggctcttggatccctgaacttctgtaggcagaaaacaagctgagaaactcagtggcaaacatgggctactttttttatggaaaaggaagcatgactcagatggaggaaacaagaggctagcaagcagggcccagaacacagagaggtactttcactgagtaggactgggctctgatcaaggtactggttacatgtgtccttctggatatcagaattattataaactagtaacattgacatgcttcctatctcctcctaggcaccagccacctttttgaaagggagtatctattgcaattgtcttgtccctgaataactaggtgttttgaatatgtgggaggcagatgatttgtgtctttagttcacaggtcttcagattgagaggaatggtacttcacgtgcagtacccaagaactttatttgcatcttcacctgatttaggtgattagatcctggactttgaactaatgctgtaattaggaagatgctttggtgattatggggacgggggtgagtatattttatattgggatggttgtgaattattgtggtcacagagcaaattctgccggattgacatgttttattaaactttttactttgagataattgtagattcacatgcagttgtaagaaataatacagagagatctcatgtaccttttccctagttcccccaatggtaaaatattgcaaaactccagtataataactgtaccaggatattgacctcgatataatctactgatcttattcacattttcccagttttacttgtacttgtgtgtgtgtatttagttttgtgtgatttttatcatatatgtaggtttataaatccactacctgagtcaagatatagaaccacaaggatcctcctgttgctcttttatattcacagccgccttaccaacttgttcctaacccctacctgattgatttttattacagtgttagctcacattataaatgtagatacacgtagaaaaaatggaatgtatgttatatacaggaatgtgttattaaattgagtcatggaaattaccaacaaagccttccatttagagatgtataatggttgacttttccaaattgagaatttatctgttaataaacaactagtatactggtaaaaactaattaagcttactatttttcgctgctgttcaggatggtttaaagcactgatataagtacttcatgtcaattacactattgggtaatagtgcaacgccttttgctttcgtatgtaagagtataccctaaatgatgaaatttttattctgtattgttcagcatattcagtcaaaggtaaccaaatctgaaaagttataaagaaggcatttctaaaggaaagaattgcctttctgtattacttgaatatttattctactctattattttgttactatagtaagaaaaataggtaaaaatcactttcaaggaatttagtgtttttcctttagatggtttttattttaaaatttttgttatcaaattatttctggcttctccttcctttttttcatttatcttaggtattcagttctttacatttttttcttatgattctgaattatttatcacaacgccagaattattatggaacattagtatgaattttcttttctttctggtttttgtttttttttttttttttttgagacagagtcttgctctgttgcccaggttagagtgcagtggcgtgatctcggcttactgcaacctgcacctcctgggttcaagtgattcttctgcctcagcctcctgggttagctggaactacaggcatgcaccaccacgcccagctaatttttgtatttttagtagagacagggtttcaccgtattggccaggctggtctcgaactcctgacctcatgatctgcccgccttggcctcccaaagtgctgggattacaggcgtgagctaccacacccggccttattttctgactaaaatgtatgtaggatctttagctttgtaaagctttaggtgttgtatgcattatttgtgatccacaggtagaaatatctataaattattattacatattatttatcttatttctagcatttaatctacatcttctgttacatttaacaaggcagttagaccatcttaatcaccgtcttttaaaaatttgctttttctttaattaaaaaaataacatttattggcattgccaggcacaagcctaggtgtcaaagagacagaaataaaacagagtccagactttaagaagactctaataagggagacaacaggtaattacaataaaatgtgccctaacataaaaacacagcatattgtggaaacatttgttgagggtgaatattaaatttagcctgcagaggtgaaggaagtcttccaggaggagcttagaaggagttcagaatttgttgagcttcatgaatgcagaaaaattgaggcctcattcccctctgcatccacactacctgctataacggccagaatatagtgggccctcgatacatatttaatgattattgaaaaagcagagatgtcagagctgaattttgaaggaaggttttggagtcagttgagtgaaagaacgctgttttagacagagggaacagcgtgtgcaaaggcacgtgtccttggtaaaatcctttcctgagcctgagaccctcagactttaccaaggaaaatcaatctcaatcagtttctccctctttctctctaggatcagcggactgtgactactgtctgttgtttccaagcaaattgctgcaaggaattctgtggctcctcccagaagctagataataaaacatatagtatttgtttaaatctctgtgaaaaggctcccttgggctaaaaatattgcttgtttcttttgttaaaaatgtttttatcaaagaataggggaaaaatagaaacttgctcttttcagagctgaagagcctaagaatgatataattggattcaccattgactcttaattaatgatatgtgagtattctgattggttaacatccttagcttacaatttcttgcctgggaaaaaaagaggttgagtattcgtcatccttcccagtggtcccactggcagagactcagtttcacttatcaggtagtccttttgctatacatccccaaatgccaattctgctgtggggttcagggcccttagatgatttaagactgttacttttcccagaattataaaggcagtgatggtaatactaggttattgcttcatactgcactaaagaataaaggcagagtcagattttttgcatttttcacaggagaggaattagtttttttaaattaagaatcaaagtggggtctagcccagagggaagcatatctgggtttggtaaatcataaaccattatagaatgaagactaagtatgccattttaaaggttgtcttgctgcttgacatggctagaacaaaaggtatgagggagaatgctgtgagataagactggatgaacaggcagagcctggatcagagaggatttgaggacccaattaagaagttttgattttccttcagggcaaatgggaacagatagggattttgactgcacagagggagcaacatgatcagatttgtgctttataaaaatccactccagtatcaataagaagggtgggttggaggaagcaaaactagaggtaaggatgtgtatagatcattgttctactttatgtttgcataacgaattatccccaaacagtaatgatataaagtaatcatttattgtgcttatgggttctttggtccagatattcagacagggtgtagtagggaacgcttgtctcttctccatgatatttgattcttctatatttcttatgcatttttgaaaggtgctttccctgagtatagaattctcagttagcctttttgtttattttagtacttcaaaggtatcactccattgtgttctgtatggcaaattttataagaagtttgtggtaattcctatcattgttcctctgtatgtaatatgtctttttgaaaaattttctgactaccaagattttctttttgtcttgggggattttaatatgaaatatcttggtgtgattttgttccttgcttgatattttctgagtaagttggatctgtggtttatcgtcttttattaattttggaaaattctcagctattatgttttaaagtattttttctgtcctcttttaaatttattttattattattattttttaattttattattatactttaagttttagggtacatgtgcacaacgtgcaggtttgttacatatgtatacatgtgccatattggtgtgctgcacccattaactcgtcattttgcattaggtatacctcctaatgctatccctccccctccccccaccccacaacagtccctggtttgtgatgttccccttcctgtgtccatgtgttctcattgttcatttcccacctatgagtgagaacatgcggtgtttggttttttgtccttgcgatagtttgctgagaatgatggtttccagtttcatccatgtccctacaaaggacatgaactcatcattttttatggctgcatagtattccatggtgtatgtgtgccacattttcttaatccagtccatcgttgttggacatttaggttggttccaagtctttgctattgtgaatagtgccgcagtaaacatacgtgtgcatgtgtctttatagcagcatgatttataatcctttgggtatatacccagtaatgggatggctgggtcaaatggtatttctagttctagatccctgaggaatcgtcacactgacttccacaatggttgaactagtttacagtcccaccaacagtgtaaaagtgtccctatttctccacatcctctccagcacctgttgtttcctgactttaatgattgccattctaactggtgtgagatggtatctcattgtggttttgatttgcatttctctgatggccagtgatgatgagcattttttcatgtgtgttttggctgcataaatgtcgtcttttgtgaagggtctgttcatatccttcacccactttttgatggggttgtttgttttttcatgtaaatttgtttgagtttgttgtagattctgcatattagccctttgtcagatgagtaggttgcaaaaattttctcccattcaggttgcctgaattttctcccaacaggttgcctgtacactctgatggtagtttcttttgctgtgcagaagctcttgagtttaattagatcccatttgtcaattttggcttttgttgccattgcttttggtgttttagacatgaagtccttgcccgtgcctgtgtcctgaatggtattgcttaggttttcttctagggtttttatggttttaggtctaacatttaagtctttaatccatcttgaattaatttttgtataaggtgtaaggaagggatccagtttcagctttccacatgtggctagccagttttcccagcaccatttattaaatagggaatcctttccccatttcttgtttttgtcaggtttgtcaaagatcagatggttgtagatgtggggtattatttctgagagctccgttctgttccattggtctatatctctgttttggtaccagtaccatgctgttttggtgactgtagccttgtagtatagtttgaagtcaggtagcgtgatgcctccagctttgttcttttggcttaggattgtcttggcaatgcaggctcttttttgcttccatatgaacttgaaagtagttttttccaattctgtgaagaaagtcattggtagcttgatggggatggcattgaatgtataaattaccttgggcagtatggccattttcatgatattgattcttcctatccatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttactggtgtataagaatgcttgtgatttttgtagattgattttgtatcctgagactttgctgaagttgcttatcagcttgaggagattttgggctgagacgttggggttttctagatatacaatcatgtcgtctgcaaacagggacaatttgacttcctcttttcctaattgaataccctttatttccttctcctgcctatccaacactatgttgaataggagtggtgagagagggcatccctgtcttgtgccagttttcaaagggaatgcttccagtttttgcctattcagtatgatagggttttgcccattcagtatgtgggtttgtcatagatagctcttattattttgaaatacgtcccatcaatacctaatttattgagaatttttagcatgaagtgttgttgaattttgtcaaaggccttttctgcatctattgagataatcatgtggtttttgtctttggttctgtttatatgctggattacatttattgatttgcatatgttgaaccagccttgcatcccagggatgaagcccacttgatcatagtggataagctttttgatgtgctgctggattcagtttgccagtattttattgaggatttttgcatcagtgttcatcaaggatattggtctaaaattctcttttttggttgtgtctctgcgaggctttggtatcaggatgatgctggcctcataaaatgagttagggaggattccctttttttctatcgattggaatagtttcagaaggaatggtaccagctcctctttgtacctctggtagaactcggctgtgaatccatctggtcctggagtttttttggttagtaagctattgattattgcctcaatttcagagcctgttattggtctattcagagattcaacttcttcctggtttagtcttgggagagtgtatgtgtcgaggaatttatccatttcttctagattttctagtttatttgcatagaggtgtttatagtattttctgatggtaggttgtatttctgtgggattggtggtgatatcccctttatcattttttattgcgtctatttgattcttctctcttcttctttattagtcttgctagtggtctataaattttgttgatcttttcaaaaaaccagctcctggattcattaattttttgaagggttttttgtgtctctatttccttcagttctgctctgatcttagttatttcttgccttctgctagcttttgaacgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcattggtttcaaagaacatctttatttctgccttcatttcattatgtacccagtagtcattcaggagcaggttgttcattttccatgtagttgagcggttttgagtgagtttcttaatcctgagttctagtttgattgcactgtggtctgagagacagtttgttatagtttctgttcttttacatttgctgaggagtgctttacttccaactatgtggtcagttttggagtaggcatggtgtggtgctgaaaagaatgtatattctgttgatttggggtggagagttctgtaaatgtctgttaggtccgcttggtgcagaggtgagttcaattcctgggtatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcctatatatttaggatagttagctcttcttgttgaattgatccctttaccattatgtaatggccttctttgtctcttttcatctttgttggtttaaagtctgttttatcagaaactaggattgcaacccctgcctttttttgttttccatttgcttggtagatcttcttctatccctttattttgagccagtgtgtgtctcttcacgtgagatgggtttcctgaatacagcacactgatgggtgttgactctttatccaatttgccagtctgtgtcttttaattgaagcatttagcccatttacatttaaagttaatattgttatgtgtgaatttgatcctgtcattatgatgttagctgattattttgctcgttagttgatgcagtttcttcctagccttgatggtctttacaatttggcaagtttttgcagtggctggtaccagttgttcctttccatgtttagtgcttcctttaggagttcctttagggcaggcctggtggtgacaaaatctctcagtatttgcttgtctgtaaaggattttatttctccttcacttgtgaagcttagtttggctggatatgagattctggattgaaaattcttttctttaagaatgttgagtattggtccccactctcttctggcttgtagagtttctgccgagagatccgctattagtctgatgggcttccctttgtgggtaacccaacctttctctctggctgcccttaacattttttccttcatttcaactttggtgaatctgacagtgatgtgtcttggagttgctcttctcaaggagtatctttgtggcgttctctgtatttcctgaatttgaatgttggcctgccttggtagattggggaagttttcctggataatattctgcagagtgttttccaacttggttccattctccccttcactttcaggtacaccaatcagacgtagatttggtcttttcacatagtcccatatttcttggaggctttgttcggttctttttattcttttttctctaaacttctcttcctgcttcatttcattcattttgtcttccatcactgataccctttcttccagttgatggcatcggctactgaggcttctgcatttgtcatgtagctctcgtgccttggttttcatctccatcaggtcctttaaggacttctctgcattggttattctagttatccattcgtctgattttttttcaaagcttttaacttctttgccattggttcagatttcctcctgtagctcagagtagtttgatcgtctgaagccttcttctctcaactcgtcaaagtcattctccgtccagctttgttctgttgcttgtgaggagctgcgttcctttggaggaggagaggcgctctgatttttagagtttccagtttttctgctctgttttttccccatctttgtggttgtatccacctttggtctttgatgatggtgacgtacagatgggtctttggtgtggatgtcctttctgtttgttagtttttcttctaacagacaggaccatcagctgcaggtctgttggagttttctagaggtccactccagaccctgtttgcctgagtaccagcagcggtggctgcagaacagcgtatattgttgaaccgcaaatgctgctgcctgatggttcctctggaagttttgtctcagaggagtatccggctgtgtaaggtgtcagtccgcccctactagggggtgcctcccacttaggctactcaggggtcagggacccacttgaggaggcagtctgcccattctcagatctcaagctgcatgctgggagaaccactactctcttcaaagctgtcagacagggacatttaagtctgcagaggttactgctgcctttttgtttgtctgtgccctgcccccagaggtggagcctacagaggcaggcaggcctccttgagctgtggtgggctccacccagtttgagcttaccagccgctttgtttacctaatcaaacaactaacttggcaatggcaggcgcccctcccccatcctcgctgctgccttgcagtttgatcttggactgctgtgctagcaatgagcgagactctgtgggcgtaggaccctccgagccaagtgcgggatataatctcctggtgtgctgttttttaagcctgttggaaaagcgcagtattagggtgggagtgacccgattttccaggtgccgtctgtcacccctttctttgactaggaaagggaattccctgaccccttgcgcttcccaggtgaggcgatgcctcgccctgcttcggcttgcgcacagtgcgctgcacccactgtcctgcagctactgtctggcactccccagtgagatgaacccggtacctcagttggaaatgcagaaatcacccattttctgtgtcgctcacactgggagctatagactggagctgttcctattcggccatcttggctcctcctctctgtcctttcttttgttgttgttgtttatattatgttaggctgtttgctattgtcctgtaactcttggatgatctgttctcttttttaattcccactttttttcctctgtgtttcagtttgagtactttttttcaatctatttccagggtcactgatgttttcctcactgtgttgagtttactaatgagtttgtcaaagacagtcttcatctttattactgtattttttatttctatcatttcattttattttctctcacagtttctgtctgtggaagtttcccattttttcatgcttgtggtccaccttttctattagaatctttaatgtattagtcataaatattttaagcttcctatctgatagttccaataactttgttgtatcagtgtttatatgtatttgtttgtctgttgacagtgtgtggtttttgtttcattctttcttgatatgtcttgtactttttggttgaaagattaacatctatatagcagtagaactaaggtaaattttatttatgcctagtgattggcatgcctcctctttttccggttctttaatgtgtgaggagagcagttaaatttagtcaagggctgagctgggcttgggttttgtttgtgctctgatatcagtgtaccacaggtttcagatttctctagcattatcttgtgtttaggatggaggctggtttgctagagggttttactcaatctgtggtctgccttcaactccggcttcttgatttgcttctgaagagggtgtcttagttatcttgcccctctgtctgaagctgaatgcattattttttacttgatgcttaccagcctggtagcataggacacaacattctctgttgcactgattcagcctcagtcttaggcagggattgtttccctgcgtctcaggggtgtcacattcttagtaatactgtcctatcccagagttaggggacgtcctggtttagaatgttttcctacttcttccccagggctggaggttattctactgttttcccacagctgtaatggatcttaacctatattacctttagagctacgaggctttttgctcttcctttagtggtttcaggtttcttgcttctcaggggagaggggacccaacagagctttgtacttttctcaaagtagctatttgtcatctccatgagggaggctctccagtctcttgttgtccaacagtttttcttgtgagcaccttgtgaggtatgtggaaaacagcctgtgaatggacgagcattccccctgcatttctggctctcaggggttttgtattctcatgctagtttcagtttgttaacaattttagtggagttcctaccagtttgtattcaatctagcatctgcttcagataatcaagtgctcatgtcctgcttgtccttgatgagctctttgatagagttaaagaaaatgtgggattttttacataagctgcctttttgttgttgtggtaagcttgagggtgatgctgtttccagccttctacctcttacttggaaagcatttgaacagactcctcaatatataatcatactattaaactgtgttgcatatgttacttacttggttcacatttgatttgaaaggtccacaattcccactttggttttcttccttataattttttttttaaatctatgactagaatctcataattttactttccaacacacccctccccacttcagacatctctaaggtaacttatgagcgagacagtttgaactcattgatggggaaaggaaactccatttttcagaagtagaaaaatataggtcctggtgtggtatgatttgatgtatcccctaaaaagtttgtgttggaaacttaatcttcaatgcaacagtgttgggagatggggaggaggtgtttagatcatgagagctccaccctcatgaatggattaatgctaatcataaagggggctgtgagtttgatctctctctctctctctccctctctcaccctcttgctctctcacccatatgatggtgtctgccatgttatgttgcagcaaggaggccctcaccagatatagcctctcaattttgtactttccagcctccagaaccatgagccaaaatacatatcttttatttataaaatactgtctctggcgttctgttatggcaacacaaagtgaaccaagatatagtgttagctcttcttttattattgattcatctagaataaaccacatatctagctaaaccttttttattcattttaaaaagacattttaagatcttcactcatcttatagagttgctgactcagatgagatattgtatataaacaatttcggaaaaatgtaaaactatacaaattgtgatttttaaaaaaatattttcactgcatactttttgggtgaaaagagcatttatttttaccaagattaagtggagaagcaataatctgacttcctgtttttgatttatttaaagaaatttttattattggttttaaagtctcttggtaagagctttgtcttttgttttatctaatttccagtttgaacctctcatgctgtacttcatagatttcactgtttatcttttgtagtcagaactgtcatatctcaaaatatgtcttttaaccttaaagctcttttaatttattagttgcccatgttagtttgatattttttgaagtcctgactttttgatacgtgaccttcattttgtttttgtttgtttctagtaagtacgttggaaagtttccaggcagcttgtcattaattggtttgttttttgtttgtttgtttttgagatagggtctgactcttttgcccagactgagtgcagtggcacagtcacagctcactgcagcctctacctcctgggctcaaggagttttttccacctcagcctcctgagtagctgagactacaggcatgtgccaacatgctcagctaatttttgtattttttgtaaagaaagggttttatcacgttacccaggctggtctccaactcttgggctcaggagttccacctgcctcagcctcccaaagtgctggaattataggtatggaccactgcacgggcccattaacatttttaaaaaagtctttctccaaaaagcgtatctcatttatttataagtttttgaaaatttggtgactctatagctgtttcatgagaaagttgagtttgatgaacaagtatttactgagcactcacacagtgtgtgcttaacattcatctagctcttttatcaaatatacatagagataaagttaccttccttaagtttccaacctggttgtatagatatattatatatatatgggaaatagaaaaaaaaaagatagtctgaacatcttggctgaattgtcataacctctgccccatactgaggcagtatggactactggcaagaacatatgctttaaaatcataaagacctaggttcaggtaccatctctacaatttagtagtaactttgggtaagttactttctgagtttgtatcctaggtaggaaaataatatctccctactagaaccattgtgatctacatctttatatataagataatgtatataaagtgtctggtgcatgttataggatgtcaataattgtctttcagccaggcatggtggctcatgcctgtaatcccagcactttgggaggcccaggagttcaagaccagcctaggcaacatagtgagacctcatctctacaattttttttaaaattagctaggcatggtggcatacacttgtaatcccagcactttgggaggctgaggtgggagaatcatttgagcccctggatgttgagactgcagtgaactgtgattgtgccactgcactccagcctgggcaacagaatgagatcctgtctcaaaaaataatatttatctttcatcaagctttaacgaccaagatgttttgcactaagatagtggcaagcccagaaaatgattgggctcagtgtctccatctaccatcatcttcacagaaatgttaggtttcacatttctttcctttcttctataccctttcgctatcttacatctcagtttattctgtttcaagcattagtgtgtgtgtgtgtgtgtgtgcgcgcgcgtgtgtgtgcgtgtgtgtgtatgttttgagacagagtctagctctgttgcttaggctggaatgcagtggcacaacctcagctcactgcaacctccacctcctgggctcaggcaattcccctgtctcagcctcccgagtagctgggattacaggcatataccaacacatttggctaatttttgtattttcagtagagttgaggtttcaccatgttggacaggttggtctcgaattcctggtcaagtgagccgcctgccttggcctcccaaagttttgggatttcacgcgtgaaccaccgtgcccaaccccaagcggtagttttttccccacgtgtacacactgataccctatttaacttcttttctaaatttggcttagttgttatggtaaaatctttcttttttgtttgccattttgcacacaaagaacctcaaacaaccctaatcataaatgagaaaatttaatgtacactcatactagtttacttgtacgaaggatgaaatagtcatacatttaatgtaaatgagacaaaatatagtaacagcttgtgtcaagggtctccaagatcaccctgattcagtgatttgctagaaggactcacagaactcagaagatagttatacacactgtgatttattatagtgaaactttattaagcaaaaaaaagaacaaaggggaaaacgagaggaaaagagaaatagcttataagggaaagtctggaggaaaccagatgcaagcttagaagagtcccttcttagtggagtaacacaggatgtacttaattccttcagaaaatacttgtgataatatatgtgaagtgtccactagggaaggtccctagagactgagcgcccaagatttttactggggctgatcatgtaggcaccctctatctagtatataccagaattttagactcctagagggaagcaggtgtttagcataaaccatattgtttataaagacagatcaggtaggcacgatgagccacctttatcattttgtgaatggcaggaacccttcctaaatcaaagttccccaaagccagccaaagaccagccttgcatgcaaggtcttttaaggatagcaatctcatgcctcctatatttactctttttttttttttttttgcatactgcagttagactctgaagatccttacagaaaacatccaaaagttctatttagaatcaatacagaactggaatgtttcctcatgttctgttatgacatatgtaataagctattattttcttttagtttacttccttttactgattggcttaataattaatattatgaaataatttattacctttcacttcaaatagtgtttctactattgtttgtttaaaaggcttttgtgaagaaatgcaaattaaaaccacaatgagatatcacctaacacctattaagatggctgttatcaaaaagacaatagataacaaatgttggcaaggatgtggagtaaagggaaccctcgtactgtacacttttggtgagaatgaaaattagtacagtcattatggaaaacattacaggagttcctttaaaattaaaaatagagctaccatataatccagaaattctaattctaggtatatatccaaaggaaatgaaataagtatgtcaaagagatatttgcattcccatgttcattgcagcattattcacagtaaccaagacatagaatcaacctacgtatccgtcagtagttgagtggataaagaaaatgcaggttatatacataatgaaatactagtcagccttaaaaagaaaggaaattctgtcacttgtgacaatgtggatgaaccgggaggatgttatattaagtgtatgaagccaggcacagaaagacaaataccacatgatctcatatctaaaaaaatgaactcatagaaatggagagtagaatggtggttaccagaggctggtggggagggatactggggagatgctggtcaaaggatctaaattttcagttaaacaggagaagtaagtttaggatatccattgtacagcataatgactatagttaataataatgtatacttgaaaatggctaagaaagtagattttaagtgttcttaacaccaaaataataaatatgtgaggaaatagatatgttaattagcttgattcagccattccatagtgtatacatttatgaaaatatgctgtaaaccatatatatatatatatacacacacacaatttttgtcaattgcagattttttttaatacctttgtaccacaggctggaaatgtgacaaaattttataacatgcttccttatgtaaaatttcaagtttcaaacaactgatttgcaaatgaaattttagaataagacctagatttagcttatatcttatatctaggattatcttaaattcagtatgcagagaaggaagaaatgagaatagattgaattcacttgggaacgctttcaggaggagactggaattaaactgaagataggtagtataaggagaggtagaaaaaaagggcaaaggatatgccagagagacagagtaatgtaactaagggaggattgagtatggggtgggttggtggggagaaataattgtacgttattactctgaagcaaatataaactcacaatcactttttttcaccagtattgttgagactcagatccctgacccatatattttctgcttttgtggattctagaactatttatagtataggaagacctacttttcttatgtaatagtttatatgaaatatgactattatgtatttctcttttattatttctttatcttaaactacttaactcatagagttgttatgaagactaagtgagaaaatatatgttaatttttatatgacagcattatatgctatatggaagtatttaaggccatgatttaaaaaattacaactgtctcatcctagtgaattagattaggcatatacttaacataatttttatcttgtgtagaatttctgcacatagaaatattatgtatcttcctcagtttgctcttatctattcttctgctaccttacttaatattcataggagagagtcctcttgttgctaaacattatagttcttctattttataattgagacttctagcatttatatccgtgctgggcttggttttcctgtttccttcatatcacataggatacttgtttggcctttgtttcctgtgttttcctctagcataccactgaacaacttggagagcaacttttataagaatgaatctgctgtattttgttctcttgcaacatttttgaaggttaaaatagagtttaaaaggttgccagattcaggatagcaaagctttataaattatttctttgtactgataagagttaaaaattatgaatgcctagtgcttagcctaaaggagcctagcatattgtaagtatgcataagcatttgctttaatgtgaaaaattatatatattctgtaattctttcaaatataatgcgtattactaggactattaaaaattcagttaaagtataattatctgataatagaatgaattcttggaaaacatctagacgaagctttaaaaattttaggccaaatatttaaatatttcacagatcactataaaaaaaacctacctacttattaatgaatagctctataactggctaatttattgtcttctctccagatttatgatgtgtgtagaaacatctttaaagcttgttaagtaacacagatcagtgttatactttctaactaattcaactgtatcaaactagtttttgaatacagaaactgttgtaatataatcattgtattttaaaaattcaataatagcactgttatatttaacatctagggtattaacactagttggaaaactacatttgatgaaggtagatttgaaataggctagaaaataattatggatgcacctttctggaatgacattggcatttgacgggtaaacatgaacggaaacttcatctctgtttgaaagcgaagaagttgttcattagaaatagcttctatatatgtcaccaatgatctaaaatattctagttgagcagctagtgggtcaacaatggaaagacatattctgatgggaaatgtgtctcaatggctactttttttttttttttttttgagacggtgtctcgctctgtcgcccaggctggagtgcagtggcgcaatctcgggtcactgcaagctctgcctcccgggttcatgccattctcctgcctcagcctctccagtagctgggactacaggcgcctgccaccatgcccagctaatttttttgcatttttagtagagacggggtttcaccgtgttagccaggatggtctcaatctcctgaccttgtgatctgcccgccttggcctcccaaagtgctgggattacaagcgtgagccactgcgcccagcctcaatggctactcttgaaaatgaagaagaggcatacatgtgggtggaacctattttttatttgatgtaattagttttcagaatagttcctatacttgtttattatttatgtttgatttgatttgattttgagacaggatctcactcaggatcacccacattggagtgcagtagcatgatcatagctcactgcagcctccaactcctgggatcaaaggatcctcctacctcagacttcccatggtggtacataccaccatgcctggctaatttttgtttttatgttatttgttaaagatggggtctcactgtgttgcccaggctggtctcaaattccaggccttaagttatcttcctgccttggcctcccaaagtgctgagattacagatgtgagcctctgtgcctggcctgttatttatattttaggaaatctatatgttaaaagaagacagtaaggccaggtgcggttgctcacacctgtaatccagcactttgggaggctgaggtgggtgggtcacctgaggtcaggagttcgagatcagcctggccaacatgacgaaagcccatctctactaaaaatacaaaaattagctgagcatggtggtgcacgcctgtaatcccagctactcgggaggcagaggcaagaaaattgcttgaactggggaggtggagtttgtagtgagccaagattgcaccactgcactccatcctgcgtgatgcagcaagactccgtctcaaaaagaaaaaataaaagaagacagtaatctctctgattatgtttactatcaagtttcagcaattattgaagatttttcttcagatttttatcattattatatcttctataaatgaaaagtacatattataaagttaattttactgtgtagtagcaaatctaatataaaaattgagtacatatgcattaggttcaatatgaactgttttcaggagaatgaatgctttctttttgtgaatttatgagaataattattgaactagtaatttcttaaatttttaaaatggaaatctgtcatcctttgtatcctgaattcttaaaagcatgaatttcataaaaataaagaaaacatagtcttgttaaatactttatttattttacttttagtatttctttaaagttcgttaaagagaaaaataacagcagctcatagatgtcaaccccaaacaaagatgaatgcttttattttgtaaagatggcttttcttagacaaaacaaccagagctttaatctaatacttagacaaactgagcttctataccaagggaaaagctatttactttaaggctcagtttgttaaaaaggcttttgaaaaactgagtgaaaggaaaaggacttagctgagttacaatttgattactatcaataaggacatttttatattttttaatatagtaagctttaaatctaaatttctgaatgtttttatatttttagttagaattatggttagaatttatagttagaataaagtttgaaccaatcaagacatttctttttgaagcaattatgtgaccttttcatcttttaaatataatttttctgtgcatatccttgcttaaattgagacagtcaagtgggaaattttgaggagacagaacacagagcctccattaggagaacaagactattcttcctagtttttttctgcaaaatataaaatacactttatctcataaactcatatactttaatcattgtactatgcttaattttaggcaataaggagctacaactgatagattctcccagcaaaaacattttcatttgtcttctatgagaaacagttaccattttttctctactgtttttaaaaggttgaaatggaatttttcaacttagagttattcttgttcttactggatctttcctcttggctctgcaggtttctgttaacatgatacagccttcacaaaattgtaaggtataaagtaacagatttttagagctaacagtgacttttcggatcacctagtcaaacacctccattctacatttaacccaaatgccgctcaagccttctatccatcctgtcgcctctttagtattcttcatgtcctcagggattatatgctcatggttattcccagtttagcatttctggccttaagggactcgatcttacttacagcataccttgcccactgttcttcttctctatgttcctggcagagcaggcaataaaagcttgaattgtaattaattgttgcctatcagttaccagaccattagtatgcttatagaaccagagtagtagactgtttatttgacctatgaaacctgcacttttacgtaactttctcttggattctttgatgctgtcattagaaaagcagaatattttgtatttggcctatattttttcctttattgtagatctgagatttttcgtggtctaaagacctccataatgaacataattatattgaagattatctttaatcatcttacgcctgaagaataaggtactgggatcatagtggaactagaagctgagcactttgaaatcagcatttggtgttaacatatggtgtcattgtatgtccttgccttctattagcaaatcattttttttttttttacctacactgaaattttttaggaatattccagttaaaatgttttcccttataagtaccttgacattgaacagatatatacttaatgtaatgtactaggcctgactgtatgaggactgataataaggtatgtctctttcatacagaaatgatctactagggtcaaataataattttaacacaaggcagataaaagcaataaaacctgggaatataaacatcggggttgggtgacttttcccaaccaaaattaagatttatagtttaaacttagaactaacatagaaaaccagtattattttcattcatattggatatcttttggctgagttgtcatttggttgagttgaatttggagttaacatggattctccactgtcaaggatataaccactgtgattctgtttcttctacccacgagtacaggggtactacccctgtttttttctcaaacaggtcaataccatctaattgctatacagttagattgatatctctgaaagttttttgaacagtagttaataatttctatagttctgccttaatagtttgcctcctaaagtccataaattaatagaaatacaggaatttttattctacaggaaagcccctttcaccaaccactcccattcctcacagttcacattttcaaaccagaaaccaggagatggtaatttttgttttatggaacctttctgcaaggcccattgaaatagtttgtttcattaatacattaaatattacctatagaacataaactccttaacaaattaagtacaatcagaaattaagataaagcatctcttaaattttaaatttaaatttactgtaactttttgtgaatacatatgtggtgcaaagaggcctatttgtaaagcctgttaggtatgaatttaatagccatatgttttaattaatttgaaaactgtcattggcagctggtccagacaggaactggcaaaagtactcattcactaggtagtatctaggggctatttgacagcttccatttcctattgtgaaagcttttatctgattacatggtgtgtgcatgtggaagggctgagtgctgtgtttactgtcagctgtttgaaattattcagtagaaaccgtagctttcacaaccagaatatttccattcttatttctgtagtggatgaggacagaagcagctaagattaaaattcaaaacatattgaggtagttcatctttaaataatcctgaatgaggtctgtacattggtgatgtgatctgtcctttttattttgttaatgaactcttcttagaccttagcacttagagcagccactctgctaatttttctcttttgccctcataattcactttctcatctttactgggatgacaccccattacctctcaagctttagcctttcttctccaattgattcattggacatttgtacttggatgtcattctgccatgttttgaaaataactaaaatcactcctccccagccaaatttaaacaaagaaaaactttatgaaaaaaaacaataagaaacttgttttctccatgtgggtttcataattctattcctgatatcattttccttttattcttctatgacttgaaactttgatgtttgactcaaccccctcttcatctgccagcatcttccaaactatcttttgcctcttgctaccttccctgttgccagaataatattccctaaactctgcttttatcaagctctactcaaaaatgcctaatgatttcctagtactttcaggaagaaatccagatttctttacctggcatatttcgtatacaatttaggttctttaattttagtctatgtactccaaaaagaaaaaaaattgttaacagagaaggatagattgttacttagggagtgtggcattttgttagtattttcccatcgtacaaaatagcaagcactatgtctgaatagctactaaagaacagaagtctagaaaaaaaaaatgaagagatctatagaaagttgataattgctttttttctcatttttgctgtcagtctactttttgtgatttacctttactggtgtaaattacttttataaatttataacttacttttataatttacttctgttaatctttctcactcttaatcactatcttttttatcaattttcttcttttttccttttctgcattccctcttactcatttttctttcccttttactgctttttgttcctttgatactttttaaaaatctttggcccttttccctgttcttgttaaattatatacattttttgaaatccagaaacaatttaaattcaattatatgatgactttttataagtaaaaatttttcctaattaacgtaataggtcagtctggtttttgtaatgccattctatcctttccaagcactgacgttctctgggattttggaatggcaagaaggaacaaggagaagagggtactttatagaagtgctgtcagtgtgggacttcagtggctctgtaatttaagtatactctgattcttatttggaaatagtcactaacatgatattgttgacttgatagttaatccacatgtgtaattgctgattaaaggaaaatatgaatctatgtgaataattatggaattataatgtgctcctatgattttttttaaagtttgtgagtgtgcttttgctctatctacctcggtttaaatcccagctgaaccatttataagctcctgatcttgggcaagtcacttaattcctctaaagcttttttattctataaaatgtggctagtaataatgtgtatccaatagaggttttagtagaattaaatatgatgattcatgtaatgtgtttagtacaatctggtatatcataagcacttaataatgttagccgctatgtctactattgctattaataacgaatgcttccactattttcaataagttcttgtatcacattgtgaaggttaatcttgacatagggcaaaagatgtagaaaaaaagatgtaataatttatgtaatatagggttactatacttttttttttgcttaccaagttatgtggaaattataatttttatatgggaaaatagaaatgagttttattgattttcaggacaaatgaccttgctttcgttctaattttgtgcttctgctttccttattctatttgcagtttactatatatcctacattcattcttagttggcattttactttgctgtggaacaccatttccttgtaatcatccagaaaacagttgcttcctaatgtattcctttcggctctggcttcatattaaataaaaggaaacataggggacctttagcattttgaaaagacccagaaaatgttcttccaactccttccatttccctcaccaagagcttacaagtttacactgtttcatatatctccaggacaagccagtctttcagaagggaagatttacatttattacttactttgactgacagaggctttggaaaattgattatatagagctgatttttataacaaaaatactgccagcagtacaataaaaaggcaaaataaaaatactaccgttaaactctcatcatatatgttattatattgtaaaaagacataaatctgcacattgattacacacggctcatataacctatacatgtaaacatataaaaatacatgtagcataattttatatgatgtatcataaatgtgacctaaactaacatgccatctataatatgcacgaaacatttaattaataagtttgcttgccttcctggaacttaattaaaggaggtttggcttgtttatttgtttttgtaatgatgtagattctcttattctcttaaaacccagccaaggaaaactaaaactatatacttttttcaaatagttttttgaatgcaattattttattgattagactgctgtacttttaaaaaacaccctgaacttcttctgccctttagtttgcacttgatgaactctctgaaaggcacagtattcctttaatttatctagagttaaggatataattataccatgaagttttactattgaaaatcagatttttgaaaattaaagtaagctttaggcagtatttggtaaagtttcttatttctgtttctgaggaaggagatttagaaatgtgaaggtcagacatctagtttgtggtagaacccacctacatcccagtcaagagcttttagttggttaagtaagtacacagactctgaagcctaggtttcaattctagcctttttattatctaggcgatcttgttaatgaacctctctgtgctttggtttctccactgataaaataaggataataatgatacttacaccatttactagttgagagaatttaatgagtttatataagacacttagaatagtgcctaacatatagtgttatatgtaagttatgatatactctacatgttgctattttagcagaataatctcaaatatttcacttgcatataaaattagtccagaaaacataatgtatttgaatttttaagttttggggagtagtagcaaaaactgacaattattccttaacaagaaatgacaaaaaaaaaaaaagaagcctgatagaggaagaaggagatgtagactgtgcagcttggcactggggagtctgaatgctactatgaactaaactatgcacaaactagctaagtaatctgaaactaggcatatgataatatcgctggaccccagttatctcttcttttacatatggggaattgaactaaagcatctctgtcatctaaaatctgatagtaaggtatgtggtaagtgcattgaattgacaataatgcaaagaaatggaatttttgtgtaaattctccttttatctgctttctctcccatcacatctgtagaacactatcccagcatctaacagttgtattttgcctcaaagtctcctttgtctggtatttcaccaactttcttttggttaatgtctgcacaatatatatcttgttttttgtccttttactttcaaattttctacagcctcatatttaaggctttatctagtctgataatcttttatttttaacaaagtgttcatttttacttaatgtaattactgatatatttgggtttaaatctatggttttactattttctatgtattcttctcattttctgtttcctgttccttccttgtattgtcttatgttagtttgaattttttcttcctaccatccttttcctacctcccaccattagcttgtttttattgttctttttatgcttatcccagagattatatcactatccttgatttattaacatatgatataaaataatactattaccatttcctgtgctatgaaagaaccttctactttaatgcatttaacctcccacaacttaaatgttattgttctgtattttaattttatatgcattttaaactccacgagccatcattatcactatttttacagaaaacgtttcttcctgcacctctgagcttttttttgtttttttgagacgaagtctcgctctgtcacccaggctggagtgcagtagcgtgatctcagctcactgcaacctccacctcccgagttcaagtgattctcctgcctcagcctcccgagtagctgggactacaggcatgcaccaccacgcccagctaatttttgtatttttagtagagacggggtttcaccatgttggccaggatggtcttgatctctcgacctcgtgatccacctgccttggcctcccaaagtgctgggattacaagcatgagctactgcacccggtctgagctttcttctccaagtattctctttccttctgaagagtacacttcagttagcagatgataatttatgtggatctgctgattataaaatctcattttttgtttgttgggaaaaaatatttttattctgctttttgagggagggggatgtttttgctggatttaaaactctaggttgacatttttttttcagtgtcttgaagatatcattcctgtgtgttccggcttttgctgtttctatttaggttccagctgtcagtcttgtacatgcagttttgtttgttttatttttggctggttttaagattgtggggtttttttccctttggttttcgccgcgttttacctttctgtgactaggtattgttttatttgtaattatcttgggttttgtagtgcttcttaacttcagggtttttaatcagttttggaaaatttaatcagtttggaaagttttcagccattatgtcttcaaatattatacttctgcctctatttttttcaactccttttattctgggattccaaagacttgtatcctagatatttttaccatgtcctatctatcatttatgctcttttctgtattttccatcttttgtttcctccatattttaatttttatattctcttctgacttcttagcccattattttttttcagttgggctaataccctgttaaatccatccactgagtcttaattttggtgattgtgttttttagtcctaaaatttcaatttaaatgttattctgcctttttgctgatgttctcagtgttgttgcttaatttattggtcatattaagcataatgtgtttttcgttttgttttgttttgttttttttagagatggagtctcactctgtcacccaggctggagtgcagtggcgcgatctcggctcactgcaagctccgtctcctggattcatgccgttctcctgcctcagcctcccgagtagctgggactacaggcacccaccaccacgcctggctaattttttctgtttttcagtagagacagggtttcaccatgttagccaggatggtctcaatctcctgaccttgtgattcgcctgcctcggcctcccaaagtgctgggattacaggcatgagccactgcgcctggtcaagcataatggtttttaagctcagctcttatatctccattatgtaaatccacagggggtctggtttctatgtcttttgtttctctttgtttccagatgtatagtattattattttcttatatccctggatttttttattgtgtcccaaatgctgtatatgcatgataatagagataatttgacaatcttaataatattccaaaaaggatttgtatttgccctggcaggcagcaagtctaagggcactagcaatttcagatcattgtaaaccaaccaagggagtgagatgatttaaaatgatctttatttcctatgagtgatatctatgcctcttttcatactaagtccaagactataaccctttgaggtcccaaaccataccaggttttatgttctccttggtgggctctgaatgctaatttttgctctgaattataagcttattaaaaacctctgcttcccttctcagcatctcagccatgctttcgacattggcaaaagccagtaacagacttcccttctgggattatctgtgtttacaaacagagcatcttttcatttcattatcaagtttatatggaacctttaagccattccatgtatatgtacctcacatttacattagcacagagtttctgaaactgtctcagtttacagagcccttattgtctttgttattttttcatggggcacctcagcaaaactgtctaaaccaacaaaaccccaacagatctttttattaagtatgtaggtccaaacaatttaagtatccatgatataaacatttaatgtcatttgaaaaaaatacatataaattgaaagacaaaagatatttcaatatctttttaaagtaaccatattacttaattataggatatgagcactgttggacagtacacatttgctcagatcttggaatcagaccagataccatgaccctcatctcctgtttcacattgattagatgcaaacttgagctgtagttcacatgatgttcaacatatgttgaatcttctgtgtttccctcaaaaatttaaaatatcctatggcatacagttttggagttgtggcatgaacacatttatcatcagaaaggatgttttaaagatgctagagatgaggtaagttaaaagaggaagagtactgaagtcaaatttcctgtttatggtcatactcttggacaaattactttacctctgttaaatgaaggtttttctatatacctcttttataacctctaaagttctttttcagttccaaaacacattaactctatggctcatctaaagcctttgctatattcttaataccaatgagccattcctttgctgctagaatttatttgcagatttgtaaatctaatgtaaataagttaccttcttgatgactatttaaatcttccctctggatttatccatggagtcagaatgttttttggcatgcctttccatgatgtagttcttaattggaagcacatcttataagagaattgtattctccaataggataattcctgtggtttaaaagttgtcacagaggaatactgtcattagaaaccaaaacagatttatttctcaattcttgtctcagaggctctaatattttactataaactcaaaacattcttacaattactcagatttattttcagattaattggattttcagtatttttcaggaaacccattaacttatattctttagaaagtacatatgtagtaggccatcaaaatgctgtgaaagtaaaatgcccttttcattaagaatctggtgtggtactatagttagagacttgtagttgattttttccaaattgatctgctatttcttggagctctttaatttaaaaacatttaataacttttttattaggcagctaatcagtttcactgaggtagaagagttggaaggcatggaaaagtataaaactttattttgaattagttggatttccatggttatttaaaaactaggcccacttattttctaaggcacttttcatttgtaatatcactgaaattgaaattccttttggtttgttagaactctgataggaaaaggcagccagaagaataggaaaatttaccttcaggactttctgccagataatattgttgaatattttagtttatttactcttagaatctttattctgggaattaaaaaggtaagcgaatctttcatgtacctcatcaattttatgtatctgaatgttataatctactttagccagttacataaataaaatcaattctatatttaagctaaaaaataaaacatacaaatctggagacctgcctaaacagtggcactttagggaaaatataacggggagttttaggtcattataagttgaacatattgtactacacagtactgtaagaaggaatagttccatggtaatatgtttctgtttgttttgatttcctcttgaacattaccttttaaggagaatgttgactagcttagatgctattagaaggctgcaaaatgcatttttgcccactgcactctcacctcccaatgtcttgctaaagccttcaaaaaataaagaaaagaaagagaaaatgaaaagaaaaaactaaaagagaaaatcagcaaagcacatattcaaaacctacaagctattgtgtcagagtttgatttatggatttatggcagaatctaagtaaatgttgtaatttgaataattggacaactattagggagacaaaaatagtgtcatctaaaagctaagtagaaactgtatgtttgctccacaaaagaaaccaagataattcctctaacctgtcatatataggaattctgaagtatctactgtctagaaatatgtcatgtgataatgaacttatttgccatggagaagaggacaaaaaacagatgtgatagttgtcttcaaaaatcttttagagctataatgtggaagagcagtaggagtaaaagacagaagtttcaggcaggaataattggacttgctacaaagaactgcctatattagaaggactcaaatacagattggaaggttgtattatggacttcactaggggcatgtggaggggtaatgacctaagattaattctgatcttgagaccgagatttccctctggtaattctacactgagctgctttaacaatgggaaatgtaatattttccagaaaaaattttaattattttacgctttctgtgggtgaccctgcaggaatatgatttaactggtgaagtgggttcaagtccaggcgcctctgcttcctcaggcagacgcccctgttggaggaatgatgtgcttaccttgaacagccatacacagcatctctgattggtcgtcactgtacttagagcatttctctcctgactgatttcaggtgtaatgtgatcttgttatatatttatgattgttcattacacatagttctttcctctgaattaagtggagtttctttttagcaaaagttctataatttgtgtgatttcagatacctcaaagattaaattttcaagaattctggtgctattcatgttactaatgaaccagaaagtattaattgagccactgtgtttcattataatatttctaaaatcaattattatattaacattagaggtagctgcagggacttcttccttccacatatgtgtgggggactatgtgtgtaggtatattatttgttaactgttagcaaatgttttatagtgttttacagttcttgagtaaaactgtaaagttacccagctctgaaaagaaatttatcttgtcttattcctctgttagacaagtagtatatcacttaattataagggtttactgttaatttattatccattcatgggatgtcttttttttaaatcagagttctaaatatttttaagttttatcttaaagtaagataaaactagccagtcaagggtgatacagttgaaattaattctgaagactcagactgtaggtttttcaaaaccactttacactaccatgattattaccgtaacaagctttaatttagtgtcgctttgaattcaggccatgatatcaaactatgctaaaagaaattctctagtgactaggactattcaccaacagctgttattccagctacctgtgagaagattttttttaaaacctgccagcaaaaagcagtctgatatgccttttaaattattactgtattagttgctgcttatataggtaaagattgagttagttgtttgtggatttttaaaaaggatattgctgatttatttcaatggaatgacatagatttggcatgatgataccagcagtggaagctcagcataggagagcatgaggtgtttagggaaaatcactagtctgattctgtattttattttgctttgtaatgtcatggaggcatggagtatttatgcatatatacaggctgataggaatacatacatatactatgtgtattattttttaaagcttgcctaaaagtagttaattccccactccccagtctacttttgttaaactgtttcattaacccaaggataacctagcttaaagcttatgttggaataagactcatggtgtaaagggtcagcacaagggaattttgaggtgatagaactgttttatgtcttgattgtggtggtggttacactatgcttttgtcagaactcatagaaatatatacaacaaaagtgaattttactgtatgtaatttaaaaataaaatgaaaatttaaaaatataaccatccagaaaattcattagatacgattaaagatacttcctgccccttctgaccttccattcttttgctctaagacccaaattagtaatgtccaagtggaaccttcacccagtcctctctgctctagggggcttcagaagactttgatatttcatcaagacgttgaaaggtctccactcaaggaatccaaccaacttccctccctctctcccttccttccattgttctctaccattcagaacatttttctacatacctttgtttatggtattttgacacatatgttatatttctaacagactttcctacaagctagatctcatgatcatttacacaagacaaatactgaacttcaaattttggcttgttacttatagagaaaacttctgtcatatatgtacaaagggaacattttaaatatttgtattaaaaatatacatatgtgaatggctcactttgtaaaaactttatgttctttttataatggtagtgatatttgtacaatgacagctacgttatttcatgtattcttccttctgaataacagcatatgttttggagtaaactatgggacagagtaaagttgtcttactctcataaggattcagtttataatccaaactatattagtccgttttcatgctgctgcaaacgacatacccaagactgggcaatttacaaaagaaagaggttaaattggacttacaattacatgtggcaggggaagcctcacaatcatggcagaaggtaaggaggaggcaagtctcatcttacatggatggcagcaggcaaagagagaatgaggaaaatgcaaaaccggaaacacctgataaaaccatcagatctcttgaggcttattcactaccacaagaacagttttggggaaagctgcccctatgattcaattatctcccaccaggtcccttccacaatacgtgggaattatgggagtacaattcaagatgagatttgggtagggacacagccaaaccatatcattctacctcagcccctccaaaatctcatatcttcacatttcaaaacgaattatgccttcccaacagtcccccaaagtcttaactcatttcaacattaactcaaaagtccacagtccaaagtctcatctgagacaaggcaagttccttcctccatcaagttccttcctcctatgagcctgtaaaatcaaaagcaagctagttatttcctagatacagggggtacagacattgggcaaatacaaccattccaaatgtgagaaattggccaaaacaaaggggctacaggctccatgcaagtccaaaattcagcaggacagtcaaatcttgaagctccaaaatgatctcctttgactctgtgtctcacatccaggtcatactgatgcaagaggtgggttcccatgatcttgggcagctctgcccctgtggttttgcagggtacagtctgcctcccacctggggttgagtatctgcagctttccaggtgcacagtgcaagctgtgggtggatctaccatgctggggtctggaggatggtggccttcttctcataggtccagtaggcagtaacccagtagagactgtctgggggaatctgaccccacatttcccttctgctgtgccctagcagaggttctccatgagagccctgcccctacagcaaacttctgcctgggcatccaagcgtttctatacatcttctgaaatctaggcagaggttcccaaacctcaattcttgacttctgtgcacccgcaggctcaacaccatggaagctgccaaggcttggggcttgcatcatctgaaaccatggcctgagctctacattagtccctttcagccatggctggaacagctgggacatagagaaacaagtccctaggctgcacacagctcagggaccctggaccttgcccatggaactactttttcctccttggcctctgggcctgtgatggaaggggctgccatgaagacctttgacatgtcctggagacattttccccattgtcttggggattaacatttggctccttgttacttatgcaaatttctgcagtcagcttgaatttctcctcagaaaatgggattttcttttctattgcattgtcaggctgcaaattttccaaacttttatgcttttaaaactgaatgcttttaacagcacccaagtcacctcttgaatgctttgctgcttaggaatttcttctgtcagatacactaaatcatctctctcaagttcaaagttccaaaaatctctagggcaagggcaaatgctgccagtctctttgctaaaacataaaaagagtcacctttgctccagttcccaacaagttcctcatctccctctgaggccacctcagcctgaaacttaattgttgatatctctataagcatttttgtcaaacctattcagcaagtctctatgaagttctaaattttcccacattttcctgtgttcttctgagccttccaaactgttcccaaccaaagttgcttccacattttagatatcttttcagcagctccccactctactggtaccagttactgtattagttttcatgctgctgataaagacgtacccaagactgggcaatttacaagagaaagagggttaattggacttacacgtagctggggaagcctcacaatcatggcagaaggcaaggaggagcaagtcccatcttacatggacggcagcaggcaaagagagaataaggaagacgcaaaagcagaaatccctgataaaactgtcaggtcttgtgagacttattcactaccacaagaacagtatgaggaaaactgcccccatgattcagttatctcctaccaggtgcctcccacagcatatgggaattatgggagtacaattcaacatgagatttgggtggggacacagccaaaccatatcacgaaccttatatgcatactgtattaaccttatagaagcagtgttgtttagactgctattcatcagaatctaaattgattaatgcattgaataaagatatattacttctacttgtctttaacaaataaataatccaaaagttttatgctcaaattattatcagttgttgtacacctgtattaattgatcaaggaattttccttatcatggtcttccctgagtctgatattttgtcctttgagttctttctactaagtgattgatgaaatgaaagcattattctgaattgaatatttttttaagaatgaaagttgagttttaaattgaggtctccatgttagccagattaaggaggaaatatggtgactagaaacatttcctctttgaacatgtgagaagctataaatttaaggctcagtagaccaaacttgtttaatcattttactaatatttccaatgaaatgtgtatttctttcacttaccgttttcttttaaagtatctactctgaaataagcattattttaggtctgagaactccaaaaataaaagatacggttggttctttcttgatgagtttatgatctatgacaagacaaattcaaacagtatagtatgacttgataattctataatggaagtatgtataccgtgtcatgggaacatagacaaacttgtggttaaggatagatttatattactatagtatagggaaacacttctaaaatactagaaaactacacctgtcgtatatgtatgttttggcacgtcataaaatctttgtgggaacttttaaaacttaccttttgatcttaaaaattttaggccaatagttttatatttaagtatgtgaggaagtaaatttattacagctttacaaattttttttatgttctatatgtttaaaattatgtttttaaaacccattttaaaacagttgctgtcacaagataactcataggcatttgcttttggttaagtgactttgtctagattttttaaagagaggttaatttcagatattgtgctccattattggactgtttgagaaaagcagtcccattttttgatttagaaatatatttctagaagaagcagaagaatttaataagttgcttttattataacgaattattaagcatcactattgaaaagggatgttgagaggaagaaataaacagaagactatgcgtaatgctttatcctcttgcaaagaatacttcaatggcatgggggtgggaatcataggaattggttctttgcaaggccatggtattgcttttgaaatgttaagtggacaggggacacaaaagtggaaagatacaaagttgtgcttctttggcagcagctggcaagcggttttttaacttatttgcttgaagtgaaaagatctggtaaggtgatgtttggtgttagaaggatcaggaaactaggagagagcttttgaataccaaagtttgtaaatatctgacccgttctttagcgcagctttctcttgatttctgatacttcataatttaattttgcatggggctttgcctaagatgctgactacaagactaaccctgcatgaatttttagctaaaacatcagtcactgtctgtatgagaatgggtaacttggttcacagtcctgagataatctgataggtaggctgctttggataagatacttcttctggactaatcagctatatttaatcctggggatgacaattctgggagaaagttcttctgaaagtagttaagggtagaatagacaatgaaaatgtgtaatataccattttaagaaaaaggaattttattacaagtactcagaactgaaactggaaaactgtgaggtactgaggcagctctaggttttggcttcttttacagcacctcatcacccagccatttcaggcaggcactctcaaggcaaacatgttcttcctccttccttccctccctttctccattctcttgtgcaagggttccagtttctccctatcctcatcaacacttttgcctttttaataaaaaccatcctaacaagtgtgaggtgatagctcattgtggcattgatttgtattttcctgattagtgatgttagtatcttttttcacacatctgttggccatttgtatatcttctttggagaaatgtctattcagtttcttagcccacgttttaattgggtcattcattttgtgtttttcttttgctattgtgtggtaggggttccttatatattttggggatgaacccattattagatattagatatatggtttgcaaatattttcttccattccatgggttgcctttacacccactgattgttacctttgctatccattttagtttgatatagtctcacttatttttgcttttgttgcctgtgttttttgtgtcatgtccatgaaatcattgctaaccaatgtcacgaagcttttcctcatgtttctctagtagttttatggtttcaggtcttatgtttaagtcgttaatccatttttgaattgatttttgtgtatggtataagataagggtctaatttcattctttttctgtttcctcagcactatttatagaagactcttctttccctattgtatattcttggcacctttgatgagtatcagttgactgaatatgcttatttctgggctttctattctgttccattagtctacatgtctgtctttacactagtactacactgtttcagtgtcctttaaagagcagaagtttttacttttgatgaagtttcatttatcaatgtctttcttttggtggtgtatctaaggagttcttgtctaaaccaagtcacagatattttttcctatgtattctctagaacctttagaatttttttttacattttgttctatggtctgctttgagatttatgtatgctccagagtttggattcgggatttttgtattttgttttgtattttggcagatggatatccaattccagcactgtttattgaaaagactctcatttctcctttggattgtatttgcatctttgttgaaaatcgccatatatgtgtggattctctattctgtaccattgatctattctttttccactatcatgttgtattgattgctgtgctttatagtaaatcttgaaatcaggtagtgtgaaaccttcaactttgctgttctttttcaaaattagtttggctattctacttcttttctatttccagtgtttgatttctacaaaacaaccctgttgggatattgattggaattgtgttgagtctatagatagtttgaaaagaattgaaatagtaatacggagtcttccccttcatgaaagctatatatctctccatttatttaaatcttcattaatttctttaattagtgatttataattttcagcacacagctcatgcacatattttgttagctctacaccaaaatattttaatgatatttttgtggtatagttaaatatggtacctttaaaatttgaatatctgattattcgttgcccatatatggaaatactggttttctaccttgttaaattaacttttaaattgtgtctgctttttaataaactttctttggagtttatatgtagataatgatgtcctttaggatttcaaaaaagagtacactttattttgttctactcatgtgttccttaggacatggattggtttgctcttatatacatgttgtatgattagatggttctttatatcatatttacattgtatcgattgttcttatggtttgtttgttttgatttctgtttggttgtttttagtgtcaataatttggcatcaggaccaacctaattatctcttataaagtgcagtactcttgcatagttatgatatatgtttcatgaaagatagcatatgggaaatttttatattcctctcccttaatgggatttgaaagaatgtatatcttacttatggtaggcaatgaaaataagtagtaacagtggcaaatatctttttctagaattatatttctttttacactgcttagtcattattgttatatgaatataaaaaggtcttggccgggggcggtggctcaagcctgtaatcccagcactttgggaggccgaagccagtggatcacttgaggtcaggagttcaagaccagcctggccaacatggcaaaaccccatctctactaaaaaaaaaaaaaattagccaagtgtggtggcttgtgcctatagccccagctacttgggaggctgagacaggagaatcgcttgaactcgggagatggaggttgcagtgagccaagattgtgccattgcgctctagcctgagtgacaagagtgaaactccatctcaaaaaaaagtaaaataaaaagggtcttaacatttaaatcatgtttaaggctgccttcatgttttatgtgatttttttaaagttgtgacattgctttagtgagttttcaagaccttaaaaatgaatctttaatttcagcagattatgatggatgagaggcatttacagtatacaattgctatcttgatgcaattctactctgtggggctttatcgatttctttccttcttcattgccacaactcaagatttcttctaagtaatatagggtcactgaaaacaaaggtgattctagctctttttttttttcttttggtcttaatccccaaattgtctttttcaaaatacttgtctacatttagtacttagtagaagagaattaactgatagttttgcttacctatttatttatttttaacaaaaaatatatgttcgtggtacatataacctgaggctactggtttggattagaagtcattaaatagaattattttttaagattaataaatgcaaaagcgcagactgtattttttcagacactgcattgccatctcttccatgaataagacacaatttttaaagatacttaatagccacattttagagataagctcattgttgtttgccaagttttaaaacaccattagcaaaaattttgttttctttttctattctcagtctctttggctattattttccttgttcagtatcataggatgttcccataataaaacaaaaaagaaacattcttggggaaggatttatcaggggattacattattttttgtgatagtttactctagtttttttagacattcattcaagtaaatgagaaaactaatttctgaaaacgttaattgtagagaaagatttctggtactaggagaaactcctatgatcataggatagtgttaaagtcagcagcagtaggacatgagcacttttttcttgagttctgtagcaattttagtggtatttaacagtcctatgcttaaacatgactataattaataattctgtattgtattcttgaaatttgttaagacagtaggtcttaaatttctcaccacaatgtgtatgtatatcaaaacatcatatgttattaaatctataccttaaatatatacaatttaataccttaaatatatacaatgtttattgtcaattatacttaaagctgtaaaaaatattgttatgaatcagaatacttaaggaaaactacttagacatgaaacatagtttcaaaattaatctgtttcaaatgcacctttacaaaatctaagaatattcttaggcgttccagagctgcttctctctggatggagtctgaagagaataaggtgtaggaaagcgtagaggtgggaaaataagcactgaggtggctttctatccgtgtctgtctaaaataatacttctgctatgtaccttgctaaaacacccactttccctacaaactgattctgagcttcttccaaggattatttttccttgttttggcatgaaaagcttaagctcttactaccttttctttttttttcctgcaaccctttggcagtacagagtttatagccacaggactgttcctatctaaatagagagcaatgcagtgaaattttaaaaaggcttctgattgttaatttgaaggacttgatattttaagaccagtgaaagttacctatactcttgaaatttgaacacaatcttttttgtaaaattggaaatgacatgagaatctagcagcatgactctttttttcctaaccaagtaagaagtgttatacaattaatcgtggcacatagtaaacagcgcaattgatattctgttgtattctgttatttaatatagtttaagttaaagtttatttttctggggaagcaatcatatttttcagtttttgattgtgagaattatattgtgtatgttgaaatcacaaaataattgaatgaaattatgtatttactcagtatagttttgcttaataagtaaattaaaagcttatttaataattttagattacttatggacaaataaaactagacttctgatgccttatgtaatactctatcagaatagattatattatgctaaatcactgtttttttagtttttttgacgtttaagattttgacagttgctttatgtaatgacatttttatggaataaaaatggcttaaatatgtacaagaccaaattattactgtagtcatatgtattaaaatgaaggatatgttttagaaatgtggttaaatgatacttttataagaaggcaaattaattataaagttcaataactcacataatttaaggtagaaacctgctactggtttgcagttcatttctattatttgtttcttataatattataaataattttttttccttttttgtgatggaatctcactctgttgccaggctggagcgccatggtgcaacctcagcctcctgggttcaagttattctcctgcctcagcctcccaaatagctgggactacaggcatgtgccaccatgcccagctaatttttttttttttttttttttgatgaaatctcgctctgtcaaccaggctggagtgcaatggcgcagtctcggctcactgcaacctccgcttcccgggttccagcaattctcctgacacagcctcctgaatagctgggattacaggcacggcccaccacgcccggctgattttttgtatttttagtagagatggggtttcaccatgttggtcaggctggtctcgaactcctgacctcatgatccacctgccttggcctctcaaagtgctgggattacaggcgtgagcaccgcacccagctaatttttgtatttttagtagagatgggatttcgccatgttggccagactggcctcgatctcttgacctcgtgatccacctaccttggcctcccaaagtggtaggattacaggcgtgagccactgcgcccggcctataaataatttttaaaaacatctttctaatcatgctgaggaagatacttcttagatgttcctctgataagtctaggcattatgacactgtttaagagatcagatgttctattctgacaagccatagtaaatatagacagtactactcttttgtatgataaatatttttgctttgacaattaatttgtcctggaaccttatgtcaaagagataggaaagaaagtaaaagacatcttagaagagatagaaagcaaaatacaagtttaaccaagcttttatattcaaacatgcaggttgttctgatttcctgaagaataaaagaataccactatgtttagacaagtcatgttagttaggaaaaggatagttcatcttgaggcattgatgacacaactttagtttagacatgcaaaattttacattttgccaacattcatctattaatgttcatatttattcatgttcatatttattcaagtagcacctactgtgccaggactgcaccaggtgttaggaatataaaatatctctctctgttctctgtcgtgtgaggatacaataggaagatagccatctgcaaaccaggaagtgtgtcctcaccagacaccagatctgccagcaccttgatcttggacttcatagcctccagaactgacagaaataaatgtttattgtttaagccacccagtttttgttaatttgtgatagccacccagactaagacatgtagcaacagtatggagaaagaggtatattttgagaaaacaaccaggtaagtgatttcaatgaagtatgagaggtgcttttatttagggaaagcacagggtactgtaacagtatatggcagaaggaatgcaaaacctcgtaattcacagggtattggatagtatacttagaagggccttgctacatggaatacttactccatgctgcttgagtgccatctaagaaatcttaaaagcaagaatcaaaaggttcaaacaatttttaagtaatttggctgtgtcccagaacaaagctcaagaatatatatagaaatgtaaatccagcacccaacaaagtaaaattcataatgtctggatttcaatcagacattaccagacattgcacagaagcaggaaaatatgatccataatgaggagaaaaacgaatcaaaaccaatctataactggcatagattttagaactagaaaatactttaaaacacttgttataatgttccatatattcaaaaacttagaggataatgaaacatgttaggtagaaatatggaatatcaagaaagaaccaaatccaacatttagagatggaaaaatgcactggatgggattaatggtatattagacattgcagaagcaaagattagtaaacttgaagacatagcaatagaaactgtccaaaatgaattacagagtgaaggggaaaaagccttaaaactaggaggagaagagtagagcagtagtgagctctggggtatcctcaaaaagcctaatatacttagaattagaatcacccaaaggagaggagagagataaggaggacagaaaaaacgcttacataaatcactgccaaaagtcttccaaatttaaggcaaactataaacttagagatccaagatagtcaaagaactcaagcacaaaaacatgaagaaaaatacaccaatgcatgtgataatcaaattgttcaaaaccagtggctaagagaaaatctaaaaagcagcctgtagaaaagtcacattatgtatagaggaaaaatgatgaagatttcagcaaactttttgttgaaagtaatgcaaatgagaagacagtggaacaacatctttaaagtacagaagaaacaaacatcaacctagaatttgtcaagagttaaatagaggctaggccataaaggctctttttatccacattaaggagtaccagagtatgaaggaagaggccaacatgaaagtgagattagaaaggatgaatcacagaggtgagagaaaaacccagagactgtgtcatcacaaaagttatgtacagcttttttatagagcttattatggaccaggtattggtataagcagttttgcatgtattaatttaactttcacaacaatcctttgggctagatacctgcagaattgttatatgataatgaaaaaatgaggtatagagaagttaagtgagttgcctgagaaaatgcatagctaataagcgaacagaatcaggatttgaactcatgcaatttgacaatagaatttgtgctcttaactagtatatcatgctgtcttttaagcaaggcaagggatgaaaatgatgtttggatttaacgataaggatttcatgaaaaggcagtagggaataggatccatagtaaaagtaaataaaggaccctaggaggagaaagacctctatcattgtcacagtatggaaggagcagagcatggatgtgcatgcatataaacttgtaggtttcctgctaatcacaactccttcaatatcaatttctctttcatggattcgaaacagggactaaaattgtctgtgttagcaagttactcctcatttaacttcaacttttcttggcaataggggagagggaagagactccttctttctttgctattgaaatataggtttctaagatactgagctgagaaagtctttctggtacccgtaaaacatggagaatttttaactgcttttgaagattcacattggcaacgaccactggaaatgaacatagtccttgatattgtgtgttggggtaaatctgtattggtaggaaaaggtcactatataaagataatatataaagataataaatgaaactttctgcaggggtgatagtaattatgatatgcaatatctctttataagcaattgtctagaatatgggccagcaaactcctgccaatttttgtaaataaagttttatttggaacatagccatgcccattcttgacgtacgtctgtggctgcttttgcactagaatatcagatctaaatggctgcagcagagactataaggcctgcaaagcctaatatatttactatctgctcattttcaggaaaagtttgctgatctcttttctagaataataaagcagtaaaaacttggaaaaatgttttgagaaaaagagaaaaataccaaaaatgtggagactcagagaactagaagatattaagaatatatttttaatagaaaatcactttacaaactgatacagattgtacattgatctcatttttatctaaatgatttacataaaatgttaacagcaattgttatatttgatttttattttcttactggttctatgtgttttctgatttttgtacaatgaacatatattattgtgttagtaataaaactgactactagtagaccagggtgacaacatagaagcccaagctaattagaatgtgaagacaatgtggcagggtcaggcaaagatgaggcatcctggaagatgtataaggaaaatgctcaagttgccaaagaagttggagaaatatttttgataatgccactaaggacacatttggtgtctttaatttcttatatttaaccacaatttacatgggctaatatatgagtagtccctgaaaatgactttccataaaaaacaaccaaaatgagttatataaattataaatcacatttaggaacatttgtaaatgttccttatttcctaagatacagatttttattagtttatacagatgttcttagttttgtgacttactgataatgttttatattagtgatttatttttaattagaaaaattaaatttattttgctataaataaagtctgtactttattatagaagtggaggaccttgttttgtaagaaatcacaattatttctttaaacaaggcaaagaaattttatttggtcaaaaataatcagaaattacagaaagcaatattgagtgaagtactgttattaaccagatgaaacttaaagtagttttactgtggtattctactgcaacatctgcacggtggcactacccagatgctcactataaagttcaatggctcctgacaagcattaagttcctttcagtggctgtactatgttaggagtcattgaaacagaagagaaatcagattttaccaaagtttatctcttaagtcaacacatttttatttaaattatcatcatgaatggtatttattatctctataatgaccaaatcagttgttgagagctatcttagtataaaagcttaggatacaaattactggcttgcccataaactgtcatgcaaaacaaacaaaccaaagcaaataacaattctaaacctctttttctatttgtcctttaaatataagtcaaaaaggctagtggtttattagctataactaaaatataatttgtaggaggaatttttatgtaaccattgttaaaaacaaattaattcaatagagaatgagcctcagagcaagaatatatgtggatatacatagtgtttttatgtgaaatataaaatttgagcctttgtgttaattaaatatataattattatctaaaattaaataaatataattatatatttaaaattgtacatacttgtgcattattttattcagccattccactaactagtatgaccatgaataatgaaatggttttgaatgaaagaatgtcagtaataggcatatttacaagaaatttcatgttaattaaatccattatgttacagaattttttaaggagaagtggtagaagtcccacttatgattgtttgacaatggactaaaaaagtctacacattgttgggaccaagcatcactggccatagatgtgtcagatgtcctaatggatcttatttatatctaatttttattattcaagttgattttaatcataatgtagaccggaatctgtttttgttacttatgcaagcactctctttttttaaaattaatggatttctcatttattcaggaagtctctaatggcatttgggggaggggaagtttattagttccttcctgagtaatgcagtttttatttcttgttgaaactgtggtctcagccaaaaatcagtgttgggtggaagaaagtattaataaaaaagggtaggagagaaggagggaaagaaagcaggaaaggataaaggtaggaaaggatggtaagaaaagaagagaaagcaaaaaaggaaaacaagaaagttaactatacaaacatttagttcacttgtataaaaagtaaatacattgtaaattgttctgctgaaacaacaacatcctgtccttatctcacttctacaccctgctgcctctatttcctgctgccctgatgatgatattttatttatatataaatatatgaagcaatatgtatattttgatgatgtttgttactgaatttctaagtaattgaaacataaaggagaattattctggttataaatttttctgagtttttatatgattactggaaaatagctagccatttctataactttataagtttacttcagtaatgatatttttctgatgctatgagttaagaaaatgtccagcccaagtctggggtttagggagtagctagtatgtagtgtgtggagaggtgcagggtggagtgtatcacaatcctgctatttcccttataaaataaacttgtttctgaaagattcttatatttttagaattgatctctcagcctttgtaatttttataaatatttaacttgtctagagaaaataaaacataaaaggtagttacagagagtagggtcacaagtgaaagaataggttttgcatgtacatttcgtgttggctctacttaaccttacaatccatattgaggaaggtaaattcaatattgctgttaatcaaatcactgagcttaagtgactcacccaaggcctcatggacaatggacaattgttagggttgaatgagaattcatacctcctcttccgattctcagcagtcatggagtctcattatcatcctcatttcctgaactgctactgtgctggaagtactcctgacagtttgtatcctccctcagaagctgtgacctatttttaatgttgctttttcaggtaaagagataatattacatgctgtgtaatattatccattgctgtataaatggatgaagaagaatttataaattccagacctacttagcattttcatgctctttataattactaaaagtctatcactatttgagtcacaggttaacttaaaaaaattaaagaatccaaaactgtatttttgttctaccaattcctcttcacatgcacacctttacattattttctgtaaatcctgttttactttgggtttttttttttcttctttcttttttcttttttttttttaagagacatagtcttgctctgttgcccaggctggagtgcagtggtgtgatctcagctcactgcatcctctgcctcctgggttcaagtgagtcttgtgcctcagcctcccaagtaggtgggattatgggcatgtgtcgtcacacctggctaatttttgtattttagtagagacagggttttaccatgttggtcaggctggtctcaaactcctgtcctcaagtgatccacccacctgggcctcccaaaattttgggatcaccagacatgagccaccgtgcccggcctttactttgttttgactgtaaatttctggtttcttaatacagtttccgatgataattaaatattaggttcactctacttcttaactatagatatttattctaaatacatattatatgaacccagctatgtcatatggatttgagaactagcattaaacatacttttaggctcttgtttgcttatttatctctctatacaagaattagcacaaatattcatatactcactaaccaagataatgttattaattttatgctacaaaacaaaataagccatatccaatattttcctaatgtcaagtgaatgtaactaaaaaaggaatgtaagtgagatcacagtgtgtgaagtgtgagttgatacactgataccttttatgattcaattaaatgttttctgaaaatagcctcttcaaattcttagaaatttcctaagaaatgtacaataagcatcaaaatgtgtaattactttagatctatttaatagttgtcaacattttaaaataatagtcttgtagatattttttaagtaccaggacaatgacataaaaataagcataaattgtaactgtctctaaatttaataaagtatacatttttacattccacaaaacttaattttaattgttttcagcactgacatataattactaaatgtcacgtgaccaacaaaaaatttaaataagatttaagttgagagctttactggaagaaatgcagttacatttcttttaaatattttagtaaataagtaataaatacttttattttaataaataacagaatgcaagtggaaaattgccgcctggaatcacttgttgttcaagccttcccattgagaaagactgattgtagactgactgtcagcattttagaggttaatgctatataaaagtatttgcatttctaaaactttttaaatcatgagtatgataaaattccaaaaatggatacctaaggtgcttcacttgaaataccattaattaggaaaactgtgattatgcttatgttgaatatcttctgcaaataaaattatcagatttattgttatcaagcagatacatatacttaagaaaaataaggtcttgtttttctaattcccaaaaccaaatgtatttttagtgtagtgagataatacaggaaaaaattgtataggctaaataatttgttgttttaatagtgaaaagcaattgattcctagttagttataataataacatgaacattcttcttctatgatttctttttttttttttttttttcgagatggagtctcgttctgtcacccagggtggagtgcagtggtgtgatctccgctcgctgcaagatctacctcccgggttcatgccattctcctgcctcagcctcctgagtaggtgggactacaggcgcctgccaccacacctggctaattttctgtatttttagtagagacggggtttcatcgtgttacccaggatggtctcgatctcctgacctcgtgatccacctgcctcggcctcccgaagtgctgggattacaggtgtgagccaccgcgcctggcctcttctatgatttctaaacttcttttattgtaaacataattcctgtgtttggggagctcagaattagtttggtaagttcttatctatgattccatagaatacaaacaaggcaaatcctaaaattatatctacatggttaagtcaaatagagagttgttgacatgttgtgatttatgtagagagtcagattgtcccattctgctcagttaaaatcagctaagggttattttgaggttctagaccatttgtgcaaaatcaaaacaaaggtcaaagaatggatgagtgtaattttttcatgcccctctttttaatatctttaaatgattacttttcattttctcattaataaaattactttggtaaaaaaaatgagtattttaatatgacatttcaataatgctatttattcaacatctagctgttaagtctaaggtgctgaatgaggttttgttagataatacaataatataagataggattgtggccctcaaggaatttgcagttttggtagaaagtcaaaaccaaacaggagaagttaaataaaacttgattatgttaaataatatcagagacaacaatagtatcagaagcatagttattctttccaaatgtcagaaaacagatttggagcataaaatatagttaattactattaacgttcgtgtacagcaacataggttaaaatgcatacgttgatgtttaaccagtacagcaagcaagagtaaatatgtgagatatagtcttctatttctttaaactctgaatgtggcatttgtcttgaagatggagggtgggaaagtgtaacaaaaaaaggagagaggacagagcatcctctcaaaagaagactgctattagaaaagcagggcacaaaaggtgagaagggatataccaaaatctaattcacctgaaaagtgtgacttaccgtacttcaaaaaaccaaaccttagtgccatagtaacaggcagtcgataaatgatcagtaattatcaccttagagggtggtggtttcaagagcctatgcttacctcaaacatagcaaattgtatatattaaatgtggacatctttttatccatcaatcatttctcaataacattgcttaaaaatgatcagtaaaattacggtcataatcagagccctctaattggtataatttttgtatgaatcattcatgtattctttcagtagatactaccacacaccattataggtggaggctatgaggtacactgttctttccaaagggcttagagttttgcttgggaaagcagatgcatatacagtagcacaagattattgcatatacaataacacaagtaggttatgtgtaggatacgtgcgagaaggttgtagcagtaaggcctggaaacgcaatttggattcagggcgtggaggtatttattataagattaagaaacataggatgtttagataaatgggactcatggaagatactcgaatatatcagtgacgtgatcacagcagcaatatttgacagtatgatgcaacattgtcagagcaaggcgagagattgattgatgaagagaaagatgaaggcaggaaggtaaaccaaatgctccttattttaatggtacttatttcaatggcacagttaaggtgtggtagtgattgaactaagtcttcaacattatgggtaaaaagataaagaagattttttaaattttggaaatttaacatttttaagacttgaagccagataatagcttatcagttagaggtttcctttgataatttaaaaactataactatatcttgcttattaggtatctaagctcttctttcttagataaaataaatataatgtcagttaaatatgtataaaatttcagtttatgaaagacaaaactatcttcttaatattgtacttttttttgagatggagtctcgctctgtcgcccaggctggagtgcagtggcgtgatcttggctcactgcaagctctgcctcctgggttcacgccagtcttctgcctcagcctcccgagtagctgtgactacaggtgcccaccaccacacctggctaattttttgtatttttagtagagacgggatttcactgtgttagccagggtggtcttgatctcctgacctcgtgatccacctgcctcggcctcccaaagtgctgggattacaggcgtgagccactgtgcctggccaatattgtacatttttaaatatattccatagcccattttagtaagttcgcgggagaagaggcaggatttttgagtcatttcactttaatacatacaaatgtcatgaagtactacttgggcagaagtaatatgcattagatccataatagaatatttttcttaagaattcaaggactggtatagtgctgtctgaacatatatttcttaagtatattttattattagaacacttcacagcacaattgagtagaaagttcagaggtttcccatatacccctctgcctctaacacacaacctcttttatcagcatgctgcgcccacagtgtacattcgttatgatcaatgaacctgcattgacacattgtcacccaaagtccacagtttacattagagaatatacaacccatggaatatgcagtatacattatgtataccctaatatacattagggttcattcagcaactaccactctgatcagtcagctgccatcaatatcaaagcaagaccctccaacagcaaaaagattatgactcactgaaggctcagagaattgttggcagtttttagcaataattttttattacactttaagttctgggatacgtatatattgtatattccatgggtttatacgtgtatattgtatattccatgggtttacacagtaacatacagaatagtttcactgccctaaaaatccttgtgtcctatcttttcatccttcccttcctccaactattggcaactgttgattttttcactgtctccttttgccttttccagaatatcatatatttggaatcatacagtatgtagccttttcagattggtttccttcacttagtaatatgcatttaagttttctaagctgggcacagtggctcatatgtttaattccagcattttgtgagtccaaggcaggaggatcacttgagcccaggagtttgagaccagcctgggcaacatagcaagacatcgtctctacaaaaaataaaaacaaaaaaattagctagacatggtggcatgtgcttatagtcctagctacttggaaggctgaagcaggaagattgctcaagcccaggagttgaaggttgcagtgagctatgattgtgccactgcactccagcctgggcaacagcgtgagatcctgtctcaaagaaaaaaaaaatgttttctccacatcttttcatggcttgatacctcatatctttttagcactgaataatattccgttgtctggatgtgatacaatttatttctctactcacccactgaagaacatcttggttgtttctaagaatcagcaattataaagctgctacaaatatctatgtgcagatttttgtttggggataggttttcaactccttgggtaagtatcaaggagagcagttgctggatcatatggtaaaaatatgtttggtttttgtaagaaactgccaaactgtcttccaaagtggctgcgccgttttgcatttccgccagcaatggatgagttcctgttgcttcaaatccccaccagcattttatggtggtgttagtgttctggattttggcctgaacatgtatttcttgatagactttttttttttttttttttttggccaagatttgccctttactataaaaacccaaactatgaatgatgattagtcttggtgaaaacttttaacaatcattgttctcgtgtattcttaagagaattctttgtgattgattttttaaaaatgttacaatatgttctataaaggttttatggaacatattgtaacattttatatttaatgttcataagattggcattgtgttagaaggcaggtttcttttgaaaagtcattttttctagaaatcattgatcaataaattcactgacttttctgttctccagtagcctgtccaaaagttaccatggattcataatattttactaaaattaatggaaaggaaaactggaaatgatagttgttctaagaaaattagtattttaagcagactagtagttttatctttggatatatctgaacagttctaatgaaaaatattttccctttgacctcaaagacgtattgtaagagtaactcaagccttaaaaagactaaatctcttgaacattaaagttgaagacaccgagaaggtatttatatgccttctggcagcagcaatttttgttattgtttgtctagttagtgccctagcataaagaaaaaaatagacatttgcaaatttcacctaaaaattgactcctatatcagtaaagattttattgggttgaggtaaagaataatcaatctgaaaggaatcattttgcaaggtaaattagtgatcaagaatacaagctttggaattagaactgaatcataaaattgtgattttgctacttagtaatatgtggccttggacaagttgtgtaaagttatgtgtggcatagcttccttatttgtaaagtgggaaagataatgcctattcattgctattataatgattaaatgagattacataaagtacttggtacaatgcctaacactcagtaggtgattaataaatgatagccattgttcttgatcagccaggcttgtacttaaacattctctttaaaactattgaaggaaaaaagaaggaaagggaatttcatctgatcaaccagcttgtgcttaaacattccctttaaaactattttagggaaaaggaagggaaggaaatttcatctgtctagctcaccaagaatggagtggacattggattctgggagcaaaggcctatgacaaagaaattaaaactaaaatactctctctgcctttttataaatcagtttttctcttcatgccactttggtaacaacttttgtggtatcagaattaaagactgtttattaacacagttttcccttttaatttgccatatattgttttttgtattatacaagggttagtacttgtctaagctgacctgctacgcccctgaaagcacaaaatgtgtcttgttcattgtatatatatcccagagtatatcacacctaatatgtaatcaacaagtatatatgaattccatgaatctcagttgttgtgtatactgtgcctgagaggcagaagaacttggtttgttaacagcttgaccacaaatcaactatgtggtgatagtttcagactttattcacacaactaattatttttattgctattgttagtattactactactaattatttctattactgttctttaaaatagtatttgtatgttttttattagtcaaggtaggaaagtggttgtaaaaaaatcccaaatttcagtgccttaatacaataaaagtttatttcttaccttatgtcacagtctactatgtataggattgccagataaaattcaagatgcccagttacatttgaatttcaaataagcaataaacaatttttaagtatatcctaaatattgcatacatatatagttatgtctttaatactgtataaggcatacttatactaaaaaaatatgtgttttatctgaaattcaaattcagctgtgctctctgtatacttattaattgttaaagctggccaccctaaagtgtagaggagtgatgatggatagaagaggtgggtggctctactttgtacagtcagtgagagtctcatactccttccttcacatagtcctaccatatgttgggccttatcctcctctatattcagtccatatgtggagaacagcagagcataatatatggggaattgtgtgtgaggtttcatgggccaaacttggaagcaccttgttatcacttccacccactttgtacatatttgccataactcagtcacatgacctctgctcacataaaggagggctgggaaatgtagtttggctgtgtgtctgagaagcaaaaacaggtttagtgagcatccagtctctaccatattcctttctttgttcactaaatcagtgacattattgtttttatttttctgtttttttcccctttgaacaattaggatatcagcacatttactcttagttttgttctccccctgcaaaaacaaacaaaaccacaatgattccttttaaacattccttccttttatgtctttctgtggaatcatcaaaatgagttgtactatttctccaaagaatgtaagttagacttaatacatgtttaggcgaagttcaagagacacacctgctcatttcttgtcctgaaatacattacagggtgcccagttatacagctggtcaataaaaagatgcctgattgccttccagagtcaaagaggcttcacttgacaataagaaataaaggtgggccaggcgcagtggcttaggtctgtaatccaagcaccttgggtggctgaggggggcggatcacgaggtcaggagttgaagaccagcctggccaagatggtgaaaccccgtctctactaaaaatacaaaaattagccgggcgtggtggcatcgcctgtagtcccagctactcaggaggctgaggcaggagaatgtcgtgaacccgggaggcggagcttgcagtgagccgagatcccgccactgcactccagcctgggccacagagcgagactccgtctcaaaggaaaaaaaggaaggaagaaagaaaggtggaagtttggtgtttttgtgaagagaaagaattgcatcatgaagatagtgtcagtgtttgagcatataagtagattattgtttataattatatattgtttatttcagtattgcacagcaaacatatccattttatttatattacattgttttggaaaactctagatatacttagcagagtagttatatttgatttaaagggtagaaaaaaattagtaatttggatgtcttgttttaaatgacatttatttgtttcttcattctttcatttagcaaataattattgaatgcctactatttgtaggatatagcatgtatagttgaagctatacatgagtatccatagtcactgtgataggaattcttttttttcaacttttattttagattcagaggatacatatatgtaggtttgttacctggatgtattgcatgatgctgaggtttagggtatgaatgatcttatcacccaggtactgagcatagtacccaatagtgagtttttcaacccttgttccctctcttcctctcccctctagtagtcttcagtgtctattgctggcatcgttatgatcatgagtacccattgtttagcccccaattctgagtgagaacatgtgatatttggttttctgttcctgaattaatttgcttaaaataatggcctccagctgcatccatgttgctgcaaaggacatgtgtattagtctgttcttagactgctacagagatactacctaagactgggtaatttataaacaaaggagttttaattgacttacagttccgcatggctggggaggactcaggaaacttacaatcgtggtggaaggggaagtaggcaccttcttcacaaggctgtaggagagagtataagcatgttggccgggcagggtggctcacgcctgtaatcccagcactttgggaggccgaagcaggcggattacctgaggtcaggagttcgagaccaccctggccaccatggtgaaaccccgtctctactaaaaatacaaaaattaaatgggcatggtggcacatgcctgtaatcccagctactcgggaggctgaagcaggagaattgcttcagcccgggaggcagaggttgcagtgagtcgagattgtgccagtgcactccagcctggccgacagagccagactctgtctcaaaaaaagaagaaagaaaggagagagagagagagagagagagagagagagagagaaactgtcaaatacttataaaaaccatcagatttcatgagaagtcactatcataagaacagcataggggaagccaccccatgatccaatcacctcccacctggtccttccctcgacacatggggattatgaggattacaattccagatgagatttgggtgaggacacagcaccaaaccatatcaccatgactttgttcttttttgtggatgcatagtattccatggtgtatatggaatatataccatgtgtatacaccatggaatactatgcatctattttctttatccagtccactgttgattgacatctaggttgataccatgtctttgctattgtgagtagtggtgctatgaacatgtgagtgtatgtgtctttttgatagaatgatttattgacttttggttttatgccaagtaatgggattgctgggttgaatgatagttttgagttctttgagaaatctccaaactgctttccacggtggctgaactaaattacattcccactaacagtgtataacacttttcttcacagccttaccaacatgtttttgtttttttgacttttttaataattgccattctcactgggtgagatggtatctcattgtggtcttgatttgcatttctctgattattagtgatgcggagcattttttcatgtgtttgttggccgcttgtatgtcttcttttgagaagtgtctgttcatgtctttgcccatattttaatgaggctatatgttttttgcttgttcatttaaggtccttacggattctggatattagacctttgttgaatgcagagtttgtgaatactttctcccattctgtaggttggttgtttactctgttgatagtttctttgctttgcagaccctctttagttgaattaggttccacttgtcaatttttgtttttgttgcaattgcttttgaggacttagtcgtaattctttgccatggacgaagtccagaatggtgtttcttacttttttttctaggattcttatagtttgaggttttacattgaaacctatactttattttgagttattttttgtatatggtgaaaggtaggggcccagtttcattcttccacatatggctagccaactatcccagcaccatttattgaataggggtccttttcccatttagtatttttgtctactttgtcaaagatcagatggctgtaggtctgcagctttttttctgggttctctattctgttccattagtctatatgtctctttttggaccagtaccatgctgttttggcttattgtagccttatagtatagtttgaagtcaggtaatatgatgtctctggctttgttttttttcacttaggattgctttggctattttggctcttttttggtgctatatgaattttagaatcgtttgttctagttctgtgaaaaatgacattggtagtttggtatgaatagcattgaatctatagagtgccttaggcagtatcgccattttaataatattgattcttccaatctgtgagcatgagatgtttttacatttgtttgtgtcttctatgacttctgttatcagtattttgtagttctccttgtagagatctttcaactacttggttagatgtattcctggctattttatttttttcctgtggctatagtaaatgggattgcattcttggtttggctctcagcttgaacatgattagtatatagaaatgctgctgatttttttttccattgaattgacatcctgaaactgtgctgatgtagtttatcagctccaggaaacttttggcagggtctttaaggttttctagctatagaatcacacattgtttgcatagagagatagtttgacttcttttcttatttggataccttttttttttttctaactttctgttgcccaattgatctggctaggacctccaggaattctaatatttaacccttaatattgaatggagttacatttcatgtcatgctttttgagtgatttacaggtgcaaatcggagatactgcagtttggtttcagagcaccacaataaagtgaatattgccataaactgagtcacacacatgttttggtttcttttatagggcatataaaagttatatgtacattatactgtattctattaaacatgcaatagcattatacctaaagaaacaatgtacataccttagttccagaatctacaaagaacttaatcaaatttatgagaaaaaaacaaccccatgaaaaagtgggcagaggatatgaatagacatttctcgaaagaagacatttatgcagccaacaaacatatgaaaaaaagcttatcatcactggccatcagagaaatgcaaatcaaaaccacagtgagataccatctcatgccagttagaatggcgattgctaaaaagtcaggaaacaacagatgctggagaggatgtggagaaataagaacgcttttacactgttggtaggagtataaatcagttcaaccattgcggaagacagtgtggcgattcctcaaggatctacaaccagaaataccatttgtcccagcgatcccattactggctatatacccaaaggattgtaaatcatgctgctataaagatgcatgcacacatatgtttattgcggcaccattcacaatagcaaagacttggaaccaacccaaatgcccatcaatgatagactggataaagaaaatgtggcacatatacaccatggaatactatgcagccataaaaaaggatgagttcatgtcctttgtagggacatggacgaagctggaaaccatcattctcagcaaactaacacaggaaaagaaaaccaaacactgcatgttctcactcataagtgagagttgaacaatgagaacacatggacacagggaggggaacatcacacaccggggcctgtcggggtggggggctaagggagggatagcattaggagaaatacctaatgtagatgacgggttgacgggtgcagcaaacttccatggcacgtgtatacctatgtaacaaacctgcacgttctgcacatgtaatccagaacttaaagtataataaaaaaattattgctaagaaatggcaacaattctctgagccttcagtgagtcaaaatctttttgctgttggaaggtcttgccttgatattgatggcagctgactgatcagagtggtggttgctgaatgctggggtggctgtggcagtttcttaaaataagacaacaatgaagtttgccacattgaatgacttttcctttcacaaatgatttctcaatagcatacaatactgtttgatggcatttgacccacagtagaacttcaaaattggagtcagttttagtcttaaaccttgccgctgctttatcaactcagtttatgtaatattctaaatcttttgtaatcgtttcagcagtgttcatagcatcttcaccagtagattctatctcaagaaaccactctctttgctcatccataagaagcaactcatctgtcaagtttgatatcgtgagattggcagcaattcagtcacatcttcaggctccacttgtaattcttgttctccctctatttccactacatttgcagtgacttcttccactcaagtcttgaaccccttaaagtcatccacaagggttggaatcaactacttccaaactctagtttatgttactattttaatctcctcccgtgaatcacaaatgttcttaatagcatctagaataatgaattctttccagaaggttttctatttactttttccagacccatcgaaggattcactatttgtggcagttaaagccttatgaaatatatttcttaaataataagtcttgaaagtcaaagttacgccatgatccatgggctgcagaatagatattgtgtttgcagtcaggaaaacaacatcagtctccttgtatatcttcatcagagctcttgggtgactagatgcattgtcaatgaacagcagaggacttccgtgtagcaggtctcaacagtgggcttcaaatattcggtaaaccattctgtgaacagatgtgctgtcacccaggctttgttgttccatttatagaacacaggcagagtagatttagtgtaattctgaagggccataggattttcagaatggtaaatgagcattggcttcagcttaaagcccccaactgcattagctgctaacaagagaaccagcctaacaagagaatcagcctttgaatatttgaaagcatgcattgacttctgctctttagctatgaaagttctacatggcatctttcaatagaaggctgtttcatctacactgaaaatctgttgtttggtataaccaccataatcagtgatcttagctagatcttctggataacttggtgcagcttctacatcagcacttactgcttcactgtgcaccgttttgttctaaagacagcttccttccttaaacttcatgaaccagtttctgccaacatcagactttttgtctgctgctctcttaccactcaattgaagagacttagggccttgctctgtattcggctttggcttaaggaaatgttgtggctggtttgatcttctatccacatcactaaatctttctctgtataaacagtaaggctgttttgctttcttatcatctgtgtttcactggagtagcacttttaatttccttcaagaacttttcctttgcattcacaacttgactgtttggtacaagaggactagctttcggcctatcttggcttttgacgtgccttactcactgagcttgatcatttttagcttttgatttagagtgagagatgtgcaactttttccttttacttgaaacacttaggggccattatagggttattaattggcctaattttaatattattgtcatttttagcttttgttttaaaatgggagagtgcaactttttccttttgcatgaacacttagaggccgttataatttcaatattggcctaatttcaatattgttgtgtctcagggaatagggaagcctgaggagagggacagagatggggaacagccagtaggtaaagcactcagaacacacccatctatggattatgtttgtcttgtatgggtgtggttcacggtgtcctacaatagtaacatctgagatcactgataacagataatcgtaacagatataatgataaagtattacaagaattaccaaatgtgacagacctgaatgagcacatgctgttggataaatgatgaatggagacttgttcaaggtatggttgccacaaaccttgaatttgtaaaaacaaacaataacaaaaacaaccacaatatctgtgaagtgcaataaagtgaggtatgtctctattcagtgatgatgggtttttttaatcccagaataagctgtctcctgtttctcatgatggtcactgaaattttgaaatgtctttctagagttaaggatgccacctgtggcctagttgcagaacagacaaattcatatgagaattgtctcaggtctcatcagcattgtcttcagtccaactcaaagcctccacccccataagaagaaaaataggtcatcagtagttaagaagatttttaggtaagttaacctttagatgttcatcacagaaatcccccccaaaaatttggattttattaagcaataaagtcagacaagcccagtgagatcagagcacgttaaggatattaatcacaatccctcacttttttggagaaagtcaactaacgaaatttttaaatgtttcaaaattccttttagaaaatgaatctaatctttcctaaaacagaaatcaattgctacaattttttttttttttgagacagagtcttgctctgttgcccaagctggagtgcagtgttgtgatctcagttcactgcaacctccgcctcctgggttcaagcaattctcctagctgggattacaggcgagcaccaccacaccctgataattttttgtatttttagtagagatggtgtttcaccatgttagccaggatggtcttgatttcctgacctcatgatccgccctccttggcctcccaaagtacaatatttttaagatatagcaacacatactgtttcagtaccacaatatctgaaaataaggtaatttttcctgtcctgtgatagagttaagcgcataggtgaagtttttaaaaagatcttgtttgctttcaagttttggcaattgtgaataaagctactgtaaacatctatgtgcaagcttttgtatggacttggttttcaactcctttggctaaataccaagaagagcaactgctgaatcttatggtaagaatatatttagttttttaagaagttactggggcctatcaggtgggtggaggttgggaggagaaaggggatcaggaaaaataactaagaggtactaggcttaatacctgggtgatgaaataacctgtacaacgaacccccatgacacaagtttacctatctaacaaacctgtatgtgtacccctgagcttaaaataaaagttaaaaaaagaagttaccagattttcttccaaagtggttgtatcttttgcattttgaaggagagttcctgttgctccatatccttaccagcatttatgttgtaattgatctacatattggccattctaatatgcatataatggaatctcgttttaatttgcatttccccaataacatattatgtaggacctcttttcatatgctcatttgccatctgtatatctcctttgctgagatatctgggtctttggtccatttttattgggctgtttattattattgcatttttaaaagttgtttgtatatttttgtaacagttatttatcagatatgtcttttgcaaatattttctcccagtctgtggcttgtcttctcactctcttgacaatgtattttacagagcagaagttttttaattctaatgaagtccatgttataatttttttttcatggaatcatgcctttggtattgtatcttaaaggtcatcttgattttattatatgttattatctagaagttttatagttttgcattttacttgtatgtctgtggtccattttgatgtaatttttctaaagggtgtaaggtctgtgtttagattcatttttctctttttgcatgtggatatccctgttttctagcaacacttgttgaaaaggctgtcttttctccattctagtacctttgctctcttgtcaaaattcagttgactatatttatatgggtctatttctggcctctctcttctgttccattgacctatttgtctatttttccttccaataccgtattatcttgataactgttgccttatagtcagtcctccaaatttgttctccttttttattgaactattttggatcttttacctattcatataaactttacaatttgttcatcaatagcgacgaaataagttcgttgtatttttattgggattgtattgaatctataggtcacatcaggaagaactgacatcttgacaatattgagatattgagtcttcctattcatgaacatagaatatctctccatttatttagttctttgatttctttcacatcagcattttgtagctttcctcatgtaaaattttatacataattttattagatttatacctaagtatttcatcttttggggtaataatgtaaatagtgctgtgtttttttatgtcaaattttgtttgttctttggtggcttatagaaaatcaattggcttttgtatatcaaccttgtatcctgacaccttactgtaattacttatcatcactctcttcttgattgcatggtttctgataattcagatgtaatttttaacttagtttctccatcagtaaggggtgtgtgtgtgtgtgcgttatctctggcttctttcaggattttttctttatcttctattttctgcaatctagttatgacatgcctagatgggattttgctttcttttgagcatttgtcccacttaatgttctctgtgcttcctggttctggagccttgtgtctgacattaatttggagaaattctcagtcattattgcttctgtttctttctctctttattcttgttgtatctccattacacatatttacactttttgtagttgttccacagttcttggatattctgttgtgtttcttaagtcttttttctcttgactttcctgttttgaaatttctattgccacatcctcaagctcagagattgtttcttcagtcatgtctcgtctagtaataaaattatcaaaggcattctttatttgtgtaacagtgtttttgatctctagcatttcttttttattcttagaattttcatctttctccttacattgtccatatgttcttgcattttgtttgcattatccattagagttctttgcatattaatcatagttgttttaaattcccagtctgatattccaacatcgctcccttatctgagtctgattctggtgcttgttctgtcttttcaaactgtggtttttgctttttagtgtgccttgtgattctttcttgatagctggacatgatatcctgggtaaaaggaactgctgtaaataggctttcagtaatgtggtggtaacttgtgaagagaggggaaatgttcttcatagtcctatgattaggactcagtgttttagtgagcctgtgcctgtggactgtgaaatttgcaagtgcttctctgttgacctcacactactccataggtgggaaaggttggctagagtgggctggatttgagtatttttgttatcttaggcagttaggctctgataaaaccatagcaggtgaggctccggttagtttctcttgagggcaggccttgttaagaacagaatgctctggagtatttcagaatggttctttttccttttcccttgccagaagcaaggagagtactctccagtatttactgtgagaaccttgtccagtccccagagacaaaacacaagcatttagagatccccctgtgactgagttaccctagaattattgactctcagatttgtctacaatgaacctccagcagttaatcagttacagtttaggttttcctaacctagcactggttccaggggatgttttttctcatgagttttgctcaggtaaattgcctgtctgtatctacctgtttgtctctccagttttgggggcagtggtttgccttgtgacctcatctgttcactggatctaacacagggttgttgggttctcagtttgttcagctttttactttttattaggtcagggtggtgacttccaagttcttacatggcgtaacagaaccctgctgtccttcttattaaatatatgttgttggattctaaattcatattttgctaaagatatttgtgtctacatttatgagggatgttgactgtgttttcttttcttacatttccttttctggttttactgtcagagtaatactcactctcccagtatttagctttaccccacaaattttgatatattatattttcattattactcattataattttttttaatttcccatgcaattttgtcttttacctatatgttgtttagaggagtattttttaattccaaatgattggagatttttcaggtgcattatgttttttagtactagtttaattatattatggtcagataacatactttgtatatattgtcttttaaattttattgagacttgttttatggcacagaatatggtctattttggtgaatgcttcaagaatacacattaaaagaatgtatattctgctatttatgagtgtagtattttgtaaattcaactagatctagctgatgtagagattggttctagtattttatattctcactaattttctgtctactatcggttgttgagagagaaatgttaaaatctctacctataattgcaaacttgtctatttcttttttcaagtctgataatctttgtttcatgcactttaaaccttattagttagatataaaacatttaatattgttttgtcattttgatccatttactctcttattattctacagctgtctttatttttttctgttattccttgtcctgaagtctaatttatctggtatttatacaagtaccctgcttcttatgataatatttgcaggtatattcttttctatgccattaatattaaatttgtcttatacataaagttgtttcttggagcagcatatgttgatttggttttgtaatccactataaatctatactttttattgcagtgtttagaccacttatatttaatttttaaaaatctttatttttgaattatctttcattttgttttccatttatttatactatctaatctttgtcctttttagtattaatttttactatttcattttctctctactgttaggtatacgtctttattgtttttagcaattgctctagaacttaaatatctgcaatataattttccttgaaaacaaagttcagacttagaaaattgtggctgatgtggactgtgtagataaattgattaatcagtcactgaattttgtagtttgaagatggtagttttaaaacaaaaattaattaatactgctttataaaatagtattatataaagtattaattttcacatctggcctttttatctatgatcacttcctcctccatactaaggaacatttttttcatcaaataaactttttccttttaggtgtacatttccaacataaacttggctctgtatatgccttgacagtactgctcttcactgatcagttgataacttttcatgcatctgtttcaaatatcttctttccaaatgctctctattccatttcctctcaataacagctgataacttcatatctcttgacagagaaaactgagaacatttggaatgagatgcatggatacactgctttcacctcaactcatttctgctttcttctccagtaggtgatgataatctcatcctccttactgttccagaagaggtgccctcttcctttcctagcatacctcttgctctagccttagaatttcatgtttcttagggaccctgatctcctaatttatctttctcttgcactctttccaaatctggacaaaacctccactttactgtcttgttcattttaactaccttttgatttctttactgtctttcttatctagcattttaaaatgattggtctacagccatttcctctgtgtccttgcagcctactttattcttcatatattgtaatctagcttccacactgaagcctcacaataagcattccatttttgcctggttaattcttaccttaaacactaagctgtagaataataatttcaaagaagcattcttaaaacttccaggatgggcttcttgtgaatctctcttcttattagtttgtatacagttcccactctatattaattcctttaggactataatcttgtcttatttatttatattctgccagtgtctggtatataagcccacaattaatttttttttagtttaactgaaattcagtatcttttcctctgtaaaaatttttgatcagtgtatcattcaagatttttaatcttccagttgaaattatcttctttctttttttttttctttttttttttttccagacagggtcttactctgccactcaggctgagtgcagtcatggctcactgcagtcttgacctcctgggctcaagtgattcacccacctcagccttcctagtagctgggactataggcatgcaccaccatgcctagctaatttttgttttgttttggtttggttttggttttggtttggttttgtagaaatagggtcttactatgtttccaagactgaactggatgcaagcagtcctcccacctgggcctcccaaattgccaaattacaggcatgagccaccatgcgcagtctgaaattatattctttcttgacttctaaacttgtttgctttatgtcctcaaaattcttttttgaatacctactttttgcaagtttttggcaccataaaattatgattctgtatgtttatacagctttcagtgaatgcatttataacagctactgtgcacctaggtgcaagagattccagtagtaataaggcacagctctttcacttgagaacttcattgactcaaaggagagaaaaacactcaaaagattataatatgtacactatactattctgaatagtttgtgttttctcctataggaaatgaggtatcttcatttgttttaaagttttcacttgaagaagtgatttgaatacatttatgcttatgaaaagataactgttggcagcctaaaagatggatctgagggagaagaaacagaaaaaaaaaacaaatggggttgtgtaacaatcatcaacaagatgatgaaaaaacttgattttgacagtggcagtgggcaaggatggcaaaaataccaaagatatttatccagccttgtcttttcatctgtgtttcagttgtatgtttctcactggtctctaaaatacctctaattgtgtatcaactcaaattcaactaagtaatgaaaataatagccaatatttattgataccttactttgtggtagacattgttctaattgcttcatctatattaactcgtttaatcccccagcaactctataaggcaggtgctattaatatacacattatctgaaggaggaaccattgtagagtttcagtaactgaccagtgtcacacaggatccttattcttcctctgtttttttgaaaaccataatgttacattgtctgaaacccggcttgatcatttctcttaccttctgttctatttgccttcatttctctgtatcgctatctctgtctacttttcttcctaacctggcagtctgcatcattttaaatgctggtttctctgccttcaattttcccttattcctcttctttttactgccagagaaatatcactatcatcatgttattgagttgattaatgtcttggaaagatgtaataattctctatcactcattgaatcaaatatgtcatagtattcaattcccagtaattgggctcatatcatgaatccaactctactttccccacattacccagaagagaacagtttcctttcttctgtagttccaaaatcattgcttcctttgtgcatatctatgttgttcttctaatctgaattgttttttattcctttacatcactttaacttttcttcaagatgtggcttaaccaagactgtctcccatgaaattaaaccaatgtgtggttgttttcccctttctgtgaattctctaccatttacaataagctgtgttctgacctatctatgcctttagtagagcactagtctcccaggtaatatgaagacggttgagcctgccctcatgaccaacttaactgacctgagctacatcaaggtgttagtgtgtggaggataggtggcaatgcctctgcttaggcataaatatgcaagtttctcacaaacatagaaagaatatgtaatatttttaccaaggcaatgaaatgtactacaacttatgataacttcacctccaaccagaatgttgtttatttccttcagagatatttctctttactttccacttaatgcaatttaaggagtcagaaaggccatcatacgatgattttaccccatagctgtgtttttactactctgtattatacttgattctacatattaccttacagtgttaaataataatttctttctttttcggtactaccaaaaacttagaaatagtatcttacattccactacactcaacttggcacttgccaagtctcaggttaaaagagtgcttgaaaaaaatgtgtatttttaatttgtgaatacagggttttataagtgtccattaaatgaattgcgggaaaatctgatttttagtctatttaataaatcagtttctaggaggtctcctaatctctcactgtgattattgatttgttcatttctctttgcaattttgtcagttttgcttgatgaattttgaagttatattgctgtatggattaaagattgttataacttgcttgtaaattgttcctttcattattgactaaagaccgtctttgtatctactaatgccttttgccttaaattttattttgttaaacagtgcatctaatcttatctagttaagtactcatcagtagtggtttcacaatgaaataaatgattattttatggctccattttcaaaatgatgtttaaaaccatgttaacttaatggatatatgtgattggcaaccatgtattagaacttgatcttgaaaatgaattatgtgggcatgttacagtagtcaaattactattcggatgaaatgatactaaaaacagttgacatttcatatttaatagcaccattgattcatgttcataacttaacattgaatgttaacataaaggttgtgtaatttattgtactttaatgtcctttaagactatccaagcctgtttagaaaatagtgaagcaagtatcaactacattgacttctgtcactttgttttctgagaacttgatacacttacttgacataaaatagcacaagctaccttagatttaagatacttattaattctataaatgacatatcatttattttagccagaaacaaaacatatcatcataatatattaagttcagccagcttctaccgatttcatgtcaggcactgctaagcactacatatacaaaggaagaaagcaggcctgtccctttagtgttattttcggactgaaaacaaaatctcaatataatacggtaggtaccacaatagaatttatgcaagagttacagaaaccatacattcttattcatagtttactaatggtgatgctgtaattacacacctaagatggtagtcaattgttttttctgtaatacagaaaaaatatataaaagagggacttaaattagaacactttttttttttttttttactactttaagttctgggatacatacgtagaacgcgtaggtttgttacataagtatacatgtgccatggtggtttgctgcacttaccaacccatcatttaggttttaagccctgcatgcattaggtatttgtcctaatgctcttcctccccttgtcccccaccctctgacaggccccagtgtgtgatgttcccctccctgtgtccatgtgttctcattagaacacattaatttaacacacaaagtcaataaacctactaaacaaattagggggtgtgaaatttcctttctggaaataccttctaaaaatagttattagtaaatattctcgctgaatgttttacatattctagattaacttatgcttctcccatgcctgtctttcactccttccctcaaacttgattgataccctgttacctgtatttcattgcactactgcaatgcttatgctagaaatccagaagccatccatgataatcctgcttcctaacccccttttgattggccttcatcaaatcctggcagtttttactttgaaatacattttgagtccatctgcatttcttctccaccactgcccaagttcctccacttttcacttgtgctgttccagaaggcatcttctcttgctttatctcttgtctatttcattttctcaaagagctaccagagttatctatttaaaaatattacatctaataatcatgtgcttactttctcaaaactttttgataacttcatattgatcctatgataaaatcatctcaggccacgctttgaaatccctgtgattcagccatgttgacttttcttaatatatcttgtattctgtcactcccctccccaccctatggtctttactttttaattcttttaatttgtaatacttttaattctgttgcgttactttttctttctttgtttttttgttttttgttggttggtttgtttggttttttggcctccctatgactgattcttcaggtctcagcctgaagaatatttgttactttgaggaaaccttttttaactctgtaaaggacaccttatttttcccctttctaatttttatcacactggtaaatatatatgtcattgtctttttcacctccaagattataagctcctgagaagaagaacaaaggtctgctgagcacaatgtcacatctatagtaggtgcaaatatttgttgaattaaaaagcttgcattaattaatgaaaataatgaattcaaaaggttgatttaaaaatatataaagacctaaaacatctcaattatatcattttttaatgctatgatttttgaaattaaattcaaagccattttatgtgaacaactgtcatatttaaattttttacttcaaaatatgttatctagtcttattactcagtatttcataacactataccaaatgaattttgtctgcttccaaaaaataaactaactctttcaggatgaaagtttattattttgagaatatccaaaagaatgtgctgcagtatgtgaaggcatatcaccctaaaatagtaaaaactatgagatagtgaaataatttaaaattttgggtgaaacaataaacaatttgttctagataaaatttaagaagtttttgaaatatgttatattagatgcatactgtttcagatctgtgctaacaatagtgttaagggaaaaaaactgaattttttgactttaagtttcttcttatgagtttaatttctgtaaatttcaaaagaaaaaggtgaaacaatgaaacaaattttaaatatgcttaaccagaaattttaagttctttcagaggagatgtgcttttttgtgtaaactttttactgacgtatatgggatatgatatttttagaagatgagtatgtagtgatgaccttcttcctggaaaaatcaacacacaaactaaaattacaatgattcatgctattgatgcaaagctctacctccatgattgtaatctgttctgtgacaaagacgttttaaagaacttcttaaatagaagtgctgtgcttatgcaatcagaacaagtgtgctttggattctaagacagggccattctaggatgatagaggaagcagatgagagaggtcccacagcagaccattggcaggaagtagatctgccttggagagcttatagactggtacaggtaataggcagaggtacatgcaagtagtcaccattaggatggtataaaatgaacagtgggaatgctttacaggtaggaaaaactatgcaccaggagtagatggcaataaaaaaatggtgatctaggcagttgaactaactgttgatatcaagggaatccaactgcaggtagtgcagactcagcagtggaaatggaagtccagtggcagatacagtcccttagaattaatatgaggaaagaactctcaagaatgttagctctactgaagaccattatccttagcaaactaatgcaggaacggaaaatcaaatgccacatgttctcagttataagtgggtgctaaatgattaaaagatgtggacacaaagaggggaacaacagacactggggcctccttgaggatggagggtgggaggagggagatgatcagaaaaaataactactggatactaggcttagtacctgagtgatgaaataatttgtacaacaaacccctgtgacatgaaattacctatatagcaaacctggacatgtacccctgaacctaaaagttttttaaaaaaatgtgagccctagtctcttgagacattcagatccagttggatgggaaccgagtcagggaatctagcaaatagaagaaagaaatgaactctcttttggcacaaggattaaaactagatcctaattactttgaatcagagtacaaggtcaaaatagagaccatcagcaagttgatatgaatggtgaatcctagattatggtttcagttgtatttatattttccctgccataggaactagcttcactacagtctagatggaattggtgggaccttgtcaacaattaaagggccattcctttgtgaatgagaggaaggcagagttagaggcctggctggcaaaatagccgaagaaaagatgcagtgtgtgccattcttcttcccctccctgtgcttccctcctcttaactgtggaagggaaaaaactattcacacaaggcacaattcaaagccactaaaagagctatgagaccaggggaaccacaacacttagctttgtaaaacatggaatttatttttaaccagaagaagaattgctttaaccaaaatgatagaattagcaagtacatactgcaataggccaagtacagtaacgttttaggatccgtagtttactagtttctagatacctcatgaaaaactattatccaaaatgaaatagtcatttaggagcaggagtgggagaatattagttttcagttgctgccatagcaaattaccacaaatttagcagcttaaaacaatgagtttattatctcacagttttgtaggtcagaagtctgggattgctgggctgatttctttgttccaagtttcacaaggttgaaattaaagtgtgggcctgccagactcttacctagaggctctgagaagaattcactttcaagcttatttaagttctgggcaaaattcagtttcttgtagttgtaggaatcagtgaggggtgccctaagcttcacaggcttacaggatttagaagccccacattcacaggctctggggattaggacatagatatctttgaggggccattctgcctaccacagaggggaaaaaagtttttcctaagggatgactataattatccagtttatcttactaggtgttagtaagaatagtaagaactgtacctagactctcaaatagaagccctgggatttttacaatgaattaaatcatttattggaaagagacaaaggcttccatcttttaggtcaaaaaggagaaagtagggaatgaccagaatatataatggtttacaacttgtgaaagcggagacaatgttaatatttctaacaccttttccttgtgtttctctttaaactatggtatttcgaaatgctctttaaggttattttattaagtatttggctaaatgttatttgtctgtgtgttggcggtagggagtatatttaatggaaaagctcacatatacacctagagtttgaccatgtggctgtaacgctgatttattgctctagtaaaaatttacccaacctctgaaattcatacgaagacaataaatgcttcttgagagctgaacatataacatgaatgctaaaatatctcaatgatatttcatttttcaacagaaagtttttatgctatttaacttttttaataactcattttgagaggtaattgcactaaattgtgacttttgtgtaataatgaatcagtacgtcttagcctcaggcacatagaaggcacctactatttgggatgcacgtacaaatgtgaatgtatcacccagagatttttttctcgaaacaaattgcttatgttacactctttcttgttatctaccttttctggttaagctaaatacagaatgcaagaagctcagtttctgcaccattaaacatggctgcttattctgaaaattaacagtgaaaaatcaaaggccacctcctaaagtattttaatacttttaatgaaattttaattgtttttatcagagtccttttgcacttctcttgcacataaaacatttatttggcaagagtggttgcttctcccttgttacctatcagacttcccatgtttcatggcttccatatgaaaagttcgccttttgtagaaatcaccagccagtcacagcactcttattttcatttgcatggcaaataccagctacaatatttagatcaccaactctttggccctttatctgtttttagatgctaaggatctacttctttgtggaatattttggttttgtttatttgattttgtttttgatgttatttctgggtctctctcttgctcttttggaagcctaaaggattgaatactattctgtggattctttgtgaaaataacatgtaaaatatttttgtgattgaaaaacagaccaaaaaaagtagcacagtgaatgatactggttctccagactgtgagtgggtgactaagtgaggtggcccagggtagagtacgtggtgctaaaaataaatttgtgtccctgtgcaaacaaatgcccaggaataatgtaaatgatttctaggttatttctagtacctaactttccaaaatagaaaaacttgttcttcatagtctgaaaattaaaatgcttcaaatcttattttattgaaatgaattattttaaagttagaaatatctgcattttatttaacaaattttagggattaggtttatttgaagtaaacttaatatgtggtcatattttctagctattgacaaaactgggtttgtgtgtgtgtgagtaaacaatcattttcatttatgttagaaataagacattccagaaagtttataaaaattgtatttaaaaaaatcactcaggtacgttactctaagctaatactatttattcacctacagtcttttatacgttaccttttatcatttgcataactaaaatcatgttacactcaattctgtatttggtatgcttcacatggcattatatcaccaacgggttcccacatttctcaaataatgccatttgtaagcattgtttttaatggttgaatcatgttccataatttagatgtactgcaatttacgcattatattactgatgaatttttgggttactttgaatatttcttactgtaaatatatcacagaacacattttatgtatactgtttttctcaccgttcagaatttatatttggatagtttcggaaaagaagggtcacttagtcaaatttattaatatttttatagcacatgatatatacatgtaatgtgatttctacaagtgtactagtttcccatgataccaataaactgtaaaaatccttctggcaagattcttaagcatatttccccagtcatcaataacattgcaactgtttatctagttgttaataacatttgcaaaaaatgacccttgtgaggtttaccagatctttgctttacacctattaactaaaaagattttccccaactttccaacattacaacaaaaaagaaactaagtacgaacattggaaaggttcacattattccaggcaagtaatttaaagagaccaatacctagatatagaattgaaacatctgagaattaaaagtatcaggaaaatgtccttcaaatctttagaagataaaaacagatgatatcccaaggaacaaaaatcaaggtggtatcagacttctctgtaccactaaatactagacaacagtagttaactatagtttgatgagtgtcatcaaagacactttcctatatataaggatttggaaaacaatatccatttactctctgttaaactaagaaatgtataaaaattaaaactcaagcatagtgaagttatgttattaaaaaattagataaagttgaagtcattattttggatgctaagagtatggttacaaaattgaaggttaaggtcaaaaattattactgaagaagagatgataaaaacaaaaatgtatgcctaaaacaccagatgtttataataaggattgggacatggaagagggagatatagaataggaaaaataagctagcttcttcatttttcataggtaaaggcaaacaatattgtttgtcttaactttaatacctttaaagcataggataaagaaagttttttttctgattttaaaggacatctcattagatgcattttagaaacttttctactaacaagtaaaacagttaaataaaatatagccataaagtttaaaaataaatggatgggagatgatttattatgcaaacacaaaaggaaagctgagcttgcaatattaattttggacaaaatagattcaaggcagtgattactaaacatgaaaaagaaagtgacttaataaaggatagaatccacagtaaagataaacattgtgctaatgaacatagaattaaaatatgtaaggcaaacattggtagaggcacaaggagaaatggactgacaacagtgtgggcattgtatatatatttgaaagagcaagggacaaaaattagagacaatatgaagatattaaaccaatagattaaaatgtagacagagaataaggatatttactaagtatccatgggaaattataacaatcattgattagaccacaaaaaaaattgtttaataaatttctaaatacaaaaattgtataatacatcttacctggccacaattggaaaactagaaaaaacaaattaaaaaataaaacctccaactatttgtgaattaaagcatatcttttattacatctgcaaacttgatattggtattctcatttttttcgtaaatcattgaattactgtaatattcattgccagttgcattcaataactggcaaataaattataatcattagatggcttaagaaaaaaattgtgaacaccaatgtcaaactttgcagatgcaaccaagggtagattcagagccaaatttgtagttttatattctttgcattttaaaaaggggaaaatagaccaggcgtggtggctcacgcctataatcccagcactttgggaggctaaggtgggtggatcacttgaggtcaggagtttgagaccagcctggccaacatggtgaaaccctgtctctactaaaaatacaaaaaatagctgggcgtggtggcaagtgcctgtagtcccagctaattgggaggccgagacaggagaattacttgaacctaggaggcagaggttacagtgagccaagacagcaccactgcactccagcctgggcaacagagtgagactccatctcaaaaaaaaaaaaagaggggggaaaatagctactaatttaattaagatgtttgaaaataaataaaacctttaaaaggctggagaatgcaaataatttgttaaaaagaagtaaacatgttaatgaaacagaaaaaaagtaaattaatagaccaattcctggcaaagatgatgagaatgctaattcagtttaagagggagaaaataaatcatcatctctgggggcctacaattcagaaagacagtccagggcaggcgggcagactctgctccacgaagtcatccagagattgaaactagcaggtgctctgccattgtataaggcatcctttttttttggtctgcatggcagaaattaaatctctgaaacatttgtgttccagacaataggaggagaaagaaaggagggagcattacaaacaagatcttaagaccaatgttctggaagtgacatgtgtctcttctgctcatattccatcagtaagaacctgatttttggtgagaacacaggggactgagaaatgtaatatagctgggatgccatgtgcctggctggtagaagaaaggaaaaacatatttttgtggtctacttagcagtgtctctcacacctgctacagtggacctttataaattatgtaaaagtagtgtatatatggataaaactaaatatttcagtgacatgaagtgttctgagaaaatgtaaatgaaccaaattgaagaaaagagaagtagaaaatatgaaaagataataattctttccaacattgcctttgtctaaggcagttttactgctttactgctgtgtcttttaactttcaataagtagataaataccatattatagaaacttcttcagagcattataaaaaacaatttgccatcaattccttttgaaaaggtagaataatcctgatgctcaagcttgaaaaatataatacatcaaaggacattctagacccatctcattgagaatagagatgtaaaactcctacataaaatattaccaaatataattcagtagcctattaaatgcatcatgcatgatgatcaagcatgacttatctcagaaatacaatgaagatttaagaaaactatcaatatgtgattacttatatcatgcttcccaaaagaaacactaaataatactactccaaaaatgaaaaggcaaaaagcatattttcttattcctgatttctttgaaaattgttttttatagtactaggcaaaggatgattttttagtatgataaataatatgtcctcaaccaatagccaaaatattttactgtgctttacactaaagttgccaacataagatacctactatcattattttaagtgtttctcataaagtacctacagatggcttatgtcttagttcattctgtgctgctataacagaatatccgagactgggtagtttataaagaacataaatttatttattatagttctggaggcaggaaagtccaagattaaggcaccagcatctgggtctggtgagggctttcttgcagcatcctcacatggcagagggaaagctacaaaaaactccttccatcaagcaagcccttttataaggacgtgtaataccattctcaagggaggaaccctcaagacctactcacctcctaaagggcccgcctcttaatactatcacactggcaacacctgaattttggaggggacacattcgtaccatagcatcttaaaaagagtacagatggctaaataaggaaaatctataatcccctgctcagcctcttcctactcacccttccctttaatcccctttccagtttctaataatcatagcactattttaatttctctattattatcttcatatacttaaaatacttttcatacacatgaaattatttttcctattttaccaaatatagactgtcttgattcttcactgtataattaggcaaacagttctctagcattcttagtaaataaattgttattcagtgtgtagaatcttgataaatgctaattgtgtttagtaataaattgcatcctaattttatttttaaacaaatttgtatttaatgcctgttgctttgaaactttcatacagagtatatacaactttttttccctaccagagaccaacagtgataataactaaatttaaaaataagaaggtttttaacttttatttcaagtttttatttaacaggacaaaaatataaaataggagtatatttctctgttcttgaaattcagaaaatatggaattagaataaaatatttttaaaaatcagtcacataatagcatttcagagaaatggggaaatgggaaatgatgaaataaataacataaacatattgactcatgctttcttagagggtagaatgatataagttcaaaaagttccagagaagatgaccacacaaactgaacaaaatgtaagtacatagaacatgaagaaagatatcatggtaactctataagttcattttaatatttccttgagaaaacaaataattgttccatactttaattgatttgagaacaccaaatttaaaatattggatttataaaaagtcagtaaaattatatttgtattttgggaaaatgaaaaagaaataaaaaagttgtcactctccaaaaaaaaaaaaaaaaacttgaaatttaggacagatggctaagtaaatgcttcaagagcagttagaaaatacattatctggcagtgcatgataaaagcatgcaaattgatctgttagaagaaacaaaacaacttttaatgataatattgttatatctgcactgaagtcttatatattcagtttagttggaggaaatactgtaaacccatattatttgtatgtttttctcttttaagagagagctataatgaaaactcaaccctaaatagtcgtggatatattatataataaaggattttctatgctactccaatgggaattcacataaattcagtgaaactaatgctttctagtagttcttaactgtaattaaactatttgctctccttttgtgatttttgtcacaacatcatagagtaataatacatgctttatggttcaggcccaacaacaactttctgtggatcatggataaatttgactcatgagttttggaagttagcttgagagaagtctcagaaatttcagcaacatatccgaagaaatgtggtacttctcccatctaaataaatttctaattccaaaaacttcttatttaccttacagtttcaaagcttgcattatttatttgctactgtatataaattagcaggttaggcagtttgagaaatatactcttttacaatgctgagagcaccatttagtgtacctctatagcgtttattatcagtatatgttaatgatcagcatagggtaccaaatggtaccctaagctgagtccgtgtaatacagtagagagggaataatcttttgccaataaattgcagcagagtgaatggataatttagctaaaaagtgtggtccacaaagtgaagtttgggctgaaatgctgtggactagtgctttatactgggtgtactggataattaccagcattcagcacacttcactttgtgtctttaggtcaaggctagaagttactatcacatcagataactcatgctggatacaatgaatcatctagctataaaaatctttattttcaagacacttctcttgttgtgcctaaagtatgaatattaagaaagaggaacttccacaaaattattgtgccactttgaaggaataggtacaaactgtaaaaatgtggtacatcttgaaatgtaggaagggaaatcagttagtagtcactgtaactggattcattcatttgtttgatttgttgattgcttgactatcctatttaaaattacaatccttgcctattttactgggaattctctattccccatccttttttcttcttagatcatggataaatatattttgtttgttttactcattgtctttcttccctcagtagaatgctggctttatgagggcaaagattttttttcctattacattaactactatattacaaaacttaaaaatcctttactatatgtaagaagagagaataaattcagtattcttattgaatttattaaataaatttaaagcataagatgaaaattcagaagccattttaaaggtttaacttgcttaaatcttcatcaaatgatttattttgttttgcttttacgtaatagcaagaaaaaaaacccaggaaacatatataattaagaactttgaagaaaaccctaccaacctagcatatgatatacctttaaacaatgtagcctgctaaaaaagaaaaaaaaaataagcaattagtcaaatatttaactgtgaattttacatgtttctttaccagcatccttacctgttgaattttagttcagctacaaatgaatacaaatgcctattcctttgaatagagaaaaaaacatattttatatacttcttaggcaactggaattgagggagaaattacatctctgaactacactaaaaagttttagtaattcagtaaattctgttttgtcactttgtacatatgctcagtgttacagtatacatttgaaagtacaggtgagtgtgatttccaaatttgtcttttttaatatgtctttttgttgttatacaattttctattctgcagttaattagaacaatagtgataggctatgtctagcttttcatactaagagcaacttctacatgacagtaatttcagccataaagatatagatcaaatctttcttcctagatctggatgtaatcgtatttatttaaactaaaagaggttgtgtttgatgatattttttcttcttactgtaacattgttgtattaaaattttacgcaagtttagttaaaatgaaaaaaagcaatttgcttctctttttttaaaacatgaatgttgctatataaagctcaatagagcaataactgacaaatggtaggtattccattaatgtgcgctaattgaaattgcatggtttttcttagaataatagatccatgtttcatcttaaaatctaagaaatactatttcttcttttatattcatatgccttatcagaaatttaaaattttgacattcataggtaagcaacatttcagataatcacgtttaaatctagacttcctcaggaaatactaaaatcattggccttaattattaacaactgtcagtactataaaataaacatatttagtttttttaaacaatttatatactgggaaatgtgtgctacaaacatactgagattttacatcttataatggaatattaatgcatgaatgaatacactgaaatataggtgaagatagcgcaacagatacactagatacaagagttgctttgatttctcatcatagcagaactgttcaattcaaactgatctatcttcagcatatttctgatcccttctcgactgtttttagtatttgtaatatgtctaatcaggttgagggatgaaatctatgattgtagaacagttgtatgtataactgccctatgtaagtattaaatctataatgttgattttattacaaagagtccaacccaaagtttttcatactcctattttatgaaataccaggattccatgaaataatttgcaagtgaagtagactttgaatttttcaattttttttttcataatttgtatgagactattctctccaaatctaatttatttctcctattcaatcccttatttacttttttgtcctcaccaccctatatactttggctaccagttacagtatatcagaaagtgaataatatgagtgttgccacctataggcaggaaatttaattatacttgtttatgacataaaagcataatcttaaaaaaaaagggagaattatttttgtcaactcctacaatccaccccaccatcttcaaactttttacctatttattcacctgtttgtttttgatgttgccatttcagatgcctgtgccttaaaataaagcatttactaaagcttttattattttgtcatagtactatttgcatttactatatcatcaaaatataccacattatttaagttctttgacttcacaaagtttaaagagatttgttaaaaccaactaatttaaccagtcatatactaaactgttgtatctcagtttacttctaggatggggaaaattaccagtatttgttcccaggcatgaaagagcatcccgtcctgcaatctattatcattagtctttggttttgtgccttctctgtaatgatataggtttgtttctcctttattctttgcagagtgctgcagcagctcccagtccagtgctaggaaacattcccccaggagatggcatgccagtaggtcctgtaccaccagggttctttcaggtactcagagaaactctgactaggaatgttaaagcataggaactcctgtttgattttattaaagatacgaaggaagataaggctattttaatttttaaggtaaataataatgtgtagccaactcttgattattcagatgggttatctattatatccctttcttcttatgttttatttgttattagattatgtatttatttacttagtcattttgttgctcaattaagaaagaaaaggaattgagaaatacaaattagcccattaaattaactgtggtaaatattttgtgggagaacagactaaatatgaggttctggaaagagatggatattaactatacaagcatagacaagatgattaagatttggctgtaatttcaaaatataactaaattataatttattaatttatcaagaattacaggctatatcaaaatatgtttgagaattatctttggggcttttaagctggaatttttattaatattatataacattttaagatcagatttcaaatacatgtgagtattcttaaatttcaacaagaccacttattttagcaatgatgataacaattttacaatgacaatacagtatttaactttttaaaatttcacagcatccacttcttaaatctgacagttttctaactcaaaccaacataaatttcgaaattcatttttaaattaattatagttaattttataataccgtttaagaaaattaagaacttaggagctaagaactagagtcgaaaggcattacaggacctaaggtaatatgctgtattgttaatgaattacattaggtacttataaactaatttgtcacttccattttgtattttcagagttcttcataatcatttgttagctaattcaaattcacaccatcattgcagggtcatcaatgtacttataaatgtgaaaataaagaaataaaattataaataattttccaaaccgtatcagttgaataaaaggtcttaattaaagcagagatccaactctagtcctttaggacatgcttatttgttcagctactctgtattaatacccaagtagtctagaaaagtcttcttagagtcacattctgtcgtgggggccctatcttataatctaggaatagactgtaactcttgattattaattaaaccaccagcatttaagatattgaaaataaaagcttacacttaacaactgctaactacatgccatgcttcattctaaatgctttacatatataaactctaatcctcacaatatccctagatgtaaaatatgtattattatcattcccactgtacagatagagaaaccaaggcattggtagctaagtgatttgcacaaagtcagaaagttacagggcttgaattcaaatcaaagtagtctggacttctgccactgaatttatcttttaagcctcgtagttgattgttattcatgaaatatttccagttcattttattttttcctcattcccttctttctcttaccaaagatgggtaggagttaacagagtaaatcagaaaaatatatatttgagagttactgaaagtctctaagaggcacttttaaaagagggagcagtttggggaggaagccagattctttcattctagggttaagccaagatgtataaatccatacatttttcatttccacattttgtagaatgaactgttctccgtttgcctatcttttatctcaaagtctcggtaagagtaattgaaaccgttagcttttagtttttccaatgtgataaatatttgagtactactatatgccaggcactgtagtaggcatctaaaaactagcaggtgtagtgtgtaccttcctgaagcttattgtatagcccgtgaggcattattaaaaataaataactataatacagtgaaatatgtgttgtaacagagtaaagtttaaagttctgtgatgacctggatgagagagccattaaatctgcctgagttggagataagagtagattggaaaacattgtccaccaaaataagcagaggaattacatttcagaaagtcagaatagtataaacaaaagcgtgactgcatcaaaatgatctgtgcagaggtgttcagagtaatacatacagaaggtagtggggagggtaggcaggagttccaagacataaaattgaaaagatatgctatagcatggcacatgttaagaacctgagtattcagtaggagccatcagagatctttaggaagggcaatgacctgaattcatactaaacggtggattcaggctctggtaggcacctgtgagagagttgtatacaaaatccctgccctcgagaagccctacaatgtgatgaatgagagaagaggccattacagcatagaaagaaaatggctgtagtgtgctcttagagcaaatcagaaggccaccaaaccgaatcttgggaggtgcatagttaggaaagtattgtcaaaatagtaaatgaaatccaatttcgcatttaaggatgagttatgacttaggcaaaggaagagaggggaagaaatttctaggaagagggaaaataatttacagagatccagagggaaaaggagagagagagagaccaagaaaaactggagcttaattagctaaagggagagtagctggtgatgaagcttgagagggactgcaggggccttgtaggttagtagagtttgaacttgatcctaaaggcagtactaaactactggaggattttaagcaggagacagacatgttcatatttgcatttttagaaaaatcactccagctccattgtgtagtcagaattgcagaggaacaagtctgaagatagggagagaatttaggagtcttttacagtactccaagtgaattttttttttttttgagatggagtttcgctgttgttgcccaggctgagtgcagtggcgtgatctcggctcaccgcaacctccgccttctgggttcaagcgagtctcctgccacagcctcctgagtagctgggattacaggcatgtgccaccacgcccggctaatttttgtatttttagtagagacagggtttccccctgttggtcagactggtcttgaactcctgacttcattatctgcccgccttggcctcccaaagtgctgggattacaagcgtgagccactgtgcccagcctactccaagtaaaatttaatggtggccttaactaagatagtgggatggtaagtatggggagataagaagtagatttgagagacagaaataaatgcaggatattgcaaaataagggaattcaaggataataattctagtttctggctctaatctgggcagatgtaggtaccattttctaagctagagaacacaaaatggggaataggtttgaggtgggacagatgaggttcccatgagtcctccaattagacatatctgttaagctgatagacctgtcctaggtttgaggtctaggacagtaatctaaactagagataaaaattgcagggccatatcattttaagggtacttgaatccacaggggtagatgaattgtccagggagaaagtacagaatgagagggtaagagaatatacaactgaactacaaaaaacactaatatttaaaagatgaacaaaagaagaacccattacagatgcagtgttagtaggttggctatgatagcagcttaaggaagagactttctgaactgattcaagatcagtggcagtagaattagaaaggaataaacagttcatagttatgtttgataggccttaattaaccaaagttaaggtagaagagaaagagaagaatcaaggatgattctgagatttctactttgggtctctggataagtttagtgtctttatctgagtaatgaaagacaggagattgaaaaactttcagatatatttgaatttgatacacaagtcatttctgtttatctaggcagactatttcaactaatcccaagtacttttttcctctattcaacatttaaatatgtctccctataaatgactctctaaaatattaaaaaactcaaagtaccaaaaatttaaaaaagacatattatattattatcttttggtacatataatgatgtgatcaaatgactcaagtgtgtcctaaatatcagcattggtttcctgcagttactgaactagtgtgattctggtcataatgtcaaaatacatatagttaatgaggagtagctgctttccatgggtagaaatagcagcagacaatcataattcaagttcacaccccagtttctaatctagttccaaagagatgttgaccttcaagaatgatccaaatctggagaacctgtgttggagtatcagttcacagttcataaactctaatacccaagatcaggcacaatcctgattattagttcagtacaaggcaaggaggaatggaagcaactggaaaagagctgatgtggctccttaaagtaacaaggcccagaaggctggctaggataaagactcagattctccaaaaagccagacttggatattagggaattcctggttcaaaagagacttagtcaaaagggtgctaaatagtttttccagcctctcctggttgcaactactaaattctgaagggtggttacctcctattgcctttgacttttagataatgataatattttaaacttatattcttagtaaatgcaaagcttattttgagatagcttgaatggactagaccgaaaaagaatttagcctattagaattagtgaataagtaaaagtaaagaagaataatttataattagcaaatgaagtccccgcctaagtatttctgagctctacttactttgtgatcatactctaaaaaatacattgaaacatttctcctaaatagacaaacatactcctttttttcctgtttatgttacagaacaagctccctcttccatgataagtatagacttaaattcattaccaagtggaatgatcacaaactgaacttgtgaatacataacaactacatttgaaaaatagcaatgaattaaagtctaaaataaataattatgatataacttggtacacttaataaatccattctggaaggcagtctttagtgtctttctatttgtgacattgttcatacttaaactttgatgtttttattgaaatgagagagcctctgttgctgagcaggaaaccaattaagtaaaatcagtaagactagtcggacatgcaaaaggaggtataaatttaataaaataaagccatttaaagtatgacatgtagttatttacttggagtctgttttcaaatgagtaatttgtataagaaaccctataagtcctcagagtgacactatggaactgatgaatgactttagagcagctttcttaaattgggaagtcttgctgcttgggatccagagggaagagagtagacatggccattgatctaactaaaagtttggcagtttttgtagaataaagtacagtatcttggtatggtgtgaatacacatccattgtaggtacccagaactgagttttactcttttatatctctgtcttattcaaagatttcattgtatgctaagaaatttgagttatgtattaaaagcatcgatatgctatttattcattcttgtggcattcatacaaaaggacaggcaaaggactttgattcctgcaatataaataggcagcagcattccttagaccaagtggattttcttctcacttatgtataatgatcaaaataatttactactaataaaatgcactaaataacacaaaagtactaattcttttgtttaaaaaattagattattaactctgttaccttgtaaagttctgtaattttatggatgagtaagtaacaaggaagcttctcttgtgaatttctataacttatagaacattaatgcaatggacgtttcttattttaaccaaaaaaatatcgagaagggtaaaaatgctttttcctactttatgttctttaccacaagaaagcttttaagaaggaaactataacttccttatcactctaataaccaaatacattcatatcctttatataaaaacacaacgtaatcttttaataggtgctaatgtggataatatctttgattctgtaactaatctgggatatacctgttaatatctaattttgaactctatatagacctttgttttcttttatcatgtattttgatttttatcttgatatatttactatattttagtcactagatctttagttttattagatgaaactgttgaaaactgataatatgttgatgttgggttgtaaatttaagactttgacgtggataagattataaatacatgttaatgaaaaaggataccaagtaatttagtttcagaccaaggtgatcattcatactttaaaatctaagtagaatgaaactctgatatagtagaaaatatgtgacagcaggttttaagtcacatttggtttgcaggcctaagattggtagtggtaaagctgccttgccatctagtggtagtttgcagatggctccacttgttcagggcctttttctagactttctatttttagcaaggctgcactgtagcaagctgacctaatgctttgacatagtaataacgcaataagaaaaaaaaatagtaagaaatttcctcttttctccatggtggtgttattgactaaggaaggctccatataaacaacattcataaagcaacaaggacaaaaagctcaaagtgtataatatttttgatattttaaaagaaaaaatcaaaaatgagaaaaataattatttaatatgacactcaaaactaaaaaagaaaaccaataatatatggttttataagtcctggttaaatgtttttgggagatagatgtttatttctggaaataaattctgcattttgaagataccttagtatctatattcatctactctgctattcctattcagacttcctaaatccagccgtttatatacatatagttaaataatctacatgccctctcaatttccttctgttattagtcttggcattaccttcacttccagtggtttgcctttcctcttatctttcttgactatggttgtttcagaaattagtctcagaaagtactctaagccaggagaaactccctttccctcttaggaagttataaataccatcttagatcttagataaatgaaccaaaagattacttgttatatccttcttagtttgaatgagtagggtactgaaactctgaagtagaattaatttattagactagaatatctaacagcattaatatatatagtttaaaaaaattcagacgttagaaatagtatttctcagaattaaatacacctaggatttagatagtggaggtgaggaagttggcttatttatcaaacctcaagaaataaaaattaagtttaattttcttaaaaatataattttgtatctttaaagaacacagattctaaatgttgaaaatagaacagatctttccctgttataaagataaaagcaactaaaaaaacaaaggtgcctaacagctgctggctttgataatgctgtcctgcagttgtggtaatagtttttctggcctcaactattagaacaaattaaaactgcccagcttgaataactaagtaagcttttttaaaaattgcaattcaggcaactaaagaccctacagcagtaactggatggacagagagcaaagaagggagtgtcaggtattcagagtctttacttgggttttccagttagaatcaaatgaaacactttcctattagaaatccaattttttgttgtttatttgttagccaaactgcgtatttaggagaaatttaggctggtcattctagaccagtatttggttttcctttcacttttcatgctactcctgcaagccaaagatgtccaacacatttagtatgaaacaataaagcatcatagtttaaaatcacatctgagataagagcttagctattgttcagatcatttgaaattatagtttttcttttgaaaatattattgaaaattcttccgagtgctgtagtttttattgacatttcttgataaaaaaaatttatatagagaggaaattgtaaatatgcaaaggctatttataacacaatttaatttagtttttattttagtgttggttacagaaacaaaaatgctccacattctttggggaattaaagataaggaacaggcatttaaatatactattaattacatatttagggggaatagatttgtcttaagcatatattagaaagactttagctttttaaaagaataacttattacaaggtagcgttcaggaacaatttgtcttatgttctatatcaggggtcaacaaaattttcctgtgaaaggccagatagaaaatattttaggctttgcaggtcacacggtctctcacagccactcaactgggttgtagcataaaagcaaccatagacattatgtaaattaaagagcatggctgtgtttcagtaaaacttcacttacaaaaaaaaacaggtgatgggcagcatttggcctgtgagccataatttgcctacttctgttctacatgaatgtgataaaaggtagcctatgagagatccaaagggtaaggaccagcgtttctctaagggggttctgtggaatactaatacgagagtcctgggagccacccaactcttaggggactagaattcttgggggtagggagtatggggctacaaatcctttagttttagttatggttttgttgtttgttttgtttttaacagataagtcttacaaactaaaatttgaggatcactagctaagattgtcaatgatatttagcaacaaatattgcccccctgccattcataccagagtcactacagtgaacaagataaatagaaattcttgtcttcatagaacttagtctactaagggaaactgagcaaaataaataactattttaaaatatgtgatatgttagttgtgataagggctagggagaaaaatgaaacagaaaagaaaactaggcagcattgcaaaagttttggatagggtggccagaaaagggctcatcaaaaagatgtatttgagtaaagacctgaaggaagagagggaacaaaccatgtaatatctgggggaaaagtgctctaggttaagggacaaacaagtgcaaaggcctccagttcaaagcatgactgtttagggacagtaagatagtctggctagataaagtagagcatcagctggggagaattgtgagataggaagtcatagataacagaaatccaagtcaagaagaaccttgtaggttattgtagggactttggattttcctctgagtggagggttttaacagcatcattctggctgcacatggagattagtctgttaaaagaaagtgtggaaacaaggagagcagtttgcatgtcattgcaaaattttgacaagagattattataccaccaaggaggtagcagtggtgagaagtaattagattatatattttgatactagagccaacagatttgttttttcttttattttagattcaggggtacatgtgctggtttgttatataagcaaactcgtgtcacgggggtttgttgtacagatttttgttacccaggttctaagcctgatacccaatatttatttttttctgatctttttcctcctcccaccttccaccctcaagtaggccccagtatctgttcttccctctttgggtccatgagttctcatcatttagctcccatttataagggagaatatgtgatatttgtttttctgtttctgcattagtttgctaaggataatggcctccagctccatccatgttcctgcaaaagacatgatctcattctttctttttaatggctgcatagtatttcatggtatatatgtaccacattttctttatccaatctgtcattaatgggcatttaggttaattccatgtttttgctattgtgaatagtactgctatgaacatgcaagtacatgtgtctttatggtagaatagtttatattcctttgggtatgtacccagtaacaggattgctagttgaatagtagttctgtttttagctctttgaggaattgccacagtgctttccacaatgattgcactaatttgcactcccaccaacagggtgtaagtgttcctttttctctgcaaccttgccagcatccattttttgttttgttttgttttgttttttgagatggagtctcgctctgtcacccaggctggagtgcagtggcgtgatctcagctcattgcaacctccccctcccgggttcaagctattctcctgcctcagcctcccgagtagctgggattacaggcatgcaccaccacacccggctaattttttgtatttttagtagagatggggtttcactgtgttggccaggttggtcttgatctcctgacctcatgatccacctgcctcagtctccaaaagtgctggaattacaggtatgagccaccacgcccagctgcatctgttgttttttgacatttttataatagccattctgactggtgtgagatggtatctcattgtggttttgacttgcatttctctaatgatcagtgatgagcttttttttcatatgcttgctggccacatgtatgtcttctgaaaagtgtctatgtcctttgcccactttttaatggggttgtttgtttttcattgtaatcttgtataagtgccttatattaatagatgctggtggatattagacctttgtcagatgcatagtttgcaaatattttctcccattctataggttgtctgtttactcttttgatagtttcttctgctgtgcagaagctcttacgtttaattagatgccatttgtcaattttgatccaacagattttgatgatagtttggatatgtgttggcaagataaaaagacaagtcaaggatgaatccaaggcttttgtcctgtgcagctggaagaatggagttgatgtttactgatgtgtataaaacttcaagaggaggtgtgagatggaattatcagcttaattgtgaacttgttaagattgagatggctgttagacatgcaagaggttttgagtagggaacaagatgtgagaggctggacttttatgtttgaggcttgagctagagagagaactctgagagtcactagcatatggattggaatatatttgaagctatgagcctggatgacatcaacaagatagtgagcatagatggaaacaagaagctgtgcaatgatggatcccaggacactctaacattaagaaattaggaaaatgaagaggaaccagccaaaaagagcagcccttgagacagaaagataaccaggcaaggaagtatgctggaagccaaatgaggaaaatgctttgaggaggagaagaatgatcagctgtgtccaatactgctgataggtcaaattagtcaatggctcacagttgaccattggatttaacaacaaggaagtcattagtggccttgttcaatgtggtcctgggggtgaaagcctcataaaagtggatctaggttaagctgagaggagagaaattggaggcaatgagtatggccaactcaaggagttttgatttaaaggaaagtgaaaaatgaggcagtaggtggagggagaagtcaagggaagacagagaaatgctgctaggagtgaaatgttggctcttacaaactattttgaggaacagagaaaaaacagccctattggcaactatgggaaaagagtatctgctattcccatcctcccaagcaatcgggtaccattttcagtacaagaaacaacaccagggggcagggcgcagtggctcacgtctgtaatcttagcactttgggaggccaaggcgggaggatcacgaggtcagatcgagaccatcctggctaacatggtgaaaccccgtctctactaaaaatacaaaaacaaaattagccgggcgtggtggtgggcgcctgtagtcccagctactcaggaggctgaggcgagagaatggcgtgaacccgagaggcggagcttgcagtgagcccagatcacgccactacactccagcctgggccacagagtgagactccatctcaaaaaaaaaaaaaaaaagaaaagaaagaaagaaaaggaaacaacaccagggaatagagtaactgaataccctttgtgcacagtaagatgcttatcaaaaaagagtaaagtataattaattacttggaatgcctgcaaatgtgaatactaccttctctatgtcatttttgtattctacaaatactctctgacatcacaaatacctttgacatccatttgaatttttatcagccattgtgtatatgtatttaagatgcatatatttcaaaatgtatgcatgtgtgtgggtgtatgtgcatgtgtgtgtgtgtgtatatatatatatatatatatatatatatatatatatatatatatatatatatatatttgagatggagtctccctctgtcacccaggctggagtacagtggtgcgatctcagctcaccacaacatctgcctcccgggttcaagcaattctcctgcctcagcctcccaagtagctagaattacaggtgcccaccacacccggctaatttttgtatttttactagagacggggtttcaccatgttggccaggctggtttcaaactcctgatctcaggtgatctccctgcctttgcctcccaaagtgctgggattacaggcatgagccaccgtgcctggcctcaagatgtatattttaaatggggattcagaaataactttaatttgtgcaatttgaattctcattttgcttatatttatacttttagcattagtcaaattagtaagctctagtttcaaaacagacttcttggtgcaataataatttctcagttctataaaatatgaaaatctgggctgggcacagtggctgacgcctgtaatcccagtactttgggaggccgaggcaggcagatcacaaggtcaagagatcaagaccatcctggccaacatggtgaaatcccgtctctactaaaaatacaaaaattagctgggcatggtggcacgcacctgtaatcccagctactcgggagactgaggcaggagaatcacttgaacccaggaagtggaggttgcagtgagccgagattgtgtcactgtactccagcctggcgacagagtgagactccgttccagcactttgagatgccacagcgggaggatcacaaggtcaggagttcgagaccagcttggtcaatatggtgaaactccgtctctactaaaaatacaaaaattagctgggcgtgatggtgggtgcctgtagtcccagctacttgggaggctgaggcaggagaatcgcttgaacccgggaggcggaggttgtagtgaggcgagatagcgccactgtactccagcctgggcaacaaagcaagacttcatctcaaaaaaaaaaagttatgttttatagaaacatcttacctagttcaataccatcttacatagttcagatatgagttgagtggctttaagtataaacttcatgtctataagtaaccaaatgaatatgcaagtattttttcattcctaaagaagtaaaaacatatataaccagccagttatatcagaagatcaagcccataggccagtttctttaacaaatgctgttatctctgcatgggaatttgaaaggactaccacttaatcagtagaaacttcccaagcatatcaagatatcagaaacttaagaacaaaacgctatgcttttttgcagtgttacatttaaataaattgaagtacctatcttccatacttcatctggagcaagtttacatgaaagtaggaatataaagtagagaaaagggagacaagaggaatatttttgcattctttaatgaaaagttcaggtgatttttaaaaattattgttttagcatctttttgattaagtcagcctaatattttatcctaaattataaatctcaaatctttattgtcttacccaaactgttatttttttaaatatgggttaatctgtcattgtcattttaatcagtagtaggaggcagcagaggagcacagtagctccagatacttgcctcacaccgaatttttctgaatataaatggatttaaacaaactatttaaaattgttatagaatattatgaaaacattcacagtttattagaccagcagacagcttagtctcccattcacaatcccactgtctgttgctacacacctttatccaatgagtacctggtaatgaagacttgaggaaaagtctcatcttcttgaaaaagctcataatatcagcggccaatattgatgcttagactaaattcatgtagaagaatcaacttgtttgtaactctgctctattgggttagccttgccaaaatagcatcaaggaaactggatctgtcattgctttacagttattttatgtgagttattttaattaagtgttgatgatagaatatctaagatgtatgggagataaactgcatacttatgcttatcagcagaatatgccagcataagtatgtcatcttgtgatctaaattagtttagtactagttggaattaaaatgtgttaatcaggaatgtcttatccactggggtgtcagtaatgtctgatggagatgttcatgaaaaacagaaaggaaactaaacaaattaagatatatgaattgtaaagtaactttgacaaaattcatttgatgtataatttatgcatcattacttttctacagaaaatgtatgaagtatctcatggaattataaaaataaaaatatgtgaacattcttaaagatggctgaaataaggatgtcacaatactctagtgatttttcaacgtaatattctcaatattatttatttaatacttattgatagcacatgacttcaagagcgttaacacatttaagtttaaaaaatgatttgcttgtaagtaaaatatagaatagcaacatacagaatagaaatctatatagagaaaattatatacgggaaagataattaaattaactaaaaaagggcacatcatgaataataagtactacttttttaaagaatgtttatgcttttggttaaatcttatagtaaatgtatttttattacttttgcagaactatgaataaataattttacagtcatttttatcattttataaaattatgttttagattctagaatagtttttatgtcatggaattttgtcttcaacagaattcaacactgtttcaaatagtgcaaagaaagtatcagaggaaagaataaatatgtctaaagtcatgtttacacaggtccaagtgagatagatttggtatatacgtagttaatataattactgaagataacccatatttttccaggctgtatttcactttgtaccttgtgtttttacctaaacgttgagtaaagaaaattactttttggcaaataaccattttcttacaggtttttaatctaaagatggttatgtgctaaagacaatatgatattaagaaagcagaatgttttatgtttttactcaaatgctgagccttttcttaatggaaagaaaatatttcaactaaaatatgttgtttctgagacctgaatattatagtttctaaaatatatttcaacctaaaacgttaggttcccagttataaacatggccttatataagacacacctgagaggcaaactgctatatagaattgttagcagttcttgtgactggtgtatgcttcagaaaaagatcagtaagttaccacacttttcttccaaaattgtatataaattaacctgatatccttttgtgccaaatcatgtttactaaatactgcaattctgtaaaactacctaagactcattattttcaaccctgtcacccagaaacagtaagagaaacctgaaagcaggagagaatgaaaggccttattagtcatctaaattataagttctcttgtatactgttagtatggatatttggggtccccagctctttgttttttacttactcttacttaggacctctggaagatataatttatcctatttaagcgagcaggatttcttcctctagacatactttataagcattttctcattagacaaccagatatgttataccaatagtctgatttactctttaccacatcaacggatactgcctatttttaacaagacaaataaattgtccaggtgagattttatacaagaggaccaagctttattatatcttttgcgggcttttagtcttccattagggttggtgatcacttggtcaatgggccagctactgaagcaaccaaatatttactgaacatttgcttcatacattctgtcttcgaatgtgctagctgctttcttccattcttcatgaaccacattataatgaacatctttgttataatgacgataattaataccgtacccatttaccaccattctctacccatcctctactattcccttaaaaacacaaataattggactaaagactacatatattgtcaaaactccaccaaaaatgttccagaaaagagagatagagcttttgaaatttattttatttcagttgttacatttctttttagtctggtgaatcaagagcacatgctaattggtgctttatgtgcaaattagcttgcctacctgaaataccactacattttcacctttcatgtttgagtggtaactaaagaactccacattaagtatttaataaatggttgcacagttgctgagggcctgagagaaagtgccacatcaaacaatttatttatgtaccatacgctttttgtgaccaactgaccataaaatgagcctggtacataagtgtgtgtatctgccgttattctaaaggtattcctatggcagggtgttacaaagaaaagaagactaaaatggcagttaagaaatttggtcttcggttttcttttacataaaatgaggaggatgtagtaaactttaaaaagttaaacttccttcttgaacatgtttctaaaaggcatattcaaataacattgcataagtaatattttattatatatgtataacacagaacttgcaaaacttcaagtgagcaattttgtgaagtaagaagtctttgttaagtaaatgatcacttgctaaattattttgtaagtttatattttcttaaacctggtaattatatatttcttacagtcatttaaaaagttctggccgggtgctgtggctcacacctgtaatcccagtactttgggaggcctaggcaggcggatcacctaaggtcaggagttcgagaccaacctggccaacatggtgaaaccttgtctctactaaaaatacaaaaattagccaggcgtggtggcacatgcctgtagtcccagctactcaggagactgaggcaggagaatcacttgaactcaggaggcggaggttgcagtgagccgagatcgcgccactgcacttcagcttgggcaacagagtgagactccgtctcaaaaaaaaaaagttttaaaacttctaggttttcaaatttggaagctactttcacatgaataattttatcctcaaaaaagtccaaagttactttaaattacataagtcctgtataattgtgcgttttagaactgtacctcagacttctaagttttctgacatgtaaactgtcctaaatgttaattcgttcattctaaggaaattattgttattcttttcttcatcattgattgttctaaattgtgctcataaaataaaagatagaatatagaaaatgcttagcaattgacattttagagggttttttttactttttaatgatttttaattttctttattattaatttatactgaaaaactaagatttaaagaacttttaaagccaagatgagatataatgagatacaagttgagatataatgagatataaggtaagatataatgagatataaggtgacttatatattgctacatcaattttaggtattctaagaaatgctggccttattttaagaattaattatcttgacattaagatagttgttgctctgatagtattttgtattctttcctctaaagtacagttccttcatatcggagtatgttataccacagtgtactaaatcctctatgataagtggtataaataaagtgctgatgaagtaggggaaatggagcctatagaaattctttaaagagaaagcagtgtttcaaaactggcccttggggaattaatttacttggcagagaaaagcgagtacagcgtaatcttcaggaacagagaatattctggtgttggggaatcatatttatatggaatttttagattctattgacaatgttagaaaatattaacaaaattaacatttgagcaatgtgtcatttaagatgtacagttttatcatatatgtcttcaaggcagttagggcttaaaatagtttgtatcaccagtaatttcaggtaaataatttataaaacagtttcattaaggggcctgggaccttcaaaaagaaaagacttcgactgagggatctacctttagctaatatgaagaaagagctggttccttctaattcttagggaattgagataaaaagctaagggcttatgaaagatcaaaataaggggaggggaaactactgcttttgtgctagcagaaaggacaagaaataaaggaaaatctctcttttaggaaactagaagtctaaaattccatgaataattcttgatataatagaaaaataattatttaaaacataatggcattcattctgaagtaaattatgattctaagtggtgtaattttttctccaaaagactacttggagaaaatgaggtgaacatttggtttgcgtttctattagagtatttttttttcattttgtcaccaaatatttattgattttcttggcttgtatatacttttatttcttctactttgggttattccatttattttagactgttttagtttgggctgctataataaaatgccatagatgaggaagtttaatcaacagaaatttattctttggagttctgaaggctgggaagtccaagatcaaggtgccagccaatttgactcctggagaggaccctcctcctggcttgcagatggccataatgctcacatggcagaaggaaagagatcatctctcttgtgcctctttttataggcgtactaatcccattcatgaaggctccaccctcatgacttaattacttctcaaaggtcccacctccaaataccatcacattggagattaggatttcaatatatgaattttatgcagacataaacattcagtccgtagcatacacagatcactagaacatgtagaaatgagaatttatacctataaatgtagtttccgtatgtcagagtactaactatgctacccagtttctcttataaagtaaataagcttaccttatgagtttttcctaattttgaaacttttttaaaagcatagccttgatcttcagtattcatagcactacatgttctatcaaatagggatgatgtaatatgacttttgaggaaagacaacagattgaaatattattttccctgggttttcattgatactcgccatttggtgaagagaacattctatttgtctcagattagtggactgatgtagaaaagaatttttatagaaattgtttctcctattaattacaagactgtgaaccttgaaaaatcctaatcagcgggtagtcatttttatcttccttgttcactgatatatctagccacttagaacagtgcctttgtgggtgtttaataaatatttgatgagcaggacatgatggttcatacctgtaattccagcactttgggaagtcaaggcaggataatcacttgagcccaggagtttgagaccagcctgggcagcagagcgagcacccatctctacaattttattttatttttttttttgagatggagtctcaccctgccacccaggctggaatgcaatggcatggtcttggctcactgcaaccccggcctcccaggttcaagcaattctcctgcctcagcctcccaagtagctgggactacaggcacatgccaccacatctggctaattttttgtattttttactagagatagggtttcactatgttggccaggatggccttgaactgctgacgtcatgatccgcccaccttggcctcccaaagtgttgggattacaggtgtgagtcaccacgtccggcctgcaatttttttttttaatacccaggtgtggtgttgtgtaccacacctgtagtcccagctactcaggaggctgaggtggaaggattacttgagcctgggaggttgaggctgcagggagccatgatcatggcactgcactccagcctggacaatggagcaagaccctgttaatctatctatctatctatctatctatctatctatctatctatctatctatctgttttgttcattcaaatatatatatgtttttgatatatatatgtttttgaatatatatatatgtttttgaatgaacaaatttctaccatactttctcattgttaagtgtagcttttttattctcctaattgacctttaatctgacacaacaaagaggactgttgtgttgtgggatatttaatctttaggtttttctttttctctatgaagcatggtaataattttctttagctccttgatgaaaatggtttgtgccttaggaacatatgcctttatccccactccctgcctcacccacacacacttcaaatatttatagctatctacattatactaatctttatatttaaatgtaatactaaaaataattaacacagaatcattggttccttattttaaaagggactttagaagtcacctggtttaactctctcattttaaggttgagaaaactaaagccctgaaagatgattagctcagggacactgctaattaatagaggtacagaaactaaaacccaggtctttgactcccagtcaaatgttatttccacacacattacaaataatcctttctggggaaggcttttttccagttaaaacactgattcaccatcatgataccttcaaacaagtatttgttactcaaacttaaaaaaaaaaaagaatgttgccccaaacataaagagtaaacacattttaagagccaaacactcttttctgcctgtttttttgtttcgttttgttttgagaaagagtcttgctctgtcacccaggctgaagtgcagtggcgtgatctccgttcactgcaacctccgcctcctgggttcaagcgattctcctccctcagcctcccaagtagctgggattacaggcgtgtgccaccaagcccagctaattttttgtatttttagtagagatggggtttcgtcatgttgcccaggctggtctcaaactcctggcctcaagtggtctgcccacctcggcctcccaaagtgctgggattacaggcatgagccacctcgcccagcccaaagactcttgaagaacctattcttctcagattgctaaagcagggaatactgacatgtctgtcaatagatataatttatattagcataatctcttggacagattagcattttaccataaaataattaaaattggggttaacattttgaatttcatttgaaagcaaattgacttctgaatagtgaagtacagatactagtgcagattattctcagttgctagtatgcaaacgcttttagattctgttgctgtgtctacgcaagctaattcactaggcagttgaggacttaggtggttatctagataacataagggaaggatcaatctgaatactaagccatgttataacagcactaattttgtgttaaaaatactttaaccatagtaatcttatatttcaggtaaaagtagtagtttttagctatattaaccgattgttttgtctttttgtgctttaattgtgtgaagattagagtttataagtggttttctatttctttttttttggcctccaaaaaaacatacaaatttgaacttaaaggaggacatataagagtaataaattgactaaaaacagaatctgtctctttctcttgatctcattttgtagtaacctgcaggttcccagctagcacatacactgaccctccctcacagcagctccttcacagggcctcagtcaggtaggagggtatagacagttccattaacatacactcattcacaatgccatccatttggggaaaaaaaattctccttttacatataccactaaataaacactgtatcatcttcttacattcagatcaacacgcagatctcaagtgttcttctgtttcaagtgaggcacttctaaatatttatctcaacatttggtatttagtaatatttttcacataattttaccttgtattctacttcaaagtggttgtattacagacaaaaattattagtaacctatttttatgtctccatgtttcaaaaactaaattgatactatattttgaattaatgactatgtcataaaacatcattttgtaaaagacagccattataaaaccaatgacacaatatttattaaattttttaaattagtccagaattaaaaagacagcttcataggtgaaattaggtgatttataaaggaaagagaaaataacagagagagtgtgaatattagaataagcttctagttgacagtacataactaacttatccaatttatggtagagtttcaaaatgataaatgagagacaactttaatcaaatatgtgaaaactaaacgtttttaaaatcaactttgttaaaattggaaaatctacttaagttttatcagctggaggtgacaatactacctgactaatctactgtttctgtccatataaaatgaactgctggaagcacttttacatataagaacacagtgaacaaaaagccaaattgctcacttaattgtgaagctccttttgttggtttgtcagactctgcaaaagatactacaggaaaaatctatacagcattaattaggattttattttttagaggctccttttaaaacagctctggaaaacctgagtagccatgtcctccaagcctaatttctaaaaatatttgtagaaaatacattctacatgtaggatttaattctgtaatgcactgtcaatgatttccccaaacctttgtctacttgctgtatattacttcttaattcatattaattaattcttaatatcttaataacattcaacccgttagatttgatatttgcttatattacatgtaagaaacatcttacgtttaagtaattatatgttgagatgtaattaaacaaaattataatttttctgttgtttctagaaaaataaataaaaaatcaaattttaaataatttaataaacttataaaattttggtgcctaagtctggatgatcaaaaatagtctctttttaccttacctaaacatttcactaaaatgttgcttttaggatacttttcagacaatttccagactgacagattcagtacatcttaggagcctctgactcatccagcaacataaattaacttgacttttaatataagatcatttttttcttttgttaaaaatatacgcttcataatcagctagggtcaaaatatgcaaagaaatttcaactttaaaatttgtagtcaatttttttttttttttttaagaaatgaaatgttactgtgttgcccagcctggagtgcagtggctgtttacaggcatggtcatgatgcaccacagcctctaactgttgagctcaagcagtcctttggcctcagcctcccgagtaggtgggactataggtgtgtgccgccacacccacagagtccgttttgaactataagaaacccatgatgaggaaaagccagagcttttttgactacagatgacccttggaaaagaaatttatttatcattttaaacaaagctataaaagatgaaatttggcaattttaaaattattaaaggaattgataaccaaaccaaacaattccatcaaaagtatctatttagaatgtaataacataggcagtaagctgcctccagaggtcctttttaagattaaattgcctgcttctctaccttattttttgccactagatattattgccttaataattcacatttttaaaagattttgctatagttactttagccagcttttatgtttttacattttctttggaaaattttctagatattctacaaaataagtaatgggatggtaatttttcttaaaagcatttattatgctgaaagcagcctcaaagtacattgatttgtgatttgattaattctaaaattttttaagtagtttattttcagatatgtattttacattgtactgttttttgttttgtttgtttatttgttttacttcaatagccttttatgtcacctcggtaccctggaggtccaaggcccccattgaggatacctaatcaggtaagatttatgtgctatgtaagttttttgtaagaatcaaagatcttgaaaatgtcacatatatttatcatcctgtaaaaatatgaaattctcctttttctgtcccatttaatgctatttctagtctgcttcaagggttggcaaactacagctcataagctagctattttttataaataaagttttattgaaaaacatccacacagatctatttctgtattgtctgtgactacttttacactacaatacagatttaagtggtcatggcagagaccatatgtggccggcaaccctaaaatatttactatttggatctttacagaaaaaagtttgcccattcttggagtctaccttatacttcgaacctaatttaaaaacttgtgtaattttggtaaatgctgattatcctcccgtttaaagaacggcaataaagacaaaaaacctaacaccacatgttctcactcataggtgaaaattgaacagtgagaacacatggacacaggaaggggaacatcacacactggggactgttgtggggtggggggaggggggagggatagcattaggagatatacctaatgctaaatgatgagttaatgggtgcagcacaccagcatggcacatgtatacatatgtaacaaacctgcacgttgtgcacatgtaccctaaaacttaaagtataatataaaaaaaatagcaaaggacctgaattggtgttttccaaagaagatataaaaatggccaacaggtatagtgtatgaaaaggtgctcaatatcactaatcataaggaaatgcaaatcaaaatcacaatgagatatcaccacacagctgtaaggatggctattatcaaaaagacaagagataacaagtgttaccaagtatgtaaagaaaagggaacttttgtacactgttgcagggaaagtaacttggtacagccattatggaaaacagtatggagattcttcaaaaaattaaaaattgaactaccatacgatacagcaatcccatttcaaggtatatattcaaaggaaatgaaatcagtatcttgaaggaatatctgcattcccatgttcattacagcattactcaaaatagccaaaatatggaataaacctaactttatcggtgaatgaatggatataaaaaatgtggtgtgtgtgtgtatatatataatatatgatattttatttatatatatatatatatatatatatatatatatatatatatatatatattatttggccataaacaagaaggaaatactgccatttgcaacaacatggatgaacctagaagacattagcagtgaaataagtcagacacagaaagaaaaatattgcatgatctcacttatatgtaaactcttaaaaggtcaaactcatagaagctgaatagagcagtggttgccagaggctagaaagtcagggaaataggaaggtgttgatcaaagggcataaatttttggttttaagatgaacaagttctgggaatctagaataaagcatgagtggtaatggatgtgttataatttgattgtgataatcattacataatgtataggtatgtcaaatcatcacattatacaacttaaatatatagaatctttgttaatgaaatattttttaaaaaataaagtttaataatattaaaaaaagaatagcaataaaattttccatgaacatacttttgtttactttcatattatatggtttcaatatcatggctctagcattcatacaaattttatccaattataatggcaggttaggcaaataattagctgcttctagaagagatagatctgttaataaatatttaccaataaaatcttccaacattttaatctacaagagctctaaaatttcatgttttgttctcaaatagctttttattaatatcataagtatttatttgctgaagagaataaaatacaatttttactcacaaagagtttgtagtttagttttaggatacaggcactgtatgtatataacccgagaagaaattaaatgcttaacactatggaatacttgtgtcaagataattgtcttgtcactttctctaattctgttgtttgtatacctagctttatcccatatttaaggtaaaccatgttattacaataagttctctttttcattcatactgtcttttcatttccactttcttccttaccagaaatggaacaagaaagttaaaattactaatttacttgacggcagcagaattctgcttctcctctcctaactcttactgaaattatgctatctttgaggtgtctcaatctgctggtgctctctgcttctagtgcacagcagaaagtgccagcactcagattcacccccaggggagaactttgagtaggaagcagtgctgggtcatctcatgataacagtgcttggcagtctttctcacattagcagctggagcatttttctcctatagaccaaatctgaattcagtacatcggggcaggggaagatggcataaaataggaaagagaagtgcacagatgccaagggttacaacatacgggaattttattttctctgtgggtaaacctgtatatattgacagtcagatctacttatataggtgcctgagtcttttaaatttctttttaaagaaatgtgcatctcttattggaggcaggcttcatggttttttagacattccgtccatagctttgtatattatataagtctaggaagcgcctaaatatctgaattagggaaatgtgaaattctagtataagtgtgttattagaatttttgacctcatatattgtgtatcaatgttgaaaatgtgataaaattattggaattgtattcaagtgacattattgaatgcctgccatgtataagatactatcctaggttccatatcctaggttccgtagagactaacaaaatgaacactttgaagacaaggttggtggtgggaatgtaaaattgtaaacctagtttgttgacaaattttacgaacaggtatttaatgtctttgaattttcaaaagagacaattaaaaagttaaagataataaaaagtttttatataggctctctttcctcaagaatcataaatagtctttacctaaatgtattttaaaacaattgtactcttctctcagggattctttttgtccattcccaccaccactccagtgcacacacatacatacacatttagttaagcttcattaattcaaacagctatcatccaaacttataataatttacatttctactattttttaaaaaagagttgtgttaataatataaataatattgttttaggaaatgtttaacctagttaggagcatgaacttttcaagcataaacacggtttctcaattttgttatgtagtcattaaagtagaatgggcaaaactatttttggtgattaattggaattatgtagataaaaacacaaatgtgtccaggcatggtagctcacatctgtaatcccagcacttcaggaggctgaagcaggagaatcgcctgagcccaggagtttgagatcagcctgggcaacataggaagacctggtctctaaaaaataaacaaataataaaattttaaaatccactaatgtgtttatttttaaatttagttttcatattaattggtcataaactaatgacgttatgttttattaagagtttgtatctaaggaaatagaaatagtaacctcttcagtagtgttgactaatcattttgaatatgtaaaagacatctctttaataaacagattttactcaatttgtaattactaatgattagactacagatttaaatttgagttcccctgaaaccatttttatggttctggattaaatccataagggtgtatattctttgtatatgtatagcactgggtattggaatatgatataatgtcactatgttgtaaaaatataggaaggggtaataatgtctaaaatgatgaaaggaaaataaaattacaaaactgtgcaatatagcagaggataaatatatatgacgaaacatgaaacatagaagttaaatctacaaaatatatttgactatacaattttacactggaattggttcaactctcagaagggatctttggtattgaagcatctgtaacctggaaccgagcaagtctttatccttcccatggataaaatatgcaatcagaaaaattcacagtattcattcaacactatcttgaggaaatcaagacagcccgaaatacagataatgttaatgatatgagtgacaccaaaaataatttaactatagatctgttgatcctatagaattcagaaactttatcctctgtttcttcagattcctgaaacactgtcaacagatatatggaatgaaaaacattgttaattctgttgcccattttgtactctaaagttgaatttggtattctacaaacacactacatctgaccattctactgaaatcttcagatatttgtgcaataatagatgagtggttaagtaaattatggtatattgaaatgatgaaatagtatgtacatattaaaaatcatgttatagaattaaatttattgagatgataaaatgtatctgtttaatatgttagtgattaatgattaaaagcataaagtagcctctttggctggtttagaatacccctttctattattgggagctcattattttttatttttatgataattacactaagatttaaattattatttcaaatccaacatggcaagattaaaatatagtattttcttatgactttgaattttgagtttatcctgagatatatatctttttctaattttgttctacctttatagggaaaattaacaaacaaatttatttttatccttctcaaaccaagaaaattttgcatagtgaattctattcagtcttacctaatttaagttatagttttatgaaggtttttgatacaattaagttatagttttatggaggttttatgatacaatgttcacttcttttgccaaaacatacctcattatcttatagtcattttgtcatagatataccatttttggataagtcaatacatagaatacgttgccatatatttggatagaaacttcacagggctatccaaaatcactctcagaaatattgaatcattcaagagatacttgttgaggtttactgtgtcccaggtaccatcctagatgtgggggatacattggtggacaaactaatgaaaatctctcttgtggagctgacattctaatgcagcactgcccaatagaactttctgggatgatggaaatattttatacctgcatttatcatatgcagtagttttagtacttgagcacttgagataggactagtgtgagtgaagaactaaatttttaattaaattaattttaattaaatttaaattgctgcatgtggtaaagagcttttaatttgaacagcacagttgcagttgttgaaatatagaaaaaagaaaagtataaatgtgtgtgtgtgtgtgtgtgtatatatatatgtcaaatggtgagttgtgctatagggacaaacatcttcctacacttaatttaatatcttctgtgttgatattgtcgttttagaggaataaaatgacagtggtgttgaaagcacctaaatgcgtctggcatcttaggtccaaaagccagcaatgtataactttgagcaagtcgcttagactttctgggttttggttttcttacctgtaaaataggagtggatgtgggtatttctaaaggctcttctagttctgatatttaattatatcattatgggcccataaaaaatttggttcatcaaaattgttactgaattaaatcttaaagctttgagaaattcaccattttttcagcatcaatgagcatttagtctccatgagtgaactatataatggtagtcaaggaaatacacaggcatacctcattttactatgcttcacagatatgttttttacaaattaaagttttatggcaaccctgcattgagcaagtcagtaagtgccatttagccaacagcatgtgctcactttgtgtctctgtgtcacgttttggtaactctcatattaaaattttttcattatatctcttacagtgatcactgattttgatgtgactattgtaattgttttgggttgccacaaaccgtgcccatacaagacagtgaacttaattcataattctgtatgttctgactgctccaccgaccagccactccctgatcactattcctctccttgacttccctattccctgagacacaacagtattgaaattgggccaactgataaccctaaaatggcctctaagtgttcaagtgaaaagaagagtcgcacatcgctcactttaaatcagaagctaaaaatgattacatttagtgaggaaggcatgtcaaaagccaagataagccaaaagctaggcctcttgtgccaaacagcaatgttaggaatgcaaaggaaaagttcttgaaagaattaaaagtgctactccagtgaacacagaaatgataagaaagcaaaacagccttattgctgatagaaggaagtttttatggtctggacagaagatcagaccagccacaatattcccttaagccaaagcctaatccagagtgaggcctttagtctcttcagttctgtgaagactgagagagctgaggaagttgcagaagaaaagcctgagggcggcgggcagagatttgttcatgaagtttaggaaagaagctgtctccagaacacatacactcaaggtgaagccgcaagtcctgatgattctactgcagaaagtaacccagaaaatctagctaagataattgatgaagatgactacactaaactgttggaagaagatgccacctagaactttcatagccatagtcagtcaatgccttcctttagagctttaaagggcaggctgattctcttattagggggtaatacaactggtgaccttaagttgaagccagtgctcatgtaccattctgaaaaatccttggtcccttaaaacttattaaatctggccaggtacgtggctcacatctgtaatcccagcactctgggaggctgaggcacatggataacttgagatcaagagttcaagaccagcctggccaacatggtgaaaccccatctctaccaaaagatacagaaaattagctgggcttggtggcacacatctgtagtcccagctactcaggaggctgaggtgagagaattgcttgaactcaggaggcagaggttgcagtcagccaagattgcaccactgcaccccagcctgggcaacagagggagaccctgtctcaaaaaaaaaattttatactaaatctactctgcctgtcttttataaatggaacaacaaagcctggatgacagtgcatcttttttacagcatgatttactgactattttaagcccagtgtggagacctactactcagagaaaaagattcctttattttttactactccttggtaacacatcttatacccaagagctctgatgcagttgtccaagattaatgttgttttcattagtcttggacaactgcatcagagttcttgggtataaggtaacacaacatccattctgtatcccatgaatcaaggagtaattttactttcagtttgtttttttttttttttagatgtagtttcactcttgtcacccaggctggagagcagtggcgcaatctcggctcactgcaacctccacctcccaggttcaagcgattctcctgctcagcctcctgagtagctgggattacaagtgcccaccatcacacccagctaattttttatttttagtagagatggggtttcaccatgttggccaggctggtctcgaactcctgacctcaggtgatccacccccctcggcctcccaaagtgttgagattacaggcgtgagccactgcacccgtccagttcttactatttaagaaatatattccataaagctgtagctgccatctgtagtgatttctctgatgaatctggggaagtacattgaaaaccttctggaaataattcaccattctaaatgccattaagtccatttgtgattcatggaaagaggtcaaaatatcaacattaatgggagtttggaagaagctgattcagacccttgtggatgactctgagaggttcaagacctgagtgaaggaagtcactacagatgtcgtgaaaatagagggagaactagaattagaagtgaagcctgaagatgtgactgaattgccacactctcataataaaactttgacagataaggagttacttctcatggatgagcaacaaaaatggtttcttgatatgaaatctactctttcctggtaaggatgctatgaacactgctgaaatgacaacaaaggatttagaattttacacaaacttagtttataaaacagcttcaaggtttgagagcattgcctccaattttgaaagaagttctactgtggtatcaaacagcatcacatgctacagagaaatcatttgtgaaaggaagagtccatcgatgcaataaacattgttatctattttaagaaattgccacagctggctgggcacagtggctcacacctgtaatcccaacactttgggaggccaaggcgggtggatttcttgagcccaggagtttgagaccagcctgggcaatatgataaaaccttgtctttaaaagaaattgccatagccatcccagccttcagcaaacaccaccctgatcagtcagcaaccatcaagacttctacaagccaaaagattacagctaactgaagcctcagatgattattagcattttttaccaacaaaatatttttaaattcaggtatatacattgtgtttttagacataatgctattgcacacctaatagactacggtatggtgtaaacaaaacatatattcacgggaaaccaaaaaattcatatgactcacttaatgtgatattcacttttattgcatggtcttgagctaaaccagcaatatctctgaggtgtgcctgtacatcagttcataagtgcatagcgagtcttgccattgaagttatgatgcattctttgtgaactaaataattcttttatgaagcaggcagttcccccatttaattatttgttttaataaatttttatactatttcatttattttaaatccctaggatttaaggcacatctttcagaacttttggaatatgttaatccaatcttgagccctgacactgctacttgtgaatagtataactatggaagacagaaaatggtgaaattagtgaaaattagtgaatacctggggctggtgaagggtgctggtcatggggaatgggaaatgactgtaggtgggcaatgttctaacattagaaaatgggcaaattttgtggtacttaaatcatgcatcaataaaacctttttaaaaatagcataaccatggacaaattaacaaattagttacatattaaacctcagttttttatcattaaaaaggatgaataataataactttataagattgtttaaacattgaaagaaatactaaggacttagcacaattcctggcgcaaatgcactggctcacaagtgtgtgttaccatggatattttgtttgtttttattaagtaccctcctcattagtgttatttttttctgccagtgtgtagatcttttgtaaaacaaagcggccgggcacagtggctcacacctataatccgagcagtttgggggagctgaggtgggtggatcacttgaggtcaggagttcaagaccagcctggtccaaaatggtgaaaccctatctctactaaaaatacacaaattagccaggcgaggtagtggacgcctgtgatcccagctactaaggaggctgaggcaggagaatcacttgaacctggaaggtgtaggttgcagtaagtgaagatcacaccactgcactccagcctgggtgacagagcgagacaccgtctcaaaaaaaacaaaaaaaagaacaatgcatgccaaaatttgtgactagttaaatgaatccgggtggaatacctttaacatgttataaatatagaaataatatgtcacagatgtatacatttttctgatattaaaggtttaaagaatgcagtgattacatcactgttgatgcgcaaagctactatctggtcatcccaaggctgataaaaatgttttaaaagttagagacttgacttattctaaaagacaaacagtgatgagtaaaaagttaaatttagataaaaacactcattttgaaaaccaatttgatgttggttaagacttctgtaagattatgccatatttttaagtgatgaacagaaacaagaaaggcttgtcagttgttctgatattcaaagatatactagaaacagtaaagttttgaagaaaatggttgccaccagtgataaaacatcattgtctataatgagacagaagttaagtgtcaaagttcagagtgtataactctaaccatttggagacttaaaaaaagcaagaatctggccaggcatggtggtttacacctataatcccagcgctttgggaagccaaggcaggaggatcacttgaggctaggagttcaagacctgcctgagcaacatagtgataccctatctgtataaaaaaataaaaataggccgggtgtggtggctcacgcctgtaatcccaacactttgggaggctgagacgggccgatgatgaggtcaggagttcaagaccagcctggccaacatggtgaaaccccgactactaaaaatacaaaaattagctgggcacggtggtgggtgcccataatcccagctacttgggaggctgagggaggagaatctcttgaatctggcaggtggaagttgcagtgaggtgagattgcaccactgcactccagcctgggtgatagagtaagactctgtatcagaaaaaaaataaataaataaaaataaaaaattaggcaggtgtgggggcatgcatctgtagccccagctgctcgggaggctgcagcagaggatagcttgagtccaggaatttgtggctgcagtgatctatgatcacaccactgcactgcagcctgggcagctgagggagaccttttctctaaaaaataaaaaaaagttaatttttttagaaagtaagaactttaagttcacaattgaatataatatcaattagtcatacatttttagtcctcctcctacatcatttatttataacttttgacagtgttggctactttttccttcttgaaactctcctcgggcattctgagatgttggtcttagtctccttcctaatttcatgcctattcagtttcagtttctttttttatttcttggtatttttaaagaattaaatcttttatcttcttacttctcattctttgaactctgtttcattcttatgactttatcactaatgattcctaaaattgtcagtctaaaccctattccttttattccctcaatacacatttattattctgtgacagtaggcacagatagggtccctacttttgcggagtttacagtctggagatacagagaagaaaacaagtcatggtagtatttaagttctctgaaagtgaggtatatgatcctataaaaacacatgaaaagcccttaccttctctgcattgccaggacatggcgggtgtggggggtggggcggggggtagccatgcagagatggcaagatgaagtggccagtgtggttgggagactggttatattgaacaaataaatacactgattgaataaatacataattgtattgaggagtaataagtaactaacataggccgggtttcccactgttgaagaggaaaatacttacaaacctagaaaggaagaacactaaaaataatcctgaagtatcagattggaattggagttgttgaattgatgttggagagtatgcatttatggtaggtgtatatgctatacacacacaaatagacatagaattagtcacagatccatgcgtgtgcatatatgcatgtacatatacacctgcatagatttcaagcttggtgtttactgagagagcctaaaaatgatgcacccaagtaacaagaacatcctgagaagcaagatctttatgcctaaatgctgtcctccactaaaaggaattaaggccccttggggaaagagctgattccaagcctaggtcagaagaagtatgaggtgagcctggaacatcttatgccataaattaaggaaatgctcaaaaatggatgtgggtatgttacacacacacaacacacatacacacacacacacatacacacacacacctgaaggcttctcactagccaaatctgagataatttgactattgaaataaatgatgatagtaatagattacaacccattgaacaatatagaaatctatgactgagtaaataggtgaataaataagaaaagcttttccttatagtgaaataccaactaataaatataaaaagaatgatggacatggaatgtctctatttgacagttatcatagtggttagttgttagtggaggctacagctgatgggttgataaaggattgttgaggaatggaatattgacaatctcagaatagctcttatactaaaagtaatcaattactgtgtagaaacctgcagacaccagcacattcagatgataaaggttaccatcaccagtagtgggatagatcaacataatttgccctctaatgtgatacactgagaaaggcatagcatcatttctctggtattcctgctaagaaaatataactagatcataaagaaacatcagacaccatgctgtagaatttaagacctgttctctttaaaattgttgaggacatgataggtagggatagaatagacatagataggaacaataggaaatgattcctgcttagaagaacatgaagagacaggacaactaaatgtaacatgtcttccatgatgttctggtaccagaaagaaaaaagaaacattattgagacaaatggcaaaattaattgagatcttggacttggatggtagtgttgctgtcaatgttgatttcctgacttgaaaggctgtatggtggttatgtaggaaatattcttattgggggaattatactttgcagtatttaggggtaatgaggtatcatgtcttcagcttgctattaagtagttctgaaaaagatttatgataatagatatatatttatagagagaaagaaaaggagaaaggctgataaggcaaatgcagtaaaaaatattaacagttggcaatccgagtcaaggtatttggaaattctttgtgcagtttctggaagtttgaaattatacatgtgaaattatacatgcatgcacacacacacaatctgggataattcctctgtgtgtatgtgtatacacacacaattattcaatcagcatatttatttgttcaatataacttgcatatgtatacatacacacacacaaatggaaggagggcttatcccagattgaggctacagggaataattttgttaggaagtgatccctaaactgagatctaaatgatgtcagcaataactacttaagggtctgtaagcttcgtgagaggagagattttttttcagtttagtttttattttgtcttgtttttagtggttggcatttaaacattgttgattgaatgcatgaataggaaaaaaaactgaaagaagtttgatatggctggaagttagaacatgagcatgaaagtggcaagaaattaggctggagaggtaatctgggaacagataatgtagtaggatctcaagaaatatgtatttggtgtgcttataagcaaaaattttgaaaaactacaaaaatgacttgggaaatggaagctacctacttcatcccaagtgataacaatttaggaaacagttctgatctggccatgtaaattatttaatgttaaatttcttttgaaatagttgcatatgttaactaattagatataactttcatgctttaagttaaattagtgaatttttttggaaattctcaccagttgtcaggattttatgtatatgtgtatgcttatatacttaagatcagtaggtttaaatcatttataccttaatccagctttaagtactgctgagacaactgttagaaacttatggttcagtatatatcccaggaaacaaaccctgttacgttcatatctacctttgtcagttctactttcccttttccgtacacgcaaattgcttaatttatttttattttaagtgttatttcgctaaataatttcttagggaaactgtgactacaaaacaattttcattcgtccctttccattttcatcctgctgctatgtaatctcaaatgagtaagatattctgtagaaatagggaatttacatgtaagaagcaaaattagttatttcagtactcttagtaaattaatttttggaaaaggcataatacttctcaggaagaaataggacagtttttgcgtagatctttgctccctgaaaatacttattttatttgtcacaaaattgggcaaagtagaatctttttagaactaagaacttatttaaggtatataaacctgcaaaacttataaatgaatgtgaaatataagaaatcttgagaaatactcaaatgcattcttgtaattatcatacaagcatttaaaaggaaattgttaaaaaacttattttataaatatttacaatattgctctttatttttcttaataaattgctaggcacttggaggtgtcccaggaagtcagccattactccccagtggaatggatccaactcgacaacaaggtgactactctaaagtaaaaggaaaattgatgtgcagaaccatagaggaaatcttttatctcttaaggaaaattgtatttgtataagtaaatctcctatagttataccagttgcatttttctaagtaacatagccaaatgatttatatttccagctcacttaattatgcatgatagtgagggtagtgataacataagaaaaagaatacatgaggatccaaaaatccatattttaattaataattctaaaaccttttatataacatctaacaagtaggaagctaagtgataatatcacttattatttcttttgcctttttcagatagaggccttagcccatctgaaagatgagcagagggaaagaaggtgctaagcagcaaggggcctgattagtttaacaatctcaataaccaaatccctccagagatacttaggaaccacagatatgtaatgctctattgtactgttccatgggaagaggagcaaatgctgttagagaattaattcaccacagaatagggagaaaatttcagtcaagacattaatagagggtgtgggtaggtagtggtaagaggtggaaaagtggtctggaagccaaggtaagatggtgtcagtactcagactcttggtaaatgagacagtaacacccaggagggaggaagctgctagcctctggtttagtactcatgctcattactttgctaatgtcttcatactttttttaggacatccaaatatgggtgggccaatgcagagaatgactcctccaagaggaatggtgcccttaggaccacaggtaaataatcagtgcatatttacaatagcaaagatatggaaccaacccaaatgcccatcaatgatagactgggtaaagagaatgtggtacatgtataccatggaatactatgcagccataaaaaggaatgcgattatgtcctttgcaggcacatggatgaagctggaagccatcatcctcagcaaactaacacagaaacagaaaaccaaacaccgtgtgttcttccaacaagaatttatgaacacagggaggggaacaacacacaccagggccagtcgggagggtggagggcaagggaagggagtgcattgggacaaatcgctaatgcatgtggggcttaaaacctagatgacaggttaataggtgccgcaaactaccatggcgtacatatacctatgtaacaaacctacacgttctgcacttgtattccgaaacttaaagtaaaataaataaatgaataataaaactgaacactgagaaaaatcagtgcagaaacctagatgctgagctttttgcctccttcacatatgtaaacaaactatgttatttgctggctatgagaatatgcattacagacttcatgtaacatagttgttagactcatgaggccataacatttgtgacatgccaaatcggtataacaacaaaccatactttaacagtgtgctgtcatttaagcctttaatttatttgagaaaatacactgtatggaaatatattataattactattcaaaaggtaactgttacccttttcttagtcatgctgaggagatggttaagttaaataaaacccagttggctgggcgcagtggctcacgcctataatcccagcactttgggaggccaaggcaggtggatcacttgaggtcaggagtttgagaccagcctggccaacctagtgaaaccccgtctctactaaaaatacaaaaagtaagccaggcgaggtggcaggtgcctgtaatcccagctactcgagaggatgaggcagaagaatcgcttaaacctgggaggcagaggttgcagtgagacaagatcgcgccattgcactccagcctggggaacaatagcaaaaactccgtctcaaaaaaataataaataaataaataaaacccagttgattgaaaatattaaagagtaagtataaaatatatttccataaatcttaaagactgtcattgacaatttattctttacaatcatatttcattatagaatgggaaaacagtagaaaaccatttagaaataaacattaaaatgggtcttattgaacaagcataatactatcagtatacatcagatgttagctgacttctctataaaatttcccagaagtatacactgaggttgaacctctcctagctgttggtgacattttaagagtgctgttccaggatatcatgcattttagctaaaacatcctttgtctctcttgggaaagcttcttggggtagaaattaattttataatgtcgtttttcaaagaaactaatttaaaatccagaattttaaatttctacctcgtgggtcagagattaacatgtcataaagctggttaaaagaatgaacttattcatttctcctttccaagaaacagcattatgagcagtactttaggagcttgttttgtatatctactttttaaaagttaaattgatgttttgttgtgctaccaacagagtaaaaaaattgagaactcagcacccagataatatgacttagacctacatacaataatatatgttgtattgtatgtttgtattgtatatatgcattgtttctaaccaacatataactatgtatattgactatattgaaacaaggggttcatttagccagactttttggagatgccatattataggaaaaaaaaaacccatataaatacagttccaaggaaagaggaacaaatggtgtcacgtaaatatatgtggcagcctcaaagccaaaagaaaccagtttcttttatttaggctcagttattttcaatggatttccttaagagctaataaaaccctcatttagatatttgaattattcttacctatttctattcatattaggaatgatgatacatgttaaccaatcatcattaagctattaataataagactgcttaagttccataggtattttattggctaagtatacttttagtctttaataaactaagccaaccaatctggctgttaaaggatttttttccaaaagattttattaataaatacattttaaatatacacaaaaactttgtgcttgtaatttagttattattatttattcacttatttttcagctagctgctctttaaatgtttatcatctctgttattagtattagattttaatacttcaaaaactagaatctgatttaagaatcagttttacagtatttacagcacagtaaattacaacagaaaataagacagtttctatttctggtaggctcttattgatgagttttaatagctaagtttattatatgtgtcaattctttagatttttaaaaccagagaaagtggtttatttcatttggattggcagtgttcttactatttctatataatatgatggaaattaagtgtcctggtatgaatttacctcagaaataagaaatgcctacagtaactttttaaaatcacaatataaaaagtataaggattaaaggaaattatttatacatacatatcatatgtttaaatgaaagcaggagtcatatttataagatagtacaataaaaaaaggtcaggtaaaataatttggaatcaggggaatcttatgacgtatttatttcataagacctggtatattaaacatataaacatatacattataaactgtgaaatttgtgataatggttagctgtgtttcttgagagataatggaaaaacaactctcataacagacatttaatcatacagatgctgtccaagagcagaagatatctgccttatttttagctgtattgtagaaaaagtctgaaatattgtctctagatttatgcacaaacaaaatacacatttcttttttaacatagatgttacttccataactttttgagcttaagatcagtgtggtacagggggacagtagttatctattagaacaactgaattcctaaaacaaagaaatatgtaaatctaattattcttagattatgttgatttgagcaaagtgcacacatagaatatagttaacatgtgattaatacttaatgcgtgtatgaagaaataaaggtttgccccaaatctagtaggcatatttttccctaccccttaatctattttaaatctaaatacagtggtggtacattatttttaaagtgaaagtatattagaatcctttcaataaaaaaacaaaactacctatttaatcaagaaaaatatcttttctaatatcatatatgaaaccagttttctacttggttttgtaataagatgtacttagctaacctgtgtttttaagggcagtaagtgccacgtgattaaccaaaactacccaactagttttagcttctctagaaatctgaaggataaagaagttatatacaaatagaaacttatgatttccaaataagatacttggagtggaaaaatggtgaggtggcaatatatgtatgataggctctcatgtaaggaaaaagtaaactgattctatattttcagatctatgatgggcagtagaatttagctcagtacagggaagaactttctagaaattaaatttcccaaccatggaaagactttataaactttccaagcagagtctgaacagccattttgtcagaaacattgcagtgggagagagattagaccagatggaattgtatagttgccatcagctttaaaattcagtgattctaaattaggtcttcccattctgcctttgttgctagcacttggaaagcaagttgttattctttctttttgctttagattattcactaaatgaaaatattttgcaaatctatcaagcatatattgaaaaatttcttattcatttcctgggtcaattcagttgaactagctcatcattcatggaaggcctactgtgtgccaggcaccatacatgaacactgggtatacaaagatgagtaacatagatatgctgccttcaaggtacttattatttagcaggaagtatagatacacaaagaaaaactgttatataatggggaaagtctagataataaatttacatactttttgtggagccattacataaagaggcaagtaattctgttagcgttgagggctatggaagctagtgaaaagaggactcatttaagttggtttcttattaacaatggtaaaagaaaaaaaaagagttagcagttacagtttttgagcaccaaatatcatgcttttaattcactaagtactatgataggtgctttatatttcattttattcaccaacaagcctataagggagataatattatcactttacaaataaggaaattaagatcagggtatcattgggagaatcatttgcccaagatcacacacagagagatgcagaggcaatggggcagtggcaacagagattcaaaccattgtctacctatgtccaaagctataaggaaaattaatggtttccttgataaaataaaacagagatcttctaagatcaaaaatgaggggaaataaaacagagatcttgtaagaccaaaaaggaggggagacttttcttgtgaaacatttctattatattttaccattcagattttgtttgcaatgactaatctttatctcagagacccccttgctagtactgctgctgccaccaccatgcctgatccagaggttaggggaaatagctatccttttaaccaatgtctcaagtgtgaacagaaatcattctattgtcccatagctcacaaatttggatatttaaatgagatttccttaaagtaaaagtaaataaacaatgagaatagcatgtaactaggtaatgtcatttatcaactgtagcttacactctggagtcaacagacctgctctctttgatttatttccttgtcatctgagcacctactacttaaaggccagggaagatgagttaacatgagtataaaagtctattatgtgtttcttaacttaaatccagtaggttggagggtatggttgggagtagggaataaagatgaaaattatagaaaatgaggacaggaaagataggctggggctgagccttgaatacctcatagagccacgctgagaagtttaaacttatttgacaggtagtgtgggtcatcatagcttctaagtgacatgagtaggactgagttttagaaggatagctcctgaggcagtttggagaatagattgggagcaggagagactaaatcagagaaacaattaagacagtgcagtagtctcagtaagtgacaaagattagtaataagaggagagaactatttcaagagctatttcatagatagaatcaatggactttggtaactgactggatatgggaatttgaaagaaaaggaagaaacatcaagagctcctggaaattcttagcttgggctattgtgtggaaagtgatagcacagaagtgacgaggaaagcagtacaaagaactcagtcatgagaagataatattgagtttacttttagatatgttgtgagtaagatggtatccagatggaaacaaatcctatgaagttcaacgtatgagttatctgggagcttaggaaagacatcatgatcagatataaagatttgagattcctaacatataagtagttgttgaacaaatggtggcagataagattactcataaatgtgttttattgaaaagagtgctatagctagaacttggagaaaagcaacatttaaaggtttagcaaaataaaaagagctagcaaaggaaattgaaaaagagtacccagaagagttggaggaatattggtatcagaaagccaagtgtgaaagttgttgataatgtcaaaatacattaagataatagtgataaaattagcctttttgtccctatggcaactaaactaatctaataacatgtacatgttaaaacattaaaatgtttttatcctttgaatgcacatgatagatattaacagaagctgattgagtcatataattcatgcatacgtattttgaatatacattagtttttatactttttgtgtatttgtatattaatgcatttctgtgttggacatgttattttgtgaatagaagtttgcatttaactttcttgtgttgggttcacctgttttgttttcttttcggactttatgtcattgtgctgggtctgacaatttcaaacattgaatcactctttcaaaattgaattttggatttatgatatgtttcatttgaaaatgtttactattgtacatatcttaggatattaataaaatatattgaaatataattgcagccataccttaatcatttaacgtgctccagtgatcatacatattcacatggttttaaaaagacatagaccaaagtaattgctaaaatagaagcaaaaatacaagaatggacccctcagagaatgaattacacaggccttatccaattggagttatgtagggaaatcattaacgtgctctcctttctttcccccctcctctttggttttgtttttttgttttgtggtagtctgacccttggttatcattacagaactatggaggtgcaatgagacccccactgaatgctttaggtggccctggaatgcctggaatgaacatgtaagcaatgttatatcatatactacattattacgtggatgatattttatatatataaataataccatattattctatttagtaaagtgttctattttctggcctctaaaatgacgttaatttgtaaaacaatttgagcaccacagtctctgtgtggtataaaaatgaactaaacaagagctgtagtgtttgcttcattttcacaacataatctcttatgttttctttgttcccttgcaacctttaattttttttcattttcaagtgctataaataacagcttttagtctatttcattttgataactacagagtctccatatagtatataaaatatgaagagatgctaacaccaggactttgacttaactctgtagaagtagataattgaatacggttaacctcatttttaacagatacatagtgattctatgagtggagtttttaactcataaatacatacatatctctacttttgctttgttgggactactgtcaacacaggaagaattctctctggtagtatactataatctctatcaaagaactttccgtagcgtaggatgaattttgttttgaaaaattccagacacatttagataaggagtaaactaaattttttattggaatggcctttccaacccaaagagagtagtttgtttctatcagccaatataatgtagtttgttaggaaatttttctttttcattatccagcttgccctccaagtcttatatacacaaggtacttgttagtgactttcattaattcacaagaggatcagtttcatgatgtggcctaaagaaaatttaccaaaagtaatgaaagtgttccatataggtttgtgggtgtctcctcaagtgtgtttccatcagttcgtgttttgattacttatatatcaaattaaacaactctgccatcatttaatggcattgaagatacactgtgaaataagctcttttcatctatgcaggattttttttaagtttctgaagccattttcatggaaagcaaatttgcctgaaatagaaaataggttaataggtgggtaccagctaggcttaaaactaacagagcaggagggaaagtaggtcagattttcctatcacatctttttacttttaaagtaaaaatggatacacatgaaatccgactcttcttaaattcctcaaaggcttggccttgtattaatggttgcttcaaaaaagagtgaatggcattttctgcttattatgtcaaaagctgaagctcttaccaataggatggagatgtatataaaacatacccacatgagattcttactttaaaatgcagattttaaggggtatgatgttgaataccatgtataaatgtaaggagtatatattttgaatactatgatcaccccagaatgatcattcaataagaatgtatctaatatcatttgtacattactctgcattataattgatcatacggccaactttaaatccacttagttttccctgttcagagaaaaaaattgtttctatgtgaccattgagagattaaaataactgcttccaattgtctagtttctttcccagatatacttaagcatatacatgtgcatgcatttaatttcctagactatggagactaaaaatatggctgaaatttttaatatgattactttttgttgatatttaggtttgggtgtcttatttaagtttaatccctagatacttttaagtattttcaattacatcatattttactattaatataatatcttctttgtaaagaacctttaagccttacagactctgatctccatttttttgttactgttttcttttatgtaagatcctataccatttttagttttctaaaaatcaggattccttcaaggacaatgaaatgtaaatatttacatttttacacttgtaaatattttcctctaatagggaaacttctcaggtatgaatgctctataagagtgtaactattatattgatattggccccaaaaaagcaaaggtttgtttagagacataaaaagtgaaacatattatctccattgcactcaatagggtaagctttattgaaattcactttataatgtattatctttaaaacaaagtctaactgtaatgcatacacacagtattcctaacgtatttgtagcttcatgtcattaaggaattttgcatattccttaaaaatggaagaaaaaggcattagaaaggtgttaccttacgctctgtcttgaactaactaaactatttaagtaacaaaaatatttatgtgttaggaggagcatgccagagactcatatctggataatttttctttagcttgtcattttttcttatttgccatgagagtatgatgacaataaaaaattcccaaccctggtcactaaagtaattaaagactatattctaactgacaactgtatttctttattgcagaataaatcattcggaagtaaatttggtaaccttattgtttaaaaaactttgttttcatgctctaaacttaggataaattatattgtgtcactgaaaaacttactttctatgtttctgtaaccagtattgtatcttagaagccaaaactaaatttaagtaatttaaagtagcatttataagttatggccaaaatataattttctaatgcattgtagattactgtttaaaggaaatttgaataatcatgtatttctaaattaaatacatttttataagtttccaaagaatttaggatttagtattaaagcacccctaactcaactttgtatacattactattaagcaatactacgaggccaaaaggatttcagaggatcttcttattctgtattatatcctgcagaattatgaagtttgtgtagttattattttgaaataaaatgatagtgaattacagaagaaagaggatttttcaggccaagcatggtggctcatgcctgtaatcccagcactttgggaggtcaaggcaggcggatcacttgaggtcaggagtttgagaccagcctgggcaacatagggagaccccatctaaactaaaaatacaaaaatgagctgggcatgttgacaggtgtctgtaatcccagcttcttgagagactgaggcacgagaatggcttgagcccgggaggtggaggttgtagtgagctgggatcctgtcactgcactccaacctaggtgacagggcaagactgtgtcccaaaccaaaaaaaaaaaaaaaaaaaaaaagaggatttttctctttggtaatagtggttgatttgatttcatcaaaatcaacctccttaccaaaaaatgcagacttctgcacccaggttggagtgctgtagcatgatctcggctcactgcaacttctgcctctccggttcaagcaattctcctgcctcagcctcctaagtggctgggaccacaggcatgcgccaccacgcccggctaatttttgtattttttgtgtagatggggtttcgacatgttgctcagaatggccttcaactcctgagctcaagtggtccccccgcctcggcctcgcaaagctttgggattacaggcataaactatcatgtccagcctctcttcatttttaaatgaggctaacctgattctacttcaaaccatacttatatagaaattttcattcaaaataattcctatgttataatttgtaaattactttcttaataatactgagggccctcaaaaggagtgggaattactgagcttaactagttgttctaatagaactactccctactataaccctcactttttataaaatacttgtgaaacttaaagtattttcaaacacaatggtaatgttaggagaaatttaacttatccatatgaattattaatacttaatagtaaaatgaaatttattatgaaacacttagtatgttggaactagattggtatttatcaaattgaaatatataatgttatgacataaatgtaacatttaatttaatgcaattaaattaaattaaatatttaattattttaacatttaggttagcatgtttaacattagaaaaatttgaaaataaaaatagtttattctatttatgcatcttattcatacagtacttgtttggttatgatatttcaaaattataagattatctacataacattattatatataaattttgccaggatctgcatatggtgtacttttatgtcattttaagataaatgttcccaagtttttttactgtgttttatttaacatcaaacaaatcatgtggatgtaccttactacccaaatgttttacttggtcaacacatatcttatgttttaccttagattctgtccattaggacactgaatcctataggtaaaatcatttttctgaagtgttccagtaattaattgtaaaatcatcatctccatcatcatcttggagaggcaacaatttccaaagacaatcaatacaaatgcctctcaccttctttctccctatgcacaaaattttatcaagtccccactggtatcttctatacctcaagctgaattgggaaaaaattccacttgggcattcctaatagagcccagggacaggactcattcccttccctgctgctcacacctctagggaatctcaaaacaaaactaaaaactgttctaaatattccatgcaaacatgggtaatatcataactaacttgctcagcctctttatctaacatttagaactagcttgtccaacctgtggcctgtgggccaaatgtggcccaggacggctttgaatgtgacccaacacaaatttgtaaactttcttaaaacattatgagattttatttgtaattcttttttttttattagctcatcagctatcgttagtgttagtgtattttatgtgtagcccaagacagttcttcttccagtgtggcccaaggaagccaaaagattggacactcctgatttagaattttaggtttaaggtcttagaatcaagggattttttttaattaaaaattttcattgtcttagtgattcaaatgaaggggaattttaaatgaccctaattagaggagaccgactgacagtagtctgcttttcataagacagtctttattcaggtacacaatttagtactaaagtatgaggacaagagacctttttgatttaattaattgggcattaattttactttaaaaactcagtgtccttagaagctgtggaatacagaacattctcctttactctaaaatgaagtaatatattggcatagattatctcccattttttctaagatttgctctggccactatctggactgaaattatgagaacaagaaatgggatttctcatttaatagtaactaaatcatcagtagcattgaaagatagattaataaatataaaagtaatgtgtgatactctgtggtttttttttaaaaggcaactttagataccttttatatatttttatttgcttatagcttaagatcaatcattttacatatattgatgttttacaaattttattttgaatgagatacaggaagctcatattgatatcacaaggttatggtttatatttagttcataatacttttcactacagaagtgtgttttataatgatttcaatgtatgtatatatttactcctatgagcagttaccatctttataacaataaccatttaatattaaaataaaactgggctttctaaaagcagttcaatttgggaagaaaacttttcttttgggggacttaattaatataaaaagctattaaaataaatataaagagagtaatttcagtgccaaactagaactgcatagtaactgaattataaatgttatattttatgatttgtcattgattattgtgaaaccttcaaagcataggttaaaatttcatttatcaaattgttttgtaggggtccaggtggtggtagaccttggccaaacccaacaaatgccaattcagtgagtatatatatatattttttttaatattttgcattttgtaacatttaacaaaaatcacaaaaacattttgcttttgaaagctttgcaattggttgtagtaacccttttttaagtaatcattcaaaaagtttaatataaattttagaaaaagatgcataattttttgaaattatgtaattttctttcacttcaaggtctaatgtaaacatgcattctattgtcaacaagactttcaaaaataaaaattgaaatagtgtgacttaagtatatactacaatagcctataaatagtgatctgtatcataaaatggtttgatcttctaaaataactattaataatcactgagttgccaaatacaatcaacctgttagaagaagccaaattattatgattttatttgctatatcaattacatctaggtttgctttcttgctgccccagaaagcaaatgcatatttaccttgtacctgttagctaaattgccatccttgtacatctctctatatacctgacatcttgggaattttccttatatatttgtggccgtggtttgatggcactaatatttatctctcttaataatgtcacagaaatatgtgcacaggttgaaaattaagctatcgatcttaatatgattttaatgttgtgatcctggagatgtttttccttcttgtctttgaaaccttgagttcttcgatatgtgagagaagtctgccatgtacatctgtgtactgtgtgcactgcacaaaggttcccgggtcaagagagtcagtaggagaatgaaatacaacctgtgatccccttgtgaagtcaatgggcatctacgcaaagaggatgctttttgctaatatgtacaaaggtatcttcattggctagcagtggccttaatgttaaatgaatatgaaaccgatccagtgtttaaggttagggtataggaagaatcatcctaaatccattgctgttttgaagcaggaatcactttcagctcaagtaaataactgtcatatattttttaaaatgttaattcatgttatctgcttttctcttaattttaatagctacgatgtttgctaagtaattgaaattatttgaagtgaaaagaatgatgttgcttccatttgagtcttcagtgtgttatttaatttcaacaagtctttctcctaaaatagtgttttgccagattgtgttggaatagagtacctttacaccctcaaaattattttcatttgcttacatgctttacaagagtttacttcttatgatctattagcttcttactatttgacctaaccaattcattcaagatttcactttaaaatcacacctgtctagcaggtcaagatacatttattttaacttcctatttaaatgcccataaaaagaatgcaagaaaacattttttgtaacaaaactcttcccagtgccagaatctggaaagaatttccattatctgcatgtctcatgaagctagatggaaaagcacaaccaatggctcaccttaactatggaaaccttcccacctagaagcacaaaaaccattctcttattcctcattgtcagctcagccagtcatccctttactgccattgtaggcagccagagtacaattcacacccaccactacccacctttataagtaccttcttttacacactcattcaaagattatatctcccacaaggcacctaggaaggtggacagggtttgagcggttgatattgacaaggatgtttcattgtaccaagggggtatattatccaagtaaacagtatagatgagaggggagctctgtgttctgatgacttttagttttttaggtactccatctctttaggatttcatagcgctgggcactgtgggtaggagaatacgctataacacactagcagttatgcattattttagaccctgagaaacataaggaattagggtaaaagctgtacacatcaaactgctgtccaccagtctgaaatgggcatttgactagcacacatgtaggcaagtaatggagttgaaagcagtctcctcgatgaatgtataccaaatgtgcaaacatctacccttactcaaagtatgagaatagggaaaagaagtggaggaggcctatcattctctctttagagagagaaagtagtcatcatcctgagcatccaaaggaaaagtaggcctctgaaaatgaccactctaagaacaaggggaaaaaaatcatagataactgacgactttctagcaaagacctagggcttctatgaaacagaagcaaaaagtattaaggaggtatttttccccaaaaaccatggatcattttgtggtgacaacttatccaaattatgttgaattccaagtttcttagacttcctgcccatatttaatattaaaacacttttcagttcgtaccaatacagttagtctctgactcctcaaggcagcatattgaagtagttgtttgttttgtttttgctgttttcaaatatgttttgtttactattttttctttcaagtgtttattttggaataacttcagagttaaacattgcaagaatactacaaagaatttccatacacccttcacccagattcccaattgttaatgtcttaccacatttgctttattatttcctctctctacataaacgtatttttaaactgtttaaatttcctgaaactttatccctaaatacttgcatgtatatttcctaaaaaactaacacataatttttttataaccccagtaaaatgatcaaaataaggaaatcaattctgatgtaatgctattttctaatctacagattttattcagatttcactaattggctcaataatcttttcaaacaaaagaaaatcccaatttacttgttacattcacttcgtgtctctttgtctcctttaacttggaacagtttctcagcttgtttttgtttggagcgggaggttgtttgtttgttttggcctttcttaaccttggagttaaaaaactccaagcaagattatttagaatgtatataatttggttttatctatttccttctgattagatttaggttatatatatttgtcagggatactacagaagtaattttgtggtttttggccgggtgcagtggctcacacctgtaatccctgtactttgggaggccgaggcaggtggatcacgtgaggtcagaagttcaagaccagcctggccaacatggtgaaaccccatctctactaaaaatacgaaaaattagccgggtgtggtagcaggcgcctataattccagctactcaggaagctgggcaggagaatcacttgaacccaggaggtggaggttgcagtgagccgagatcgcgccattgcactccagcctgggcaacaagagtaaaactcggtctcaaaaaaaaaaaaattttgtgtttttctcaatgcatcatttcaggaggcacatgatgatttgtcccattattgttgatgttaattttgatcatttagttaaggtggtgcttgtcaggtttctccagtataaaataactatttttccccttgtacttattaacttagagacttactttgaatgtacagtaggtatcctcttcctccttatactttcatctgctattttggacatctattgatgattcttgcctgaaacacttttttactttgttggttgccaaatggatatttttgaattctgtcttttcttctccgtttattagttagctaactataacagagttgttttttcttttccattcatattcatttatgtatatacgatgtattcatgaattattttattctgtgggtttaggatgctaaaattgttcaaagttttcccctttaagtgggatcacttaaccttttaacatgtccccatttttctctgagcacattgaagctcttcttatattttcccagttttagccctggaaacagccacttctttaaggagcttggggttctttaactgggtattggtatttagaacccactagagtaatacaacttttaggccctctcaactaacagaactaggaaatatatgtatgtgtatacacacccacacacgtctatacctttacctatttgtattaaaaacatgagtgcacactgatgcttccatttcagtccatccctacagggttcagtctagcctttctactttccatgtttataagtcacttctctgaaagtatgaaacctgtctgtcttatccataatatatgtatttattgcctaatctttgtccacaattttgtcatataaaagtgttttgctcaaaaatatttttggcactcttttacatgacagcaggaaaaacatttttaagggcaaactcatatttttaattccaaataaaagttacgattttaatttttaattttcttacccctgagcattacagtattggtctcagattcttacttagaggtttatttacaaactccctaattgtaatttttcttttttttttctttttcacgaaggattctgatctttgtacaagttctgatcattatcaaacattttactgaaaatagacacttttgattacaaggtccggaacaccaaccaaactagacttatactgaaaaagagtattactggatcatatatctgaaaagtccagatatatttttggttttgagcacacttggttccaaaagtttaaattatgtcatcctgagtcccacccaagccacatgaaaaaaaaaaaaaaaggcagaaatagtttactaaagaaaattaaaggaatggatagtaaaagaggggataggcataaacaacaaaatgttcagtatagcattatactcattaattcgctcacttgtcaggggaaaaagaggaaactcctttaaggaaaatatgcatctattaatagtgattaagcctaaaggaaatatgaacaaattactccaaatagtctctgctctatacaaataggtgctcatttttttaaaaagcactaaaatagaatatttttaatttcatgtggcacagataatgtcttgatattatcttcccttatttctagtaaaccagtgcttgtaagatagctttaaacttcacagttgaagaaaggcacttatctaaaatgttacagatcatttaacaaaatgaaagtcctctagttacttctctgccctctaccacagcaccacaatcatgggtattgggactcagaatatttcagaatatttggattctcatcacagtttttgagtgatctgtctagattagccagacagtatgtgtggcccttaattttattctctgtcaaataataagttcttcaaattctgtgtttgactttctaatcctctaattttgcttatcttctacatcttcatttttacctttcatttcatcttaatgagtatttaatataaagtatagggtagggttagaaggaggattttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctagaaggaggatttagggataaagagaaggtaagagttttgaaggtgatttcaactctttgaatccaagtagctgggagaatgggaataacacaactgagctaggatcacaggaaaagaagcaggtgtaaaggtaggcaatgaggtttgggggctttgttttttgtttttttttgaacgttaaatttgaaatatttgtaggacacctttgattcttccacaatgcctaatgcgtatttctatccttatacttaacacgttataattaggatctgtgatgttcagcctcagccaggtcctccctgatgctttaccagcagtttgtttttttcactcttccttagctacttttcttgtcctcctcagtgaatactattgcaattctttattctcattctgcacctacattatgtttggccccttctctatcagctaattgtgtcatattttacagaggagaagaagagaccattagattcaaatttcttcagattctgccctttgcgtccaatgttatcagacctttagtcacctttcttccttcttacctcagaaatagaaatatatatatatatgtattttcttttcaattctgacccttctgtctattctctctctctcttttttatttttatttattgttctattatttttttttgagatggaattttgctcttgtcaccaggctggagtgcagtggcacaatctcggctcactgcaacctccatctcccaggttcaagcgattctcttgtctcaggctcccgagtagctaggattacaggcactgaccaccatgcccagctaacttttgtattcttagtatagacaaggtttcaccgtgttggccacgctggtctcgaattcctgacctcaggtgatccacccaccttggcctcccaaactgctgggattacaggtgtgagccaccacgcctgtccctatctatctctttgttctatttcttgttacttctttgcatatcctactcattcactctttcaaatgagtctttagtctatgtccctttccattgactggaactttcctctagtgccatgccgtgaacaaaatcccaagacaatccgaaggctctagttctctactcctctagagttgggaggggttaccagtacaaaacttctctcaacccttcctcagtctccagccaccatcccatgtctcccatacttccactccctcaccaccttctcctagataattaattccttggcctgtctttttaatcaccatgtggcaatgaagtgcctgaaacataacaggtaatgaatggaagtttattgaatttacttctcaacccatttcagttcccatgaaagtcctattttgaaggttattagtgactttctacttaccaaccaaactcagtgacttactttctatcctcatcatacctaacatttgagatatttgactccttggttttgtattaatatcttttctttttttggtttaataatgtttctttagttttccatatttttattacttttttatttacttttaggtgtatcacagaaaggtaaaaagcttaagcctgacagccttcaagaataaacccagggccaggcacagtggctcacgcctgtaatcccagcactctgggaggccgaggcaggcggatcacgaggtcaggagatcgagaccatcctggctaatacagtgaaaccccgtctctactaaaaatacaaaaaattagccaggcgaggtggcgggcgcctgtagtcccagctactcgggaggctgaggcaagagaatggcgtgaacccggggggcggagcctgcagtgagccgagatcacgcccctgcactccagcctgggcgacggcaagactccgtctcaaaaaaaaaaaaaaaaaaaagaataaacccagtttagatatttcctaatcactgcatctgctacctccttcttaaaaatctaacttgcttgactttttatatttttcctgattttcatccagtcacatatccaccattctttctctatctcttttttttggtggggtggggggacagggtctcactctgttgcccaggctggagtgcagtggtgcaagtggtgcagtctcagctcactgcaacctccacctcctgtgctcaagcaatcctcccacctcagcctcctgagtacctgggactagaggcacatgccaccatgcttggctaattttttttttgttttttatagagacaaggttttgccatattgcccaggttcgtctcaaactcctgggctcaagcagtcctcccacctcagcctcccaaagtgctgggattacacgtgtgagctgccatgcctggtctccacccattcttaattggcaatgttttctaattacatttcttggctgctttttttttttttcattttaatgctaccatgttgtttcaactaccaaaaatctagtttaatcctagatcaagtatcttgtccagcacaaagtagaagtttattcagttgaagctgtatccttagtcctggtctctgatacattctagacctgcatttctaaaagtttgtttatcatatctacctcagtgtcttctggtaccttcaaatcctataatcagacatttccccaaacctgccccacttcctgaattccctatgtataaatgagtagcagcagcatctacccagtcaccacgttgaaaacctaggaattatcttaacttcttcctttctttgtctgccacacccagtttgtcaccaagctctgccaagtactttgtgaaatgaccctcaaattctcctactcttgcttatcttcatcagcactgcctatcactctttatcatctcttgccaggatttttttccagtggtcttctaacttgtattcatattccatgatgcctctagacttatttctctaaaacataaatttagggctaggtgtggtaggtcatgcctgtaatcccagcacttcaggaagctgagtcaggaggatagcttgaggccaagagtttgagaccagcttggagaaaaaagtgaggctctgtctgtacaaaatatttaaaaataaaaaaggattttaaaaacatacatttgaacatgtctctataaaacccatgactccttatttcctacaacataaattcattcatagtctgactgtgcagcctcaccctttaccacaaccccctataagccccacactatagcagctatataacatagcatagcatttcccaaataaaccatgatttcttttctttctttctttgttttttatagcagttcttctctttgtctttctgatgggcatctactctctgtaagtcccaactgtccagctcaaatgtatcttctgtactcacatggtacttctacctatattgttatattttatgtccttcacactactggtcctagggctaggagcccaaatgctgatttttaataaagacatcaaagactatgaagtagaaacagcataagccaaaaataaagagcttgacggggcaaaaaattgaaagaaattgaacaactagttgagataacatttgtaaaagtatttttaaatgtttattttatttaactctttgaaggaatcatgaagaaggagaaattaaaagtataaaaggaggccaggcacagtggctcacgcctgtaaatcccaacactttgggaggccaaggcgggtggatcacctgaggtcaggggttcgagacccgcctggccaacatggtgaaaccccatctctactgaaaatacaaaaattagccgggcgtgatagcaggcacctgtaatcccaactacttgggaggctgaggcaggacaatcgcttgaacccaggaggcagaggttacagtgagcctagatcacgccactgcactccagcctgggcaacaagagcgaaactccatctcaaaaaataaataaatagaatacaataaataaataatataaaaggagcaaggacttaagaatgagatagttgagaaaagctacctttggaaataaacaaagtttttttttttcctatctgggatatacatgaaaatttaaatctataaataatagaatgttgagctgaaaatgaaggtatagtaagagcacgatagcttcaatgtatgacaggaagacgaaatatttactcaggatggtgtaatcaccatgagtgccagctcacaagagtccattgttaaatattcaggaatttcatgagctgtttgttaaaccactgttagcttaaaatctgccatgtgggaatatttacaccacagtaactggcaaatactataaatcagggctttttttcccccatgaagtttactgggtttactgacacattaccagtaagcttcaaggctttcataaaggctgagccaaaaatgcttccagatatttgttaagatgaggtagaagttggagagcatgattacattttggatcttgtcaaccgtgttttgtgtttctctccaggaaatctgtgcattaaaacagaaaggttggctggctagagggtgatcaaagagatggaaattaacaaagtagactttatgataatgaatttaagacattggagagaggaataaaatgttgacagtgccatgaaggagaggcagaggcaatttagttataaactaatagagaaataatgtgctaagtaaacatggtggaattgtgatgcaagaaaaccctggttggaatatagagtaatttttgtaagtgtcatgaggaataagaaagatgtcaggcaagggagttagttgttcagtaaagagttctaggatatgaccatactcataaatggaggagagggcagtatattgtaaagtaaagcaaggcggtgaactgcaagttccaaatatctaaaggctaattagattgtatcttaaagttgcttaagaatgatgataggcaatatagagtgacagaagaacatgagccaagtgctaaagacagagagagatgaaattggtcctaggagccgatagataaattggtggtttggaaagggcagactcacatttaaataaagagaagtaggcccagcacagcagctcacgcctataatcctgacactttgggaggtcaagacagatggatcgcttggctcaggagtttgagaccagcgtgggcaacatagaaaaactccatctctacaaaaaattaaaaattagccagtggagcacaccttagtcccagctacttgtggggccaaggtaggaggattgcttgagcccaggaggtcgagactgcagtgagccttgtttgtcccattgcactccagcctgggtgacaaaaaaagaccttgtcccctccaagaaaatgagaagcggaggatggatggtaggtagatcatgaactgaaagggacccaagagagcaaagttgtattcattcactaaatgaagtaaatgtttgctgccataaaaaaatctcagtactcagcagaattaattctaatccctagtgatgctgggcactctagcagtggccatctgcagtgctgaattactcataggcagaccaagcagagccttgggacatgtgttgtgtgcgtaaggcaaagcaagaacaccaaataaggagaaaagcttttcaaataacttaatattaaatatttccaaaaaaacaaatatttatcaagaggaaatcataacttggttgtacttccttatacttactttatggtttcatattatttttgtgtttaattatatagcaggtattgggatagatggtttagaatagtacaagcacttatcttttcactactgtaaaggtcctattctggccctggctgtctgacttcgagtagagagtaatctattggtgttcttcagaataagacaaaaatatctcttatggatgtacagcatcttaatacaagttagctagtaagcttgtgtgaaaaaagaaaatatttggatttaactttccctattaatatacatactcgagggcttacttttaaacataggttttctggtttttcatttcttaaattatcacagcaatgtcgtattaataccttctaatctctagaaaagagcttggtgaagagcttgatttgaagagaaaaagggagtttgttacccatatctgatcctcacaaattaatagtctttggagactcgtattaacaaactttttttgcatagcttagaaattgtatgtgtaaatactactaatttgaaaaattctggtttcccatttttagatacacaaatatatatatttctacttacagaataagtaattagtatcatgcaatatgcacaacttacctgaaaccaatatatcttaaagcagttattctgtctaaaatcctcttgactaaaatctgccttcttttgtgtaaatccaagttattattattcagttttccagtacttaaacagatacaaatttttttatcctttactatactttgtgatacattttaaaacttgacaaaaaatcatgaaataaattcattttaggtcagtgtccatattgctacatgaatcaaaaatttttttgtcctattcgtgttccagataccatactcctcagcatctcctgggaattatgtagtaagtacatttgggtttgtttgcttataagaattgatgttacattttatttgggcaatgaaacagttgtccagatgttaagaagagcccctgtgtattggccaagaagtgaacatcttgagttgtttcatctgccaacctcagtacatatgttgatgttcattagtgaaacagttatcaatctggccagaattgccctgagtactgtgttttacttcagcatatgtttctgaaaaccagtacaatacactctgtccaatcatgaagagagtaatccccagttacacagtaatatgcttgaatttgcggttctccaggagaataatctacaccccagtccaaccctatgcaccacacatagcgtctaagaagacattaaactttctcccaatcacaaatgaattagatggcagaataatgactaataatttagaggaatcatttcattttttggttgttctttgaaattgagaacacttatttttatcattattactatttagtacacattagaattttccaaaaattcatgtcaatgtgaagtcaaattaataagttttatatgacctcctgagcttacaagtgaccttttaatcatcatcatcacattatgatcctagctacatctcaaagtcaacacagaggaaaatacgttacaccatttagagggaaacacctaacagagaaacaaggataaaatggtaacaagggaaatctttcccacagaaatgttcagaggtggtggctagctggaggggaaaaaaagaacgcataagaagaaaatcagtgagcatttcactctccatggaaatagtattttattaacatagtgaaaagcacacactgctttggacctgtgaacttagtgttcagtgttcatgtaagctataaaactaagcaagtctttctttgcattttctatgaaataaaaatgaaagtaagaaaatttatataaaacctattttttcttaaagccactaatgaataaggctgatatatcattttatgaaattatagacatttatttaaaataaattttaagttgtgcaaatacagatattatttgaaataattgacaggtctatagccataccaccctgaatgtgcccgatctcgtctgaaataattggcaggctgtatctgtacattcagaatgaagttaaaattttgccatttaaaagttaatttgattgctgtacatagagcatctgaaaaagcctacaacccattgcctgaattatctattttggttatctgaaattattgaattaattttagaattacctaatcgccatttcagtttgattgtgtagctacagcctcaataacccacagcattagtcaactttgcctctcatttctaattgatgtgatagtggaaggtacagtgctccagaaacgttgcaattgatgctgacagaagaaagaaatgacatcagtgcatttttttaaaatatgaatcaataagcagatatcttcatttttaaatatattctctaagcgaatatcattttagctttctataaaaactaaaaatacatatgaattatttctgttttatggatttgtaaagaccctgttgaatgatttctgcttaacctcattataactgatatgattaagtcatgaataatgaattaatggtacaggctcattgtttttggaaatttgtcaaaacagtctcaacatatttaagctaaattatgttttgtagaatattgaaatgattgtgcagtcaaagaaaataaattagagaaaatatatttctgctcttattttcaaattggattattatagatataagtctaacttctgttttttcttatgcaatgccttatttttactgaaattttgtataattatttagggtcctccaggaggtggagggccaccaggaacacccatcatgcctagtccagcaggtattgtaatcaaactagccacatgggcatttgattattagaataaaatcacagaatatagaaattgttcatgaaataaagttagtagtattcatgttctcacgatagttaaaggagtagaggcagcatggtaggaagaaatatagtgttcttaaataagtattatccagttaagcatttagaaaattcctatggtgtgggtgtcagatttaattaggatgaacactgttgatctatatgaattgcccaaaaatgtgtctaacttaaagatttattgagactgataaaactaaccaaatcttctacaatttagaaaatttctgaataaataaaacattaaatacatggattcattaggtttaaaatgccaaatcagactcaccacatctattatcttactaagatgaatgaaggatgaagaagtacttacagtattatttaccctacatgtctataagtatttattagtcagcttataaattcactatgtaataataaaagttttttatcttctaaactaaaacatacttcaatgttttcataatccttttatataattactttaaatagttttatcatttatttttgagactttcacacagactattaaatgtgtcttggggttgttaacagtggaagactaaattggcgcacccttcttagaaaatgctatgataaaatgtgtcaagagccatgaaaaggttcataccatgtgactctatacttctaatactagaaatgacagagatacaacccaagatttatgtagaaggatgctcatttgttatactcaagagtaaaacagtagacacaaactcatgcctaattcaattttagtggaattagtaaattaatgtttaaggtgtaggttagaatataatagagccattataattattatcaaagaatttgtaatgacatggaaaaataaaatctcatgattcaatgcaatataatcacagtttcatttgaaaccgtaacacaaatctagaaagtagaaaacaaagaaataggctaaaactctatcagttattactttgggatgattaagtagatgggaaattttaataattataaagtatttttgattatgatgttttactgttaaactcatatgtttttaactggcttgttgaaattaagatagaagcttgaaattcagtatcattgatcataccaataaaaatttttaattttgagccctttcaatttagaaaaatcataaacttgataattaatacaaaattttactttgcttcactaactccttggatatttaatggtctgtgtcctgaaggcatcttcattgaaaatgatacaattcatcgaagatagaattatatcaactgatcatcttgcccatatttatgttcttatatggtgaagttaatgtttaatttatgaaggtagcatgtgaataataaatgcttcactgcaagactaaaaaaaagtttttggagcaacactgaacattgcaggcaataagtaatcttcctttcaaaccagaaattgccacaagtacatcttcctagtctttttgcatactcttttatgtgttcatcctgtgtcacagtcactcctctaatactcagccagcaccccacccacaagaaaggaggtcccaggagatccactttattgtaaagtttttctgtacatagaagtcagacattttccagtaaatacatacatatatatatatatatatatatatatatatatatatataaaattttttttttctttgctgagacagagcctctgtcacccaggctggagtgcagtggcacaatctcagctcgctgcaagctcagcctcctggattcaagcaattctcctgctgcagcctcccgagtagctgggattacaggagtgtgccaccatgcccggctaatttttgtatttttagtagagacggggtttcaccatgttggcaaggctggtctggaactcctaacctcaagtgattcacctgccttggcctcccaaagtgctgggattacaggtgtgagccacctcgcctggccataaataccaatcttatctctctcaaattttttctgtagcagatgaaattatattcttgattagtctttaaaatgataaatttcttttctttgtgcacatttaaaatatgtagcccatcttccttttaccaagagtaaggccaatacagttgaaaaaccatttgaagatttcctatgtttaaaaagcaatccaagattttttaaagttaatcttgtgtgtgattgagtttattccaacagttaaatctaagttagcagtacttattgtctttagtacacaagatgagtaagacacggtcctttccttctctccatgagcttattatgtcctagttggaagcaggaggaacgaataaagcagtaaagtattcctataatggaaggcagaactcagtgggaggggagcactcatgcacttggaactgccaggaaaaaacctcatggaagacataacatttgagatagcccttcgatagtgagtagaatttcagtgcatagagattgagaaggtgtttggaggaagaaagaacaaaatcatggaggcagaaaggttggtcacaggaaaaaacaagtagcctgggttgacaggagtatagcatacacaaggatgtaaaaacagttaaggtcacaaaagtaggttaggaccttccttagaataaacaaatagggtcaacctgaggtaggcactccaactttttcaacattatgatatattcaaatagatatattcaaataagatacagtatttagatttatgggtcattgttcacagccaaccaataaatgacatgagatctactctgtaagtaatacacactaaaataataaacttattaatgtctaatgagtaatcacacagtaaaaggaaaagtaattgccactctatggttactgccatgagaaagtaaatgatacttaccttctgtctcaaatcagtacaaaaattttaaacacatctttttctcaaaatgggcctactggcggggcgcggtggctcacgcctgtaatcccagcactttgggaggccaaggtgggcagatcacagggtcaggagatcaagaccatcctggctaacacagtgaaaccccatctctactaaaagtataaaaaattagccaggcgtggtggcatgcacttgtagtcccagctacttgggaggctgaggcaagagaatcgcttgaacccgggaggcggaggttgcagtgagccaagattgtgccactgcactccagcctgggcgatagagcaagactctgtctaaaaaaacaaaataaaacaaaagaggcctactacattatatttaagaaaactgtataatgtggaaaaatagaaaaccataatttatcatttatattttctcaatgtaaaatatttagcctttcactctaggttttatattataaaaacatgtatgctcagagacttaattagaattagctaacagacatgaaatataaattttttaaatactgcacaatgttacatatatttatatggatatgcagtacagatatttttattataataaatcaaaaataaagtgagtaaaaacatttcatcagaagttgtgctggaagaagctggcttttagttcaaacaggagaattacattattctaattgtatactcttactctaatctttttctttcggaattaagccaggatagtccaccagctttcactaattattaagtaaaaagactatttttaaaatttgtatattggaaacttaaggaaataaaactgaaaagcaactgaatctgaattttaagagatattatatattacatatacacacatacacacacatagaattgcttgaagtaaaaaagtatcttttttaaaaagaaaaactttactataattttttaaatttctaataatccttttacctgaattattgaagtgattcctcatacctaatttatgacctcagaatgacaattttggggtcagaaaatgactgtgggtatttatttttagtaatgacaatttcaagtgttgcagcttatatagagagaggtatctgtatgcaaaccatctttgatcattactttgtgatgaattgggtatagactctaaagaaatattttaattaagtaatattttgtttcagattcaaccaactctggtgataacatgtatactttaatgaatgcagtacctcctggacctaacagacctaatgtaaatatgaactttttttatttttggaatgtatttgaagactttcaaactctgagtgcattccatgtcctgtatattgtttaaactttatattttattatccaggagcttattagatattcaaaaagtcaaattcttttctctgagctgggttaaaaaaacagtaaacatatataacagagattttatatcaatataatttaaaagtaaaactgatcctaatcaattacacattagtttcatcttattttattgtaaataattaatgatatatactatttgaaaatgacaggttatgtataatcatttatattaacctcatttttagcatcactaagctttttcattgtgatctttttttgtcctgataaacttgaaaataaaggaggaagttggctatgcttgttttttttagaatatgaaatctagactttaaatatggagctaaagcagttactacaggaagaacttgggtgttcttaataaagcatatagtcatgatttttccacagaagttcacaggaaaacattttatttatctataaggcctacatgtttacaaaaatatttataacagattgtagttaatacacatatacatgtgtatatagggtagcagaaatcaaagaaaaatcagaagatatatatttatatgttaaactgaccaaacatacatacctatagttttagtgtcttttaaaacactgtaggagccagataaaagttcacaggctactaggcctaccagcaccagtttttcaacccatatctaaactatgcttttgataaaagctgaataacagcagtaagtttaaagtcaattatttctttgacttatatatgccttatatcagtgaggcatacatattccaagttgtttactgaacaccaacctacgtgcttttagatactcaattttaccaagcaaaattggcattctcttggagaattttataagcatgtggtttgtattgcccatggtgatagaaggccatcttattcacacacagaggtggtgaagtacaggtttgcctgccaaaggcagttatttcttcctaaaagccttcatgattagtcaccaccaccactgcatccacacacacacaccatagtcaatattctgccaatattctgcaccatacaacatggtagaaatgcttttggcatgggaaatttgaagagaaaatgttttcagcaggctgtcttaactgtaagtgtaaggtatcatggtaacttgtcttcgaactgggctccatgtttccttagtcttctagagagatgagaggaagactgagtgggcgggccatgggttctctatcaccaaccccatcatagcacacctgttttgaaccagacttctaatgtaagattccacctgaaaagaaaggaaagaaaaaaagaattccactactttgaaaaatgttaagcagaattgccatggaacctctgagtgtcattgaagtgacatggttgagactgccaagaagaattagctatattcagccatccccaaggaatgaaatgtatttaacctataagatgaaattatttattatgtccatttaaacaaagacagattgcctactaagaaaaatgttaatgttgtcataatgacattgaattattcttattaataagccaatacccttaacagcttcttaagaaccacctttggttttcaatagaaaatttgtcagtatcatagaggaaaatgcttatcttctaatttgcactggaatgtatatactttctgagtatatctgaagaagaaaaatttggagataaatgatgattaagctaaacatctatatgtggaacatagagaaaacaatatgagagaggtgaacagtccagttagagaatccacaaggctgaaaaacatcaagtaaaagatctccatagcttgaaagtaaaaataagttgtggcagtgtcttgtaatgttaaatatattgtaaaattgagataagccattgttttcagtatgattacagtgattttcttcatttttaaaatagtttccaatgggtcctgggtcagatggtcccatgggtggattaggaggaatggagtcacatcacatgaatggctctttaggtaaggcttttcaatttgatgtttagaataaattcataacaaaaccttaattctacctagtgcatattacagtttccaaagttcttccatagccagctactcatttttaaatacttcaacttttacctcatacagatagtttaattgacattttattggttataactgtagatcacttgaagatcagaagtgtgagaattgttctagttcatattcacagttatttactttaacctatagaaatctcatgtcttaccataaaaggagacattgctgctgtgggcacgtgtcatgcttgcccaacccagaaggctgcagtattcttgcagctgtttgttgttgttgttattgttgttgttgttgttttgtctctagagttctgtggacacagtctcagaagaatctcagttctctccaagaatttcttaattttgtttttggatttttatgtttgcctcctttttaacataaaattgttaatcatattctggataatttgaatgattctcttttaagagaacactgcctacattgtcttcgtgataaagaccatttcaagtgactgatggttgaaaacatactttataggccaggcgccatggctcacatttgtaatcccagcactttgggaggccgaggcaggcagatcatgaggtcaggagattgagaccatcctggctaacatggtgaaaccccgtctctactaaaaatacaaaaaattagccaggcgcggtggtgggtgcctgtagtcccagctacttgggaggctgaggcaggagaatcgcttgaacccgggaggcggagcttgcagtgagccgagatcgcgccactgcactctggcctgggtgacagagcaagactgcatctcaaaaaaaaaaaaaaaaaaaaaactagctgggcagggtgctgggcgcctgtaatcccagttactcaaaaggctaaggcagagaatcgtttgaacccaggagtcagagggtgcagtgagccgagattgctccattgcactgcagcctgggtgacgagcaaaactccatctcaaaaaaaaaaaagaaaaagaaaacatactttataagtgatgccttcttaccatatgaagctaaatagctgcaaggtgaatgaaaattttaacaatagtgagaaatacagacaagtgttgcaaaatggactaggtcataccacatactatagttatatttgttttgcattcacataggtcaaatgcaaaacaaaaaaacactttttatgttcgtatatgtttaagtaacatgaccataaactaatttaaaagttgacaatggggatgggagttatgattttttttttcttttggaaagggttcatcttttacttaagttggaaaaaatatgttcatgagtaatttaggttatatataagatttcacttcccgacctaaggtcaggaaatgcctccctctgatacttggaaaatctttcaataaccaaattatttgcagtacactaagagacttttgagcttttaagaattcatacttattttgcctagattgcaaagtcttgatttgcactgtccaattgcactagccactagccatgtgtgactatttaattttaaattaagtaaattttaaaattcagttcttcagttgcactgccacatgtcaggtacacagcagccacttgtagctaatgactaccttaatgaacatcacagagaaacatttccatcattgcacaaaattctattggacagcaccattcttgaattttattttccaatttattgcaaaataattcactttgcaatattgttatttgtagaaccattcacaaaaagatgatatttggtaaatagttaaaaggctctcattatcttagtcaccagaatagaattttcagaagatttttacctatgcttggcaactggctcattgctttctataatgaacattactgtacatattatatatacacatatatatgattgcatatatgcattcggtatttaataatttattatgcctatttatttacaacttatattaataagccctagctttatttgtaatgttgactgaatgctatgctactaaaatgttatattatttttatgctaggaaaattaattgtcagaagttaaattgtttaaaataaagttaatattgtggcaaagatctgattattgttctgttacctaatgtatgattctatttctttttttttttttttttgagacagtctcactctgtcacctacactggagtgcagtgatgtgatctcggctcactgcaacctctgcctcccaggttcaagtgaatttcccgcctcagcctcccgagtagctgggactacaggggcctgccaccatgcccggctaatttttgtatttttagtagaggtgtgatttcaccgtgtttggccaggctggtctcgaactccggacctcaaatgatccacccaccttggcctcccaaagtgctaggattacaggcgtgagccactgcacccggtctctatttcttacataagaaaagaaattcatattgattgtttatttcttccaaggatcaaaataaaaatataatatttaaagacatttttagttttgaagaattgtcatgaatattcattgctatcaactttttaatattaatacttagcttttggttattatagtaaattatggtttaaaatattgtcaaacattgtcgcaagtgttcattttatattttatcagatttacagcatcattttcaaaaaatatatgtagatatctctatatatgttatatatacatttttaaatttttaattgggtagggtatataaaatggtctttctaaaatttcacatttaggaatctatgataacaacagttttcttcatgcttccataaaaaaaaaacgattgggaactaaggatagaactccttgcattttccatcagatggtactgattcactatactgtataaaagaagaggaattttttcagatttaaaaactcaggagctatatgctggaaaatacatatagtatacttcacttatttaaattaaaggagtgtttaatttataaatgaaatcttacctaataaaggctttctttttatattttgtttcaggctcaggagatatggacagtatttccaaggtgagtgctgtgtattctgtgttgtttttaatcagaattttatttaacatggaactcattaaaattattagagtaaatttacgaattttgttcttgaacaagagtttgaaagtagaagaccaggtataattaattggaagttaagaatattaatgcatattatctgtgggaaagggtaaaataagtcttttaagaatgttcctaaatatgctaagattcattaataggacatactatacattattagttgacacccaagtaataacaaatttaatcacattaagatgttacttatttgtaaagcaaacttacagaatttagataatcttttgaaaatgtaaagatgtctaaagaaatgtgaggagagataaatttgaaaaagtggttattatatatcataaaggcattgcatttacgtatccaattcatcttgcaaatcttcattaggaaatgctgatttccacaataattattctagtccccaaaatagagtaagaaagtgattagaggaaaattatattcgtacaagcaggaaagtgagccttccattagtatgtgtttgcattttccctctttcaatagtttgagtatctaaaatgaatcctttactaaaatgccttatatttttgaagaatagttcctaaatactatttaggtcatgatgaatttaaaatagttctcagtgaatcaaatatatttagaattactgatgggaactaattatttgctaccaccagaatgattctcttagaagtctgctctatatcaataaatagagaaattcattaagggatgactttttgaaattctatttctaatttatatttatgtataataatgtaaaattcctgctgccaagaaaaataaaataagattgattgagctaaaaatcattttaaattaagacttcaagttctaaaaaatatttaattggaattctggcattataactctactgcctggctgctttgcctcacaagctccacatgtattttggatgtctatatttagaaacaatcatgtttacaaaaaatcagaaaggtctttttttttctaaaaatagataaatatttataatgagtactagcttacctttgtgagaaatggtatttatgaggcctgttttcaaaacaaaattgcctatgtaactttattagagccttctctctgggcctttgcaagtcagattaccatgattgtgttggctctcagatacctctttttttttttttttttttttttttgatggagtcttgctctgttgcccatgctagagtgcagtggtgcaatctcggcccactgcaacctccccttcccgggttcaagcaattctcctatctcagcctcctgagtagctaggactaaaggctcataccacgaagccttgctaattttcgtatttttagtagagatggggtttcaccatattggtcaggctggtctcgaactcctgaccccatgtgatctacccgtctcggcctcccagagtgctgggattacaggcgtgacccactgcacccagcatctcaggtatttctaacaatttaattagccaaattgtgctttgtggtcaccagtgaaatttctgatgccatatttgagaagcatattcttgtatctacagatggattcttaattacagaaaagtaggatcatcaagatagttttaggccatctccctaaaatttttactaactacctaaaaccttttacataagatagatataaacaaaattctgtatgggaaagtactttataatttataaaagtttaaaatttttaaaaagtcataatgattaattaaatgccatcttctaatctgccctcatatcagatcggttgctattccttctgtgcttactttcccatgcctgttttcggatacaagtttttccaccataccatgcccactcctcataacattctcttgcctaatgatgcattgcttgtgctctaagcagtaactgaccatccagtgtgtacttgtgtgtgctgggtattgccttctgcactatggggacatagaaaagtcttcttaacaacaaacacgatctctgtcctcaagtggtttattcttaggcaggagttccttcattcagtaaatgttgacgcctactgaggcattatgctgggctctaaaaatccaaagataaacaagatatgttctctgccctcaagaagttcagtttaacgaggagatcaaacgaattggataaataaaaatttttacaaagcaaagttaatatgcatttaaattacataagatttatccccctagtcataaacatgccacttaacaatgtgctagaattgactagttaaatctgccttcaaatgagttcctacgcatctcatttctacaccacctctactccaggttcattggctctgggctctaagctggccgacccctgggtgatagtaccattagtgcctgttgcaccatagtcactttttctcttaagagcatcagtagcatcgtgcacattgtataccccctgccccagattctttctctccctgcctctttccactcccagactgattttttcagtctttgactacgaggtatacacagtcacagtcactaactcgcttttcccacatttcttccttttccaacacatgttcagctatctcaagaagctttcttcttccttttgttttcctggaatcatttcattatcattcatttccatcctgtttttttcgagtaattttgtttgtgaatcaaaagacagccttgaccattatcacttacttttttgtgtcttttttttttttttttttttttttgagtcaagagtttcgctcttgttgcccaggctggagtgcaatggtgccatctcctcggctcaccgcaacctccgcctcctgggttcaaacgattctcctgcctcagcctgccaagtagctgggattacaggcatgtgcctgtagagacggagtttctccatgttgtcaggctggtctggaactcctgacctcaggtgatccatccacctcggcctctcaaagttctgggattacaggtgtgagccactgcgcccggccatcgcctggtaattttcaaagtccctcttaggtctctagccacagctctatagttctccagttaaatctgtattttgtcaagcaccagtatcacatatttttaaaaaaaaaatttactccattttaaatgttgtgtataagtactacttcaattgtttttctactttttattgcatagatactccattttatccattttatatgtaagataaataaagagtactgaattgagaatcagaaagcctgatgctactatagtacttacaagttgcagggacacgttacttaatctctcataggcatagtttgcttagctgtaacataaagattttagttcattccctgcctacttcataaaattgttgagaatcgagtgtgaacatatgttaagggctatgaagtgctatacagacactaaatatctttcttctcattagctatacaatcttttgtggacaaggctaggaactcacactatcaattgcacttggatggcactgtttcagtaagcaaaatgaattcaaagcttccaatgaagtttcaaaattatttcttgctcagttgagcattacctagtaaaactcatgtgcctctttctcagaatgcagaatttatatttgatttagaaagcttttaaagatgatatatgaaattcctttcagccctttaataactgaggggtcacccatttaatcaatgaaacaaaaatccttttccttggagttggggttgagggtagagagaagtatatggtttgttttctttctttttttttttttttttattgatcattcttgggtgtttctcgcggagggggatttggcagggtcataggacaatagtggagggaaggagggaaggtcagcagataaacaagtgaacaaaggtctctggttttcctaggcagagtgtttgtgtccctgggtacttgagattaaggagtggtgatgactcttaacgagcatgctgccttcaagcatctgtttaacaaagcacatcttgcaccgcccttaatccatttaaccctgagtggacaccgcacatgtttcagagagcacagggttgggggtaaggtcatagatcaacaggatcccaaggcagaagaatttttcttagtatagaacaaaatgaaaagtctcccatgtctacttctttccacacagacacagcaaccatccgatttctcaatcttttccccacctttcccccttttctattccacaaaaccgccattgtcatcatggcccgttctcaatgagctgttgggtacacctcccagacggggtggtggccaggcagaggggctcctcacttcccagtaggggcggccgggcagaggcgcccctcacctcccggaaggggcggctggccgggcgggagtctgaccccccccacctccctcccggacggggcggctggctgggcggggggctgaccccccccacctccctcccggacggggtggctggccgggcagaggggctcctcacttcccagtaggggtggccaggcagaggcgcccctcacctcccggacggggcggctggccgggcggggggctgactcccccacctccctcccggacggggcagctggccgggcgggggctgacccccccacctccctcccggactcagagtctcgctctgtcgcccaggctggagtacagtagcacaatcttggctcgctgcaacctctacctcccaggttcaagaaattctcctgcctcagcctcccgagtagctgggattacaggcgcacaccaccatacccggctaatttttgtatttttagtagagacaggggtttcaccaggctggccaggctagtctcaaactcctgacatcgtgatctgcctggctgtgccttccaaagtgctgggattacaggcatgagccaccgtgcccggccggtttgttttcttagaagaaaagcagctaaggaaattctgcagttcgtattaacatatctcacatttatatttctgagtttgaaaaacacatgtatgtgagaagacaagctctgatcatatcatgtttaataaattaccaagaaagtattttcaacctgaagcattctgaccccaagaattttggctccagttagagatcctacaccattcacaagggagctggtagatgactagagatctacaccatcatctcatgtgtgctgacctgagttctagctcatttgtgcccactgggagaatgactgacagtttgttctttgagggagctagcagagtcaaaacaacactctagaaaactcactattggcagcctgtgagaaagcaattcaaaatccactacttagaataatgtcattattattttattctaattacaggcagagccacagtttctataaatgttcacttttttaatttgaaaatggaaaaatttaaaattttaaaaagttttaaaaggtttgaaacaatttttgaggatgggagaagggataataacttactaattaagagaagatatgagctgggcacagtggtccacacgtgtaatcctagcactttgggaggccaagtgaggaggattgcttgagtccaggaattcatgaccagcctgagcaacatagtgagatctcatctctgcagaacattttaaaaattagccagatgtggtagcacacatctgtagtcctagctacccaggaggctttggcagaagcatcacttgagcccaagagtccaaggctgcaatgagctgtgatctcaccactgtattccagcctaggtgacagataccatgtctcaaaaaaaaaaagagagaagaagatatgtaatacctgctagaagaaatcagaccaggaagtccaacagggttaaacatggcagccagaggaaattgtgtttgtggtgtattatgtgtgtgtgcatatatgtgtgtgtgtatatatatatgtatataaatattcatgtgtgacatcatagcttaagagaatttccaacttgaagaaatgataagtgagaatgtaataaaatttcttgaagttggtatcagtataatcctaaccatattttttcaagcaaaactcttaaagtagggaataaagtacatattcattgaaataactgtaaccgatgggcctaatgtatctaaaagtaatcttgtactcttttgtgctgaagcaagtagagtgcctttttgaccaacctaagtcctttttatacatcatattcttgccttattgatgaaacctactggacataatacacaaatacagctacagttaaatgaagcatacacacaattcattaccacctaccctcattacctgttctgggatggtttttggtaccgctatcttagctgtccctcagatgccaatattgaatatgccctttagcccatatcatcatgtcactcagcgattacggacagcacaattttcttaagatttcccattgaggagcttctgttgttttccaattttgcagagattactctagttaaaaacaaaccaaaaaaacccaattgtcctatcacttcaggcttttcaaatacggtccagtaggctgaataggaataggtttcagagatctgattttatctcagttttgtatgttgaatgtatcctttcaatcttcctgttagtgtccttaaatacccgtccccaccacacatacacacacacacagaagagtataatgctgagccaccatgctatgaagaggttgcatgtaaaacagaaataataacactggaagtattttgtgtgtatttaaacattagcaatgcaatgttactttcaaattgtaagtatttaaaaatcaatattttgagttaggaatcaggtttgaagttagccagactttcagaattataaatcaagaaatgatatatggcaaatgtgcagcaaagatttaaagcaccctaactgagtctgagatacgctgcttctctcatggtaccttatataccacagggggtatgaatgttacacaagaataagagggttcattttactcttttgtttgactgtgtgaaatatgcagcttccaactgcatccttgaattttcttatatatgtgtgtatatattagattgtattttattctagtattaccaatttctccattatatataaagtgacagaaatccaaaagaatttataaattataagtaaatcttacaatattttttataaattcattttcctttttgagctaagtcagcattatcattcctgttttcaaggtacagtttatttaacctaataactttaataattaatgaattctaaaataatgcagttagttaaattttacttaatttttttcccaggaaatcaagatattcagattcatttcaaagtatagttgcttttctatatacttggataactaacatttttcagagaaaaatttgtcaaaaaaaatagaatcctctttatgctattaaagtatatttcccaagtccttggggtttcttgacacagagagctccaatggacttcagaggatccttgttctcagatcctccctgcggggtgcacagcaagacaagacacagtgtatttctaccagctcatctatctatctctgctttacattttaaccattttcttctgggaataactcattcatgaaatgttaatttttatgatacaagttgttgtagttaagacaaaattctctgagcaattttctttaaaaaaaaatctaaaaactaattccaaaacaatgtaaataggaatggcttaggaaaaagtaagccagtaagtaagtaagttatttcttccatttgaaataacaactaaaaaatgtttaactctgaagtttttttttacaagttaatgaattggaccttcaaagaattacagttatactactgtataaacatggtttatagtccaatgtcattctacatttcctattgatgtggagtatcaggtatcctgccatggctaaaattgtgcggtaataatgagactagcaaatttaaatagaatatgaagcaacgcactgctaacttggtgttcgattagattgctaataacagtcattttatcttccaaggaaagttccaaagtaaatctactcttaaactaatgataggaaaatattctaaagcagttttcttttgagcctccttttcctctaagagtacataataaattctcaagtcctaaggtgtctcttgttcttaagtacagttgttagctatctttcttttttccttaaagttcatgtaaaaatggttgaaatagtgttatctgtatactgcatgtagaattaaaaggaaatgtttattaaaacagtgacctttcaaagtttggttagtgaaatgactaagggagttattgttccatcttgccttatcagtgggtaggatctcttcatcatgcccctgctgggaatgttttaaactctccagtgttttaggaactctataagctgagggtgggaaattgaataaatattgattctgaagctaagaaaatagttgtggtaggttattgggggtttttttatttttttttaaattttcatttgggaaggcattagtacttgtcaaagtgcaaagaatgaaatagaatacatggtagaagtctaagattaaaattagaagtatgctttgtccttagggatgctgtttcaatattcgaaacagtacagtgcaagagggaaattaaaattttcaacaatgccttgttttctaaatcttgtttacagaattctcccaataatatgagcctgagtaatcaaccgggcactccaagggatgatggcgaaatggggggaaatttcttaaatccttttcagagtgagagtgtaagtattcccttgactatattatactcaaattttatttctgaagctcttctgctagaataaatgcataaagccacttttactgctgtttatctagagttcaacaggtttatcttttagataagagaaactttaagtggaatatctttgaaaataatttttaaaacaaactttttcttttttattctgtgtacatagttagaaaaaccataataatagttttctcattgagaacctccactgtaaaggaacaaactggaaacaggttgcctatttgatactttttataagttttcatgctactaaaatgtctcaggttgctgcaaaactaggtgtgtttcagtgctgtcctcaaaatctaaaaagtctgttcttactttatatagtagacctcactggactgaaggccaaattggcggtctgttaacctgagctgaatacccaagtcactgcttgcgtgtgattgtactgttacacaaaagttcattccatatctccatagaagtagacagaaccaaaaagagaagcaataaaattcattcatttaacaagcaattactgagcacttaccacatgccaaggcaatatgctaggtattggagagaccaaaaagacaaaatggtgccttttctcaaggagttctatgtaatataatgattttttacattaatatttcacattagaaaccccaatggaattttttaaaatacagtttcccagaactctccctagacttagtgaatcagaatttccaggagtggagctgggcatacttgaatgtggaaaagctttgttgctgatgctggtgtacattctctgctaagaaccactgaactggaatgtagcataaaagatttcaaaacccaaatgaatttcatcttcacaggattcatagcatccttaaaatttcttacggaggacctaccaaactgcagtcagaatcatgagagagactaccctcattttgcccaactcagcatttaccagaggtgataccatcagaatttgaagcactggctaatagcacgtctacctttatacagagtggctgttccattcccaaaacagaatacaagattgagtgctctgtggattcttgtagttctgatatccacatgggacctttgcaggggacaagacatcccctgtttttagagttcgtttctgttaaaattatgctgatctgtagtttacttgcaggcaatatatgattagtgaggacaaataattttttatgtgtaacagtttacagttgaaaaaaaaatttagcctgtcagtgttaaggaaaaacatgagaagctacataatttaagtcataatgcttaagattatgggaattattttttagatcctggttctttgagtggtttgcttcaaaactatggacaaattaatttttctatgttcacttttatctaattaaagacatttatttccttttcgagtaattttaccagcaataaagtggtataattcagtgaggtatttgataattcaattcagtttaacatttattgagcctattatatgcaaagcatcaggttaagaccaaggtattctgaaataaatataacacctactttcaaagagtgcaacccaataggaaaaacagatgttgatataactaaaacgtgtcagattaatgagtgctgtaatgtatatataagccatgtattttaaaagtcagaggaaatgattaatttggagttggaaaaaaacttttttaaaaagcttccacatgactttcacttatgggcagtgacaagaggaactcttccctctacttccttcccagatttgtcattagtgactgctgtcttaacagttggaagaggggtaccaattcagaactggcatcagaaagctcttcactggggcaaagattcagatatgccaggatgtggagaacttccttgcacagaataagccccagcttctcccttcaatccctaatggactatgcacatggcaaacaacagattcttctgtgaatatgtgcatttagaaacgagagcagctggaacaaggcttcttccacccctaacttctggctcaccctccctgcccctgaacttaagcgggttcaatgctagactgccagcagagttaacagcaaacagaagttccctgctttctcttccctccttgtctcctgtccccaccagaaatgttgtaaaaggaaaaataatttgatggtggactgagaaactgcaccaccaccctggagggtagtacagccttggaagcaggtacacactggcttctccattcttctgtctcctgagaagaagggacttgttatgaatgatatcattgttatgtgtggctttctttgtcatattactatacatttttgtttagatctttttataaaatcaagcaataagaggagagaggaagaaagacaaaagagatttggtgctgacaaatgtaaggctttgaagaagtaaataagctagttatccccaataagttagctttgctataatcaaggaaaagcagaactcttaatgaattcaaaaagaaaacattgttcaataaatgaacatgcaagttctagtgtttaatacacataactctgaaagcacatatttttgagcagtctgccttttaaggatctgtcaggttttatcttgaagttaaatcacagaaggaggcctgggaagggagcaagtatctattgagtactctttatgtactagatactatcctagtctcttcacactcacacatgctgcttcattcaattaatatagaaacaaaaatgcccagcccaaagtcataaaccttgcggtgccaacatgcttgacaaaacaaaatgcgaatcaaaaaatgtttcactgctgaggttttttttttttaagatcacaaccaagaccctttatttcaagaaacaaagatgccccctagtgttcaaactgtaaaatgtttgttttggaaagtatagactacaaaaagccttagttcaaaaaaaatagtttttcatgcttctcaagtgaagaaagtagctggtctggtcttatttcctgaattaatttagcaaaatattttcccatggcactgaaatataatcaattgagtaaacatgatattaaaataatggcatcaaataggaattacaaacaagatggtagattatctctcattcccttaccccctttgtcattttctgctattgtaaagaaatcacatcagccccaattttttaatgtaatcataaatactaaatttatttcaatttatgtcacttttgtttagctcagggtagaggaactgttctttatttctctctaagaaaataaagtatcatacagacacttaaacagaaatatagtgagaattaaagtgttcttgacatgtataaacagaaatttatacacattgttcaaagacttcatggaaatctctggattttatggtacatgaactgggcataataaggaaaaaatcacaagttcatagcaaggcgtgctatctcatttcacattaaaagataaaataagttggtatacatttaaaataatatctttaagggttacatttttaactgaaccaaactgtaatgctgttgactgctttgtaagagctgttttatcatctggttagggagagccagactcagaatagttttgaaacagggcaacctgatatcacagcattttggcataaacattacaatatgtcatcacatattgatgcagcagtacaatagaaacattgaagtgtggtctcagtacagtacaccatgaatattttatgtctctaaatatgatactccatttaacacctactcttcctttacttctggaaaattgtaagccacttctctactactttgaagaatagtaatctatagcaaaattcctttttgcttgcccattctgtgagttttcctagaaattttgttatttccccttatttcattttttgaagtagtttcagtaatggtggccaaacatgagcattttacagcctcaggagtgtaaatagcacgttgcatatgtagacacccaggcataaatacaaactattttactgtactaaatatatttagcataccatcttacagttatttgtactactcaaaaattaaactttattagatggttgctcctttttcttttctttctttttatttatttatttatttatgtatttttgagactagagtctcattctgtttcccaggctggaatgcaatggtgcgatcttggctcactgcaacctccgcctcctgggttcaagcagttctcccaactcagcctcctgagtagctgggattacaggcgtgtgccaccatgcctggctaatttttgtatttttagtagaaacggggtttcaccatgttggtcaggctggtctcgaactcctgacctcaggatccacccacctcggcctcccaaagtgctgagattacaggcgtgacccaccatgcccggccagttgctcttttttctgagttgttttgtattgcgtggagctgatgcttccattttgactgaattgggccctcattttctctattttttcactcagtttcctccctgggccaacctcactcttttaacttcccaacaaatcagtaacaaagtatcatttttctgtaagattgacttaaaacatttgaaatatcacagataaaaaaatgttaacagttgccagtgttgagatgatagcaataaataaaaatggttgataatagagtatatgcgtatgtatagcttgacatatatacatactcttaacaacgtatagtataatgaaggctattctatattttcaacactatttcctaacataacctgacatatgaatgaactggaataatttttttttttttgagacggagtcttgctctgtcacccaggctagagtgcagtggcacaatcttggctcactgcaacctccgcctcctgggttcaagcgattctcctgcctcagcctcctgagtagctaggattataggcacctgccacctcgcctggctaactttttgtattttttagtagagacagagtttcaccatcttggccaggctggtctcaaactcctgacctcgtgatccacccgcctcagcctcccaaagtgctggaattacaggcatgagccaccacacccagccccagaaacatttttaaaaagcatttcctttgaggtcctttctgaaatgcttagtatcttttactggtttatattattgacacagtatactcaataagatctttgttttaaaagaatgattgattatctagctgccctattaattaaaattacatacgactaaaatttcagttcctaaattgtactagctacatttcatgaactcagtagcaacctctggctagtggctgttgcagtaaacagcacagaattataacatcatcatcacagaaagttatattggactgatggaatcaccaatatttattgtaaataacagtagctgcggaaagcatagattaaatttatctgtgcccattttgccatattctctgattttttctactctagtaaaatcttgctaaccacttattttctttttatttattcttgcctctaaacttttaaataccaaagtatagttctgtttagccgcaggctctggatagttgaagcatgctgtcattgtttataatgtgagacgtggaatcacattatgtgcatggaatcaattgagtaaacatattaaatggtatcatgtttgtgatgatgaaatggtgggttgaaatgtgatgtgatgaaatggtactctgttcccctctgacacagggtcagggatcagttccatgtcatcagcatttgtctatgactggaggttttgctttgctttgcttttctgctgctatgatcaaggggagaggttgtctaaactgaatctcctttcttgtttctggcagtttccctctatttttttttctcctatgacctgtctaaaagtctccccttcttatcaccatatactcactataatcctacatacaggatcagttcaagtatgtaatttcactttcctgtactgaaactctgtaggctgtgaagtgattaacaagtattaatagattttccttgatgtaatgcatgtttataggattaaacaatcctcttcctatggtccagtgacccttttccaggcctaatcacccacctttcctcaggaacagtgcatgtttttggtttgagccctaatgacatctggcccagacatgtgccagctgagccattgcccctctgtgctcttccctggggagtcctgctttcacactataatccatccatacatcagtacacacctatatgtctttctgatttctgcagccggtctcagcttgtctataattcacttcattttattctctttctgccaactttctgaaaagttcgtgctcgcctacccaggattatcacagcttctggttaggttcctggaacctgggaccaatccctttgactttatctgcctttttctaggaggcacaattgttattagcatgttgaaaggaattgccttttaccctggtcctcataggtttccaataaaacgtttaaaaaatttcagggtccacatttacattttaatttagaaactgtcttcatccaaagagtaaattaccatgtgggattagatgcttctccccacagctcagatagtctagagctgtgctgttcaaaatggtaaccactagctacatgtggatacatgaataaattaaaattaaataacattaaacatttagtgtcttgattgcactaatcacatgtcatatgctcagtaggcacatatggctagtgacctccaagttggacagcacagaccacagaacaagtatgtctttgaagaaagttctcttgcatggtgctgctgtagaacttttctgtcacagtctattctccaagaatatgagggtacaatggcacaattagcaaaatagttgctctttatttctctctaaatcatttttgaaaccactttttccaaatctctgaaaccctcaccttttatcatttgtcagcctcatcaaactgacaagtccgcatgtaacaatgatgttcctactcacgtgcaaaaatgactggattacagttagagtcacaggccgagcacagggtctcacgcctgtaatctcagcacttcgggaggccaaggtgagcagattgcttgagcccaggagtttgagaccagcctgggcaacatggtgaaaccccatctctacaaaaaatacaaaaattagccatgcatggtggcgtgtgcctgtagtcccagctactggggaggctgaggtggtgggatcacctgagcccaggaaggtcagggttgcagtgagctgagatcacaccactgcactccagcctgagtgacagagtgagaccctgtttcaaacaaacaaaaaagattagagtcacagattatgggcaagatgcttaaatgctgaagtataaattagactcttaagtattttaaatgctttaatgagagcttcccagggccagcttggagttgtttctgttttgtttccctacagtattaacctaacacttgctgagcactttctgtgtattcaataaatacatggtttaaggattttatatctcatcttccccaagcccctttacagatagggaaactgaagtcaagacaggttaggtagcctcctcagtttacaagctagtagacagcaaagactagacctcatacttacttagttatgatccagccttggactaaatttaccaaaggtttttacaagtgcctgcaaaacataaatctgtctggatggagggaggcagagggactgggtaatgatgagcctctgggtgcagggagaggataggacttgatgctttccaggggaaatatttaaaatttcagtactaagttaagtctgtatcattttactttttttatagtttcttattttatgttgtatgagatgaaaagcttgcacataaaagatgataagaaattagaattcatcgtttctgttgtaccaagaagaaccttagtgatctctaaaagaattgttgttaaaatatggattcttctttccttctagtactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaattgcgtctgatgcaagttatcctgtgaatcacaaagtgtactgtctcaaaaaatagaagaaaatgtgtcttcgtcttta

SEQ ID NO: 36484 - DNA, 177638 bp, Homo sapiens
gagggaaggagggagggaagcagccgctgacccgtggcatgagctggatgcggtgtccgttgcaggactagggcgccgacatgaacctgcaccaggtgctgaccggggctgtgaaccctggcgaccactgcttctccgtgggcagcattggcgaccagcgcttcacggtgagtgagggaggccctcgcgtcgcccgtggcccggcctttgcccgtcattctgggccgagcttggcccagaacgacgggcagaggcgcgaggtcttgtctccccaggggggtccttaccacccagaacccagcagacctggcccttgagaactaaggaagcaaaaccatgtcggtcagtgaggtactgtatggagcctgaactcaagttagaatattttgtaggatttttaaagtttttggtctgtctgccttgggccagggtgctttgccaaagtcgtttgttcaaaaatctttgttgagtaacgagttgggggcttttttataccattctataggttcaaattgtcaaatttaggaatagtggagattggtttcattttgtattctaagttaaggtcaagtatctttgtagttaaaaagtgggtgtctcaaaacaattaccaattgtttgccatcaacaactagccttgagaacagtgtttttcatttattttcttttctaattccctgagaaataacttcggaaagaaaaaaaagccttttcatttttaaaaatatttcttggatattttacaataacctggtaatcccaggttaaggttgcttaacttgcttttcattggtcacatattgacaagaagagggcaccaaatttcgggctacttgtcagtatagtggcatttttctaccttaactataggtttttttttaataacaatttcaaaatataagtcagtaattgcacatgatacttttatctacataaatttataatgctaatgatttttgctacaatttgtgtagatacctctttagttgtgattaaaagtaaaacttgtcactgcctgggaatactaagtgctgtaggcttttttctttaaaaaaaataaaagtaaaacttaattttgtataagtgacacaaagtaaacaacgtaaccaatgccccaggtttaggagtgttaaatttctaatctttttctctgcttttaatttttctgtggtctttgttggtcagaataaataatactcagcatttaaaatggtggaggcatttaatgcctgaattgtacttttagaattgtgccaagaagcattttgttttcaaatagagactgtacctcccctttagattgactcatacacatcttaattatcgggattccaattctaaatgtttgcccagcctgaatacttgggaaaagagtgagctctgagggtcccagtgagcaactatagtttccttacacctgggcattgctctctgctcttgctgcttgagaggaaagtaaacatcatccttagaaggttttcctagtgggaaattataggataatattgttgcattctctgtcatttcctaaatttatatgagtgctttctccagtgtaaattctaagaacttttgctttttaaaaacttttgaaatgaggtctccctctgtcacctaggctggagtgcagtggcgggatcacagctcactgcagcctcgacctccccggcacaagccgtccttccaccttaggctcctgaggagctaggactacagattctaatcaccacggctggctaagttttctattttttgtagagaggggtctccttatgttgcccaggctggtcttgacttcctgggctcaagtgatcctcccacttcagcctcccaaaatgctaggattagaggcgtgagccaccatgcccagccctaagaattttttctaagaaggcattcacaatctatgtaagcagtggtgtgaacttcaaagcatatgcagtatgatggcctatttatatacctggatgcattcctctataaaaccttggtgaatgtctgtgtattgtttttaaggagagatcagttaatgtgccgaggaggattagatagatggtcatcctgtaccatcatgtagcttgttgctcagttctgctgaattttaaagttcatttccattgagtaggatttaatctcccaccaagcctactgcagatttcttccaggtctctggaagcattcagtaaataaactaaaaataaatttttaagtataaagagagttcagctctctttagttttgatggaattttaaggatttaacagtcatggttttcctttgcagcctgttcatccttgactctttaagttgcttacgctcattatcctggacacttatatacaccttaaatttttctctcttgaaatcgcccttttttcttctctcatgttaaaaggcagaatctattgtttacttcttgagttgttttgtgttgttttttttttttgagacggagtttcgctgtcgttgcccaggctggagtgcaatggcgcgatcttagctcactgcaacttccgcctcctgtgttcaagagattctcctgcctcagcctcctgagaagctgggattacaggcatgtgccaccatgccctgctaattttgtattttttagtagaggtggggtttcaccatgttggtcaggctggtctggagctcctgacctcaggtgatccaccagtcttggcctcccaaagtgctgggattacaggcgggagccactgcacccagccttgagtgttgtttttaaccttttttgattttgacttttctttgataggaaaatagtaaacattaatggtagatggtatgtgaagactaaaatatccctcagttgcattttacttgaagtggagcatgacatcttcctcttgcagttccccttgaaaaattcttttattccttttggtactttgtgttttcttttaggacagtcctgcttttgtaattcctccctttgcatgtttgcagataacttacgtgttcttggtttgaaagattacaagatgtgagatcttgttttactcataaagcctgacaggttttaaatggaaatgaaactgaatgccacttctcctattttctagatttgaaaatatgaaattaccaacgcagattagtctatttaagtattagatacttttttactacctcatcaggcatcaagctgttttgactttgctcttagtaagaaaacctcttgtgggcaatgaccatctctcctgtgctttcagagcactttctttgcatctttattctatcattaaccagtcttgccttgtggattgtatgtgtatgacttcccacgcttcattgtgagcacctagaacagtgattgaaagagtgtttaaacctaacagtaaggtcattacttggagttgatttccaatgtggtcccttttaattagctgtttatccattagcaagttatactcttggaatttctttttttctcttctgtaaaatgggactaaaagagtattattcatagagttgctacatgaaaaagtgctaagctgtaagtccatggtttagcacatgtaaaactctcaaaaatgtcagttttcataaaattaaggttatatttattgtaatgcctaacaatagaaagtacttcataaatcgtggttgaattaatgaaaaatggatagagaaaccttatagtaatataaatattaattgctacatttaaaaatagctttaatcatttagatttgagtccaaataaaatattcctgttagtttctttttttttctttttttttttttttggagactgagtatcactctatcacccaggctagagtgcagtggtgtgatctcagctcactgcaacctccgcctcccgggttcaagctgttctcgtgcctctgcctcccaagcagctgggattacaggcgcacaccaccacgcccagctaatttttgtgtttttagtagagacgggtttcatcatgttggccaggctggtcttgaactcctcacctcaaatgatccgcccacctcggcctccccacgtactgggattacaggcgtgagccaccgcgccctgcctgttagtttctttttcaaagtcagttgttaggcattttatcatcaacaagtgagcaactaggggagactttaggtatgctaagcaaaaattatttattttttccttatttactggaatgcttccttcatgcctttttccttgttaatttcctactgatcttagtatgtgagaaatctggtcttttttaaaaaaaaaacaaaaaaaaatggaggctggggtctccttatgttgcccaggctgatgtctaactcctgggctcaagtgatcctcccgccttggcctcccaggctgctgggattacagacgtgagctgccatgtccaccctgcaatttttgcttttagaattaaatgtattctgtttataaaaggcaacaagttaaaaagaagactagttaattagaatctacatttatagattctacttttatgcatactattgatatgatactttttttttctttttcttttgtggtttatctatacttagggttgaaactgtgatttgaatgatatggaaagggagataatttccaagagacagaaagattgtaccaatatataagactaactgtctctgatttggaacttaaacatcttagctatgggagggaaagcaaatatgttatagctccaatttccctttagtattagaaaactcagtgtttctagctaagggaatctagattagaaatcaaaagactgtaattatgtgagtgtcattagagaaatagggctgaataagtagtcgtcttcagctttctgtaataagcatccttgagtttagctctgttttgtttactttaaggaaacctttattggtagaagtgtaattgccaaattgggaggatgggaaggtgtttgttttttttttctgaaagggggcatgtgaatcttttttggtggggagaatatagaagggcaaagattgctactattcacatgtgaagaaagagaaaggtgtttgtggtgcataaaatattgcaagtactaaagtggacttcaaaatatgttggcctgttttaaaacataaagttttacagtgtttaagtacctttaaaatcattgaaatgatagtagttctcaatactttattatattttaaagataagaattgctgcatgccaaacttaaaacctatgtcatttaaataggacatataccagaaaggaattctttgggggtgtttacctggttttgttgattaaaactagaatactgactgttacagccttgaattttattgaaatttagaatatttgagaagattctctgccaaaatttaaagttgaaagttatattttgattatatgcttgatagcacacatgtgactcaattcttcctgtgcatcgtgtttattcttaaagttgataaacctaatgttgtatgtgcctaatagaaggattttcatttgtcaatttaattttattggttagtaatagattattctgattacagatcttttattattttttaattaaaacatttttaaataaaaagagatgggggtctcactgtattgaccaggcatgaccaggaactcctggcctcaagtgatcctcccatcttggcctcccaaagtgctgggattacagggatgaaccaacaggcccagtgctattttattttatttttttgaggcaggatcttgttatattgcccagactggtttggaactcctgggctcaggtgagcctccctgtgattacaggtgtgccccactgtgcccagtgattatagatcttttgacagaagcagctggtgacatcgacagtttatttgataagccagtgctgctattattgttttgataaccttctatattatagtcagggcaccttgaaatgagtttttgtgaataatttattttagacatctgtaaaaccagttttacattttgatttagaagtttcatgtattgtattacatcttcatcttaggttttttttttttttttttttttttttaagacagggtctcactctgtcacccaggctggagtacagtggatctcagctcactgcagcctctgcctcctggcctgaagcgatcctcccacgtggctgggaccacagacacgtgccaccattcctggctttttttttttttttttgtatatgtgtgtgtgtatatatatgtgtgtgtgtgtgtgtgtgtatgtgtatatatacacttaaaaatatatgtatgtgtacatatatacatttattttttaagtgtgtgtgtgtgtgtgtgtgtgtgtgtgtgtgtatatctgtacttacctggcgagaccctatctgtacttaaaaaatatatacgtgtgtgtgtgtgtatatatacgtgtgtgtgtgtgtgtagatatatatacacacacacacacgtatatattttttaagtacagatagggtctctccatgtaacccaggctgttttcaaattcctgagctcaagcagtccacctgcctcagcctcccaaagtgctgggattacaggtgtgaaccaccatgcctgggatgttttaggtttttatttaaaatcaggtagacggattattttttatttaagaatttagtggtacaaggattattttaaaatcatgcacagcccattctgtttcatttatttatttaaaacaagtttttaaagatgaggtcttgctgtgttgccagggctagtctggaacttctggcctcaagtgatcctactgcctcagccttccaagtagctgggactacaagcctgtgctgctgcacctggctcatattttcacttttattttcacaaactttctagtattaaggagaacattgaaactggagatttagtatgcccttttcttttagaaatgagaccatttatatggacttggagcttgaattatttgtccagccactgatgcctctgttcttagcacatatttgtgagatatttattttatttatttttttgagacagagtcttgctctgtcacacaggctggagtgcagttgtgggatcacagctcactgcagcctcaatctcctaggctcaatcagtcttcccacttcagtctcccaagtagctgggaccacaggtgtgtgccacaccatgcccagctaattttttattttatgcggagatggggtcccactatgttgcccaggctggtctcaaactcctgggctccagtgatcctcccaccttggcctctcaaaatgctgggattacagacatgacccactgcacccagtctgtgagatattcagatcaaggagttcctatcatgcctgtgttgcaagatgaagataactatatggaaatcagactttaattcttgaccttattacctgttgtttcaccgttattgctacacattttaactttacaatttatataatttagcatgagttaatttagcaacagtctttgttgccagtatcctttaactgtctggaccctttttgtttgcgccagtctgatgaaattccacacacttgatcagtctcatgttctttcttgttcctgtatatctcatgagcactactagactatgtaaagaaattcctgtggaaaataaagtcatgtttgccaacctcaaatgggacctcaaagctttccaggaatcctcccaccagtctgctcatttttcctttcttgtaccttctgaaacctcccatcccagtgctctcttaactcatataaacttgccacctggaatcattcagatggcagctccctcatttttgactacaagctgaaaaatccacttatatcagcatccattctttccttctctcctcctggtacaataaaataaatgtcccccagaattgtccagggttaatcagtcttcttggtgccgtggatcttatctattcaggctgtctctgggagctcagccctaaagttatctctacttttttctttccagagtttctaaaacatgcttaaaattctcatcttgaaaaacagccaacctgaaaatcctttgctgccacatccctctttatctttgacttcaaagtccttgaattgtctgtatttgttgccacttttatgtcctgctcacttcttaactcactatactttggcagcttttttctccttagtcactggtaaccacattgatgctaatttgaatcaacagatctcctttgtaccttgctttctctttggcatttgtcatgttgatcattttctccttagtcactggtaaccacattgatgctaatttgaatcaacagatctcctttgtaccttgctttctctttggcatttgtcatgttgatcattttttccttcactttccttggcttagttataccatactcgcccccaaccccaccctcttagtcattctcagtgttctttgcaagatatctttcttgtctgtcccttaaatattggtgaccgtcaggcctaccaggccttggtcctcttctcgtttcattctacatgcagctcctggtgtatagtctgtgatggtgagatccctgtctttagcttcatattgataattttaaatacctcttggattgttccacttgaagttgctacaaataatcaattttaaaatgttctgcacgcctgtaatcccagcactttgggaggctgaggcgggtggattgcttgaggtcaggagttctaggccagcctggccaacatgatgaaacctgtttctactaaaaatacaaaaaattagccaggtgtggtggtgggtgcctatgatctcagctactcgggaggttgaggcaggataattgcttgaacctaggaggcagaggttgcagtgagccaagattgtctcgctgcactccatcctgggcgacagagcaagacttcgtctcaaaaataatataagtaaaataaagtgttctatactcagtcaactcccctaccttggtgcaccttccaacccacaccccaatttgttttgttcgtcctcctgtgttcattatctctgtgaatggttccattatccagctggttttttttaagccaaagatttggaaatatccttaacacctaatcctcccacatttttcttatacaatcaatcaagccctgtagattctgtctcctgagtaattttaatatatttccacttgtcttttcagtagtgcagttactctgttgaaatagccttttaacctctgtccctgtatttaatcatacttgtcttcaacttaaacaatattgccagagggaatcattttaaaaggcagattaggataaggtatgaattcttcccaatgcattttactgtacttttctagtctctcatcacttttcctcctctctgtaatagctgcctccctaaactgtagctatatctaacgtctttccatttacacagtaagaaacgctttcttattttcaagccatttcacaagctcttcaggaaacttttcaattacccctccctaggcaaaaaagatgtaaatctggctaactcatccctaaaggcttggttttgatgtccctagtcagactagatgatcttcctatttgtagcctatcttataattcctttttcagatgttacccactagaattgtactacctctagggacagtgacttcatattgcattccaaacagctggcaaggtagggcctagtaaatacatgaggacaaatgggacaaagaaaacctgtgctggagtcagaagagctccaaggactaagctgtctgttctgggcaaggcaaagaagacagctgcgtttgggctgcctccccttcttcactcccagcttaaaatcctcaaaaagtcaaatccagatgacttcttggaaggccttagggtaagaaagtgtcatttcagctttctattcactccccacagaaatagcactcttccttgattcatttaactaacatttattgatgccatatgtgtgcgaggcattgtttattggtagctaaaatctttacctgagtcagaacctttttaaaataaaacatattttaatgtgtaaaaactgcttgagaacatactttgactcaaacatcttcacacttaagtcaattaacaggtatatatagttggcttctggttaagttttgtttttataggaggaataagaactcctaagtgttggatgcaagaagtgtagatgagaagttaatgtgaagaagatatagagccgcagaaacaaagattgaagaccaacttagactttaccaattttaaccagaggtacccttgcttaaccttttcgttttaactaatggggacaaattgagactgtgcatggagaattttgttcttacgtgtatttgaaggtagtttttggccataagttataaaggttttaagaaaagagttcctttggaaataaaaattgagtttttactgcatttggggtcctgctatctaaaaatatgagaaagaattacgaataaacatgattcttgcccttcaggagcctgattttattgttgtctgaattgattgctgactgtcataactatttcccagaggaagttttcttaaggttatatatatatatatatatatatacacacacacacacacacacacacacacacacacacatacacgtatatacatgttcttagaatgttttataaaatcaatttttattttatttatttttaattttttttagagacagagtcttacagtgtttcccaggctgcagtgtagtggcgcagtcgtaactcactgcagcctcaaactcttgagtttaaacagtcatgctacctcagcctcttgagtagctgggactacagacatgtgccaccatgcctggcttattttatttttttagagacagggtctcactctgttgcccaggttggagtgcaatagtgtgaactcagctcactgtagcttcaacttccttggctcaagtagatcctcccaccgcagtgtcccaagtagctgggacgacaggcatgtcccaccatgcctggctaatttttaaaattttttgtagagtggggtctcactgtattacccagactggtcgtgaactcctgggctcaagcaatcctcccacattggcctcccagagtgctgggattatttatagatgtgagctgccatgcctggccttattttattttttaattgatgcctaatagatgtacatgctttcaaagtaaatgtgataatttaatacattcatataatttgtgaagattaaatcactgtacttggcatatccagcaccttaaatatttgtgtttatgctagaactatttgaattcgtctagctgttttgaaatatacaatagattattgtaaactacatttacagtagtgatctgtccaacactaggtcttatgacttccatcaaaccgtttattagttccaattattcaacttctcttcatcgtctcccccaacctccttagccctctggtaaccatcagtctgctctttatgagatccacttttgtagctcccacatatgaatgagaacatgtgatatatttgtctttctgagcttggcttatgtcacttagaatgacctccagttccatcctttttattgtttgtttgtttgttttgtcagagtctcaaaaaggctggaatgcagtggcatgatcttggctcactgcaacctctgcttcccaggttcaggcgattgttgtgcctcagcctccccagtagctgtgattacaggcatgtgtcaccatgcctggctaattttgtatatacacacatatatattttttagtagagatgggtttcgccatgttgaccaggctggtctcaaactcctggcctcaagtgatctgcccaccttgacttcccaaagtgtagttccatccttgttgctgcaaatggcaggatttcattctttttaatggctgaataatatttcattgtgtacatatactacatttttttcatccactgatgggcactcaggttgattttattatcttgggtactgtgaatagtgctgcaaaaacatgggcacatagatgtctttttgatgtactgaatttcattcttttgcatatatacccagtaatggaattgctggatcatacggttgttcagttattaggtttttggattttttgagatagagtcttgctctgttgcccaggctggagtgcagtgacacaaccttggctcactgcaacctctgcttcctaggttcaagcgattctcctgcctctgcctcggagtagctgggattacaggtgtgtgccaccacgcctggctaatttttgtgtttttagtagagatggggttttatgtgagacaggctggtctcaaactcctggcctcaggtgatccgcctgccttggcctcccaaaatgctggcattacagccctgagccaccgtgcctgaccagtttttaggtttttgagaacctgcatacagttatctgtagtggttttactaatttacattcccaccaacacagtaccagggttctcctttctctgcatttttgagaacatctgctatttccagtcttcttgttaaaagccattttaactggggtgagatgatatatgtttatagtttttatttgcattttcctgatgatttgtgatgttgaacattttttcatatacctgttggccatttgtatgtcttctttttagaaatgtctgttcatgtattccccccctcaccccttttttttttaagacggagtcttgtgctgttgcccaggctggagtgtggtggctcattcttggctccctgcaacctctgcctcctgggttgaagcaattctcctgcctcaacctccaggtagctgggattacaggtgcacaccatcatgcccggctaatttttgtatttatagtagagacggggttttgccattttggccaggctggtctcgaactcctgacctcaagtgattcacctgcctcagcctcccaaaatgttgggatttcaggcgtgagccactgtgcctgaccttttccccaaaagcgttctttttgcttaaaattgttttggctatttggggtgtttgtggctccacctaaattttagggtcatttttttctatttctttgaagaatgtaatctgtatcagaataccaaaaatactcttcacagaaatggaaaaaacgatccttggctgggtgctgtggctcatgcttgtaatcctagcactttgggaggctgaggcgggtggatcatctgaggctgtgagttcgagaccagcatgtgaccaacatggaaaaaccccatctctactaaaaatacaaaattagcccggcgtggtggcacatgcctgtaattccggctactcgggaggcgaggcaggagaattgcttgaacctgggaggtggaggttgtggtgagccaagatcacgccattgcactccaccctgggcaacaagagtgaaactccgtctcaaaaaaaaaaaaaaaaagatcctaaaattgtcttctgtgtggtcattttaacaatattaattcttccaatccatgagcatggaatatctttccattttttgtgtgtctgcatcaatttctttcatcagagttttatagttttccttgtacaaatctttcacttctttggttaaattaattccagctggtcacaggggctcactcctgtaatctcatcactttgggaggctgaggagggcagatcacatgaggccaagagttcaagatcaccctagccagcatggtgaaaccccgtctctattaaaaatacaaaaaaattagccaggcatggtggtgtgcacctgtagtcctagctactcgtgagactgaggcgtgagaatcgcttgaacccgggaggcagaggctgcagtgaaccaagattggtgccactgcactccagcctgggcaacagagtgagactttgtctcaaaaataaataaataaataaataaataaataaatataataataataattaattctggattttttctgttcttcgtagctattgtaatgggattgctttctgatttctttgtaagattgctcgccattggtgagcatacaatggtgtatgctattctatacaccattgatgtatagaaatgctgctgatttttgtatgttgattttgcatcctggaattttactgaatttgttcatccgttctaacaggtttttttggtgcaatcttaaggctgttctgagtatacaatcatatcatttgtgaacaaggctaatttgacttcttcctttccaatttggttaccctttatttttttctcttgcttaactgctctggccaggacttctagtactatactgaataaaagtggtgaaagtcggcattcttgttccatatcttagaggaaaaatcttcagtttttccctatttagaatgacgttagctatgggtttttcataaataatctttattattgtgaggaatgttcctcctatgcccagtttgttgagggtttttatcataaagggatgttgaattttatcaaatgcttttccaggatctattgaaactatcatatggtttttgttcttggttctgttaaggtgatatatcacgtttattgatttacatattgtattagtctcttcatgctgctgataaagacatacccaagactgagcaagttacaaaagaggtttattggacttagagttccatatgactggggaggcctcacaatcatggctgaaggtgaaaggcacatctcacatggcaatggcaagagagagaatgagagccaagcaaaatgggtttccccttatgaaaccatcagatctcgtgagacttattcactaccgtgaaaacagtatggggtaaaccgcccccatgattcaattatctcccacctggtcccttccacaacacatggaaattatgggagtaccattcaagatgagatttgggtggggacacagagccaaaccatatcacatatgttgaaccatccttgggtccctgggatgaatgccactttatcatggtgaatgatcttttaatgtgttgttcaatttggtttgcaggtattttattgagaatttttgtatctgtcttcatgtgtgatatgggcttgtagttttttgttgttgttgttgctttgtctggttttggtgtcaggataatgctggtctcataggatgagtttggaagtcttcctttctcttcagtttttttgaagagtttgagtagaattggtgttagttcttctttaaatgtttgatagaattcagcagtgaaaccatcaggtcctgagcttttctttgataaaatactttttattatggcttccatctcattactcattattgatttgttgaggttttgaattttttttgaagagtttgagtagagttggtattagttctttaaatgtttgatagaattcagcagtgaagccataggtcctgagcttttctttgataagatactttttattatggcttccatctcattactcattattgatttggtgaggttttctatttccttatggttcaatcttggtaggttgtatgtgtccaggaatttatccactcacttctggattttattgaatttgctggtatatggttgttcataaggattctttttagttctttgatctagttgttttgtcttctatttaatttgttacttacttgggtcttctcttttttgcttagtcaagccacagttttgttgattgtaacttttcattaaaaagtttcatttcattgatctttttttttgtctctatttcatttatttatgctctgatctttattttttcttcatacaaatttgggtttgatttgttcttgtttttcaagttccttgaggtgcattattaggttatttgaagtctttctactttttttcttttttctgcttttttaatgtaagcatttattgctttcaacttttcttagtactgcttttgctgtatcctatagattctgttatgttgtattcccattttcatttgttttaagaaagttttaatttccttcttaattttgttattgatccattggtcattcaggagcatatttgtgaagtttccaagggttttcttactgatttctagttttattccattgtagtgagaaaaggtacttgatataatttctgtttttcaaaaaattgttcagacttgttttgtgacctcagatatgtctcttcttgggaatagtctatgtgctgatgaaaataatgtatattctgcagcggttaggtgggtgttctttaaatgtcaggcctattagatctagtgtatcgtttaactgatgttctttgttgattcttctgttagatctgtctattactgagagtggggcgttaaattctcctacgttattgtattgcattctatttagatctattcatgtttgctttatttttattattttttttttgagacagagtctcgttctgttgcccaggctggagtgcaatggcgctatctctgctaactgcaccctctgcctcccaggttcaagtgattctcctgcctcagcctcccaagtagctgggattacaggcaccctccaccatgcctggctaatttttgtatttttagtagagacagggtttcaccatgttggctagactggcctcgaactcctgacttcaggtgatctgccagcctccgcctcccaaagtgctgggattacaggtgtgaggcaccaagcccagcagtgtttgctttatatgcttgagagctctggtgttgggcgatagagatatttataattgtttatactatttctggattgactgctttatcgttatatagtaatctttgtctctttatagtctgtctttgatttgtagcgtattttatctgatgtaagtatagctagtcaagctattttttggttttcagttgcatggaatatcttcttccacccctttactttcagtctgtgtatgcttttgttggtaaggtgggtttcttgtgggcagtatagagttggttcttttttcttcatttattcagccactctgtgccttctaatgggagaataaagcccctttacattgtgttgttaggttgctgcaaaagtaattgtgagttttgcctttaaaaaagtattattggtaagtaaggatttactactagcgttttgttgtttttctggttgtttttctagtcctctcttcctttcttactgttatcctttgtggttaaatgctcttctctgttagtgtgttttactttgttactgtttatttttaaagtatttattattggttttggcactgtggctaccatgaggctcacataaaacatcttattgaagtgcgttattatcttaaaggtatgacagcttatatctcaaagaatagaaacaaataaaaataaaatgctatactcacatttttggctttcagttgtcttaatttgcctgtttttatattgcctgtctcttaaaaagttattgtagatattgtttttgatagatttgtcttttgggcttcataatagagttatgaataggttacacaccacaattacagtattcttctagatttgtctgtgacttaatttttccagtgagttttatatcttccaaaacaattttttttttgcatattagtggtttttttaatttcatgttgaagaactccctttagcatttttgcaagtcttaatggtggtgaatttcgtcaccctttgtctgggaaatactttatctctccttcatattagaaggataactttgctggctacaatatttatagaagacaacattttgtcttttagcattttgaaagtgtcatctagctccctcctggcctatgtggtttctcttgatgaatcttttgccagacaaattggagctccattatatatgcatatatatatatacatatatatatatatatttttttttttttttttttttttttttttttgagacagagtctcattccatcacccaggctagagtgcagtggcacgatctcagctcactgcaacctctgcctcctgggttcaagcagttttcatgcctcagcctcccgagtagctggaattacaggcgcgcaccaccacaccctgctcatttttgtatttttttagtagagatggggttttgccattttggccaggctggtctcaaactcctggcctcaagtgatctacccaccttggcctcccaaagtgctgggattacaagcatcagtcttgtgcacagcgacttcatttttggtactgccttttttttttttttttgagacagagtttcactcttgttgcccaggctggtgtgcaatggcgcaatcttgtctcaccgcaacctccacctcctgggttcaagcaattcttctggctcagctttcctgagtagctgggattacaggcatacgccaccatacccagctaattttgtatttttagtagagatggggtttctccaggttggtcaggctggtcttgaactccacacctcaggtgatccgcccgccttggcctcccgaagtgctgggattacagacttgagccactgcacccagcttttgtactgcttttaggattttctctttgtccttgacctttgagagtttgattattttatgcttcgggttagtcttttttttttttttttttttttttttttttttttttttgagaaggactttcgctcttgtcgcccatgctggagtgcaatggtgagatctcggctcactgcaacctctgcctcccgggttcaagtgattctcctgcctcagcctcccgagtagctgggattataggcgcccaccaccccacccagctaatttttgtgtttttagtagagacagggtttcaccatgttggccaggctagtctggaactccggacctcaggtgatttgcctgcctcaacctcccaaagtactgggattacaggtgtgagccactgtgcccggccacttggggttagtattatttgggtcaaatctgtttggggttttttggcctttgtctacctggatatttatgtcttttctgaagttttagaaagttttctgttacttctttggataagctttctactttctcttgttcaaatccctcttgaatgccaattcttagatttcatttttgaggtaattttttgtatcttgtaggcaacttcattacttttcttttttgtttttttctcctctgttttttttttttttttctttgagacagagtttcactctttttgcccaggctggggtgcaatggcgcgatctcggctcaccgcaacctctgcctcccgtgttcaagcgattctcctgcctcagcctcccaagtagctgggattaccggcgcctgctaccatgcctggctaatttttttttgtatttttagtagagacggggtttcaccatgttggccagggtggtctcgatctctcaaccttgtgatcagcccgccttggcctcccaaagtgctgggattacaggcgtgagccaccgtgcctggcagtcctctgtgtgtttttaaatagcctgtctttgagctcactgattctttcttctgcttgatccattcttctatggagagcctctaatgaatttttcagttcagcaaatgtatttctcagttccaagatttctgtttgattttttaaaaatatttcaatctgtttattaactttttctgataaatttctgaattgctttttgtcttatcttagagatgactgaatagttgtttccttaaaactattttgaattcttggtcagagagctcacatatcgcctactggttggggtcaggttccttgctttgtttggtgagatcatggttccctgtttgctgcatttatttatttatttatttatttgacagtgtcttgctctgttgcccaggctggagtgcagtggtgagatcacagctcactgcagccttaatttaccagctcaagttgtcctcccatctcagcctccttggtagctgggactacaggcacatgccaccacacccagctaatgtttttatttttgtttttttgtagaggcaagtcttgctgtgctgcccagcctggtttcaaactcctaggctcaagggatcctcctgttttggcctcccagtgttgggattacaggcgtgatccactgtgcttggcctgctgtttcttgtggatgcacacctatgtctttgcatttatggattagttatttattctagtctttggcttgttttggtttatattggatatctttacttggagattcttcactgctaagccactgcccctttttaggctccaggtgttgccttaagtccaggttcaccttggctctagtaaaccatcaaagggctgccgttcctaaagtgaggagatcccacaggaggtatctcagcagagggggaatgctggctaagggttcatgtgctggaaacctgtgggacaaacctcctacagggtggtgttactactgaacagcctctctcatgtggcatctcctttggctgagttatggagcactattttcagggatgcagataataatactgcctgccctctttgtttctccctgtcctcagagatatttctttaggcacttgtgatgcttcttatgggttagggctgggacagatattctgctagagaacccaatatggtggggaagctggctgttcaccataatctccctttttccagtgtagaaacaatgtttggggaaattttctgtgccctaagtgctgggcagaattgggggaggggtgttgtgaatgtggaagtctctttgtcttttttcatttctgaaaattgtcttttttcattcctgtggccccaggaactgtcttgtcttcatatgtgagttctgggttatttctggtgatactttcagcactgtatatttgttttgggttttctttttcttttatttaagaaaaattctttttctttttttttcacatagggtcttgctgtgttgcccaggctgatctcaaactcctgggctcaagcgatcttttctccttagcctcctgattcggtgggattacaggtgcaatgttgtatgaatctgtttttcattttctttggaggcaagtgaaacaccacctttttggagccacagttattattttttaaataacagctttattgaaatataatttacataccataaagttcacccttttaaagtgtaaattttagtggttttagtgtattaacaatgtgtattaccacaatctgattatagaacattttcctcacccccaagagaaatcccgtgtctattaccaatcactgtctatttgccactacccctagccactggcagctgctatcttacagccacttacattgcttgtttgcttatttgcaccaactgccttactgactctatggatttgtctattctggacatttcatataagtgaaataataaaatatgtggtcttttgtaaagttcatccatgttctagcatttactagtactttttatggcttaataatattccattgtatggatatatactatattttgtttagccattgacagttgatggacatttgagttgtttccctttgtggccattatgaataatgctggtatgaacattgatgtacaggtttttgtgtggacatgttttcagttttcttgaatacaggcatatcttgttttcttgctctttcccttattgcacttcaagtattatgatttttacaaattgaagttttgtggcaaccctttgttgagcaaatctgtcagcactatttttccagttgcatgcgctcactttgtgtctctgtgtcgcattttggtaattctcaaaatatttcaaactttttttattattatttttgaacagagtcttgctctgtcacccaggctggagtgcagcaacacgatcttggctcagtgcaacctctgcctcctgggttcaaatgagcacgcctggctaattttcatatttttagtagagactggatttcaccatgttggccaggctggtcttgaactcctgacctcaagtgatctgcctgccttggcctcccaaagtgctgggattacaggtgtgagccaccatgcctggccccttttaaaattattattatatctgttatgatgatcagtgatctttgttactattgtaatggttgtggaatgccaatgaactgcgctcagacctccctattcactgagacacaatgatatagaaattatgaatagtgacaaccctacagtgtcttttaagtgttcagaaaggaagagttacacatctctttctttaaatcaaaagctagaaatgattaagtttagtgaggagggtgtgtcaagatgggccaaaacctaggcctattgtgctagttagctgttgtaaatgcaaagggaaaattccaaaggaaactattaattaaagttctgctccattgaacacatgaatgataaggaagcaaaatagccttattgcttatatggagaaggtttgagtggtctggctagaagatcagaccagccacaacattcctttaagccaaagcctaatccagagcaggaccctaactcttctcaattccgtgaaggctgggagaggtgaggaagctgcaaaattaaagtttgaagccagcagaggttggttcatgaggtataagaaaagaagtcatctttataacctataagtgcaaggtaaagcagcaagcgctgagtgatgtagaagcttcggcatgttatccagaagatctagctgagataattgatgaaggtggctatgtgaaagaacagattttaaagcagatgaaacagccttctgttggaagaagatgccatctaggcctttcataactagagaggagaggtcaatgcctggcttcaaagcttcaaaggacaggctgactcttgttaggggctaatgcagttggtaactttaagttgaagcccatgcccatttatcatgccgagaatcctagagtctttaagaattatgctaaacctagtctgcctgtgctctacaagtggaacaacaaagcccggatgacagcacctatgtatacagcacagtttactaaatatttccagcccgctgttgagacctactgctgagaaaaaagatttcctttcaaaatattgctgttcattgacaatgacctgtgctctgatcaggcaggtgtacaaggagattaatgtagtttttatgcttgctaaaacattcattctgtagtccatgaaccaagaaatgcttccaacttttaaagtcttatttaagaaagttatttcataaggctatagctgctatagataatgattcctctgattgatctggacaaagtaaattgaaaaccttctggaaaggcttcaccattctagatgccattagggacatttgcaatgcataggaggaggtcaaaatatcaacattaccaagagtatggaagaagttgatttcatccttcacaaattactttgaggggttcaagtcttcagtagaggaagtaactgcagacttgcacaatcttttttttttttttttttaattttttatttttagacaaggtctcactctgttgcctgggctggagtgtagtgatgctcaccacagccttgaccttctaggctcaggttatcctcccacctcagccttttgggtagctgggactacaggcgtacgccactgcaaccagctaattttttgtgttttctgtagagctggttttgccatgttgcccaagctagtctttaactcctggacccaagcgactcacctgtcttggcctcccaaggttctgggattacagatgtgagccaccatgctcagccaagttcaataattttatttgatttaaaatttaccaagactacggagacagctttgttaacttctagtaccatcgctgagaaaaagtcaaatagtagtagtatgatgcagcagcagcaaaagaacaagggtaattcagaactagataagtcattgaatgatgaagtggtaattgttattagttggtattttcctctgtatagtactaagtgtttatttctgggattactttacatttctcaactctgcaagtgtaatatttgtattaagtagtaatttgtgtgggcttcaaaattagtatagacttgatgtgggaaaattttgggtcatgtttgacaaaatacttgcaacgtaatatctgaaattaggtagataatttcaggtacaacaaaggtgaagttgtgaagacatgagtttttttattccactgaaaggaaactgaaaatgttgtttagaagggagcaaatctaaattgtaaacatgtaaaattcaacacaatattttgagaaacagtgacaatcagtattctcaaaatttaatatcaaggagaaaaattagtttctaaattatttgaaagacaacttctcttaaaattagcctttggaatttattcttgctaatggtcttatgacaagccttatgatcccatcatggatatttatataggagaggagatcatcatgtgatttttttgtttgtttgagccagttcttttcactttgtgaaactagtggaatcataattgattattctttctaatttttaggtaaaattccaggcaagcatgttaactagggaagcccctgttggtaccatggaaatagcaggagaccaaaaatcaagagatcaggttctgaagccccactctgccactaagatgttatcaacttatttgggccttgattttcttttccatatagcacattcatttgtatgttctctcaagtcccatttttaatattttttgatagagtatacagaataattttggttttggtaggaattaaggtgtatatgaagtataattttttttttttttttgagatggagttttgctcttgttgcctaggctggagtgcagtggcgcgatctcagcttgctgcaatctccacctcccgggttcaagcgattctcctgcctcagcctcccaagtagctgagattacaggcatgcacgaccatgcccggctaattttgtatttttagtagagacggggtttctgcatgtaggtcaggctggtcttgaactccagacctcaggtgatccgcctgcctcagcctgccaaagtgctgggattacaggcatgagccaccatgcccagcctgaagtataatttttaaatatatgtgcgtgtgcaaaaatgaggagcaagtagagagttgataaaaactttatgaactcaggttggaaaacagtttgtgttagatgtcttattgttgtaacgtgtgccagtctataatatgaatcctaggagaacaaccatgtaccctgtaatggaaaaaactcccgtgatcaaagaaggtggtagggaaaaggacacacaaaagaagagttctagttgggagagttatgctaactgttgtaaaattgaaaaagagctatgaaatgcttggcaacaagtcttgagctatgtatactttcttttgttgtgatgactgtttttgtgaaattaaatgcttcatttattccacttataaattattagctgcattctaggcccttgtgttagaattgaggactagagtagagaacaagataaacttgaatccttcctttttggaatttaacttttaataatagatagggacaaaagacatttaaaaattgtgatatatgccgtgaagaaaataaacagtaatgtgatagaaagtaatgggagagatagtggttgggaattgtagcctgaatgctggaaagcagctaactagaaaagaccaggcagataaaaggcagataaacaccttgagatgtaaaaaggaacagaaacaagagccagctgagagaaggaaagaatagcctgagatgggtttatagaaggaccaccatttaggatattgaccatggtaaggtgttgagattttattccaagtgcagtggaaaactgttgaggggtttaagcagggaaaataacttggtgcagtaaacattcttcaaatatcactctttgtggaaatgcattagagggaggcaagaatggaagtttgctattagtagaataggagagagatgatcatggttcagtttagacaagggtggtagcattcactggagatgaaaaaagtgagccgggcgcagtggctcacgcctgtaatcccagcactttgggaggccgagacgggtggatcacgaggtcaggagatcaagaccatcctggctaacacggtgaaaccccatctctactaaaaatacaaaaaactagccgggcgtggtggtgggcacctgtagtctcagctactcaggaaattgaggcaggagaatggcgtgaacctgggaggcggaacttggagtgagccgagattgcgccactgcactccagcctgggcgacagagtgagactccatctcaaaagaaaaaataaaaaagtggacagagttcagagttgatgcatattttgcagaaaggactgacagaatttgctaataggctgtatatggggaggtaagggaaatagtgccaaatgtagattttttttttaagaaaacacctaaaattggtcttttaaaacatttattctccctgccttaaaacatgatagttaatactagtattctacatggtaaatgtttccttgacacttttatcatttttatttatttatttttttaggcttatgcatctggatgtgacattgtaatactgggaagcgattttgaaagattacagataatcccaggagctaaacatggaaatattcaagtgggatgtgtagactgttcaatgcaacaaggcaaggtttgtaatcttcttctaatatacaaatttgtttggaatatggtttttgtcaggataatctctgaagtgtgtatttcctattgaattagagacttggctttgtttcaaagatagtgtagctagaagaatttttggctgtctaagatgcattctatagagtgccagaaattctcttcttatataattttaaattatagcatcatcttctctgagaaagaaatacaatacttactgatatagaatgagtctaaagcttacgtatttaaaaggtgattggactgggggaaaggagtaacaatgaatcttcaatatttacaaataaactaaaggaaatgatttagaatatttttttttttttgtctgtgaacaggtagttatctccttgtaacttctatgtaacaagggctgtgtaactttttgtggaaatgaaaaactctttgagagtttataatattctaagcccataagaaaagtgaaaaactttatctggacttctatttgcatatgaaaagtagaaaggtaaccttgaaagtaaaatagcaacaacataaacaaaagtaacaaagtataaaattcttctagatcaggttaaatacagttcctgtagtaccagaatgagaaagtcatactactaggcaaggcagcataatatatagcttaaaataactccatataggcataggtggtaaggcctatatatagttgtagctagactggactgaacttcgcaaatacactcatatgattccactagaacattttgtgtaaggaatcaaaatggtcatattaagagtccatggacccaatcatttgtttttaaatctaatcttcatttgaggtaaactttctaggattaaaagttgccatctgggacttaaagatattaattataaaacgagtttctgttttctgaatctttacatatttgttggactactgttctttttgttacatggtattccttccctttaatatagttacaggtgtcctctatcttttgttgaggcctcttatgacttctcgctgtacaacaaaaatgatctttattatggaatgctggaaatctttgggttttttttttgttttttgtttgtttttgtttgtttgttttgttttttgtttttcagatggagtctcgctttgttgcccaggctggagtgcagtggtgcaatctcagctcactgcagcctctggcttccgggttcaagcaattctcctgcctcagcctcccaaatagctggaattacaggtgctcgccatcatacccggctaatttttgtatttttagtagaaacggggtttcatcatgttggtaagtctggtttcaatctcctgacctagcgatttgccctccttggcctcccaaagtgctgggattacgtgagccactgcgcccagcctatccttgagatttttattttcattctcttcatgtttgtttgatcttctagctcttttgttctgtaatctttcttaactgtataaaaacttgcttaataccatctggactcacatggagctggttaatgttaaaaatataatttaatactttccaatatgagctatctttttgtgatagactatatgacagtccaggttagaatgaagaaatcatggccatgtgtggtggctcatgcctgtaatcccagagctttaggagggtcaaggtgggcaaatcgcttgagaccagaagtttgagaccagcttggggcaaccctgtctctacaaaaataaaaataataagtaaatagccggacatggtagtatgctcctgtagtcctagctacccgggaagctgaggcgggagaatcacttgagcccaggagttccaggctgcagtcagctctggtggcaccactgcactgcagcctgggtgacaaagcaagaccccatctctacaaagaaaaacaaaaagaggaattaagaagtcatttggttttataatcatttaatgaagaaatattttcttcatttacagatatcagtattatcatagtggttccttaaagtatcaggaagaaaattggcaggttctggtacctggggacttctgactgtttacatttaagaaggaaatgttctttgggaagccgaggcaggtggatcatgaggtcaggagttcaagaccattctggccaaaatagagaaaccccgtctctactacaaaataaaaaaaaaaacattagctgggcgtggtggcgggcgtctgtaatcccagctactcaggaggctgaggcaggagaatcgcttgaacccgggaggcagaggttgcagtgagctgagatcgtgccactgcatttcaacctgggtaacagtgtgagactccgtctcataaaaaaaaaaaaaaagaaggaaatgtcataggcacctgtatttttattattactgtttttttctttgtactgtactaccacctaattcatttttctgagaaaattaatcctcatttatccttttattcatcagcttcaaagtattcttagcccattaccttggaaaagttcaaattgttcaccttggtgtgaggccttttacaacctggctcagatctgcctttttagtctcaggtacactattgtgttataaggagcactctcttcttggtgggatggtggtcattcacctctaaacatacattgcctcttttaatctttacatctgttttctttttttttttttttttttttttttttgagacggagtctcactttgtcgcccaggctggagtgcagtggcgtgaactcggctcactgcaagctccgcctcccgggttcacgccattctcctgcctcagcctcccgagtagctgggactacaggcgcctgccatcgcccggctaatttttttttgtattttttagtaaagacggggtttcaccgtgttagccaggatggactcgatctcctgacctcatgatcctcccgcctcggcctcccaaagtgctgggattacaggcgtgagccaccgcggccggccttacacctgttttcatactatgccctatttataaagttgaatactcactgctttttgaaatcccacccataattaaaggcccaaactaaacacttcctccagatcaatgcagcacaagtgatatctatatcctaagaattcagaagccttaaaatatccattcacagttttttctccatgtttgttgtgtcctcatttcttaccttctctttactacatcatatgtttttttttctatccctgattcattcatttaatctctctctctgtttgatttccaatattttgatgttctttatatgagactcactcaagttatagtagtagttaccttataaaacagagccaggaaaggttatgatccatcaatttaaagagtaaattcaaaggataaaatagaatatgttttaaaatgtactcagggagtttccagaggaatagacctaagttatatttttgaaaagttaatgtacactgacagaattgtcaatttagaggatggatgacgacaattaacatttactgtgcatattgtatgtcacttattatatgttaggtgttttacaaatgttatttcaaccctcaatgctgttaggaaggtagtgttgtacatattatgaacactgtaatggaaactaacgtttggagagattaagttgctagttaacgtagtaagttgcagttctaggattctaatgcagatgtgatagtcttcaaaactgacattcttaagcatcagtgaatgaaattgtgtgtattggcatatttaaagttatagtattcatttctttgctttttttgattcataagtaagttaacatatccctaataaattctttttttctttttaaaagattgcagcgtcttatggaaatgttatctccatttttgaaccagttaacctaccaaaacaaaagaaaaatttggtcagtaatttatgatttcttcttttaggaattgaaatgttttaagtattgaaagagtgtaaaatcagagtgatcattgagtaaatcggtattacttatatactgtaattgaacctacatgttaaattccattttgatgttaaaaatatatttaaatttttcattggaatagaactaaaataaattgtgccaatgaattgttgaaatgctttattattttatttctgacatttttaattttataatatttcaagagtcagtaacctaaagtttggcactactttattgctagtatcaaataccgttgtccagccatatgtggtactctttcctttgttttataatctacctttatacaggttttctgcctcttcagggcttaactttcttgcattatttagatcatgtaatacagtcgttaacaggtcaatgaatgtttttctttataagcaagctgtactcagaaatagttctgaaaactggttacccaataatttataaatattcgaatcatgttagcagattttataggttctttaatgcttgtgcctgtaatcctctctatttgggaggctgaggcaggaggattgcataaggccaggagtttgaaaccagcctgggcaagattttaaaaaaagtttagccaggcatggtggcacatgcctatagtctcacctgctcaggaggctgagatgggaggatcgtttgagcccaaaaatttgaggttgtggtgagcaatgatggcaccactgcattccagccagggtgacacagtgagaccctgtctctaaaaataaaaataaaagcaaaccgtctgaaagaagataagtgtagtgtcattgaaagagcagtgtaagggagctaaatgatgagaaattatgaacacaaggaaacaacagacactgaggtctacttgagggtggagtgtggcagaagggaggggagcagaaaagataactattgggtactgggcttaatacctgggtgatgaaataatttgtacaagaaaatcccttgacacgaatttacctatgtaacaaatcttcacaggtactcccaaacctaaaattaaaagattttttttttttttaaaaaaaaagaaagagcagtgtattgggagtcataggactggtttctatttctgggtctatctagctagttggtcttaggtaagtcagccttaagaaattctttgcttaactctcaaattgattactatctattcagtcttgatgggaatattattaggctaacatgtcaaagatggtttaggaatgtattaattataaaggactaaactgttttaatagcagacatacctttatatatcttttgatagttttcatgtcatcttcacttagctcattagtattttacaaattacttcaaacctagtttgtgcagccattatttcttctttttatgaataaggcagtagagtaggctcaaagaatatagtgacttgacaagtgaagcagctgttaagccacagaactaagagtaaaaccatctgtattgattcctaggtgtgagtgttctttccttaccttgtgttaatgaaaactattttctgagttaattgatatttatctttaaatttcatagaaatagtgttcacacttctgatttctatttgtttttatagattgcctagtgaatccactatttgagcctcttaaagccttaagaattagtaattggcagtactaaaaagaattttttaaggcgattaccccacccagcccagaacagtgtatttcagtactcaataaatatttattaaataaaataagtagcttttgaaaatcagtatgttatgttaaaatgcctttattgggaaggatagaatagagaatttcaatgtttgcccattttctcctttcctaattataattgatgaatgtaatgtataaaactcaaaaagaggctggtttattggcttatcagcactgactttgcagaaaggacaataaaaaacttgatgaagaagggcaaaagtggatcaaatggtgaagttatagacttgaaagatgtataaaatctatgattctaaaatatagtttcagaatgtttagatccttgtaaaaatatattctttccttttctttgtatattatggagtattcttgtgaggtggtggtcttcatgagagttgcacatcacaactaccattggatacatgtgcccaaatcctgctctgggaatttctacatctgtagctgtgggattgtgtctatgcacttatatgtcttgttctagagagggttctggtatgtactgtgattgaaagacattcctgcaaggcagtgtttcatgaaagcatattctgtaggtcacctatgtcaaaatcacctggggtgttaaagtacaggtttctgtgccccatcctgaagcttttgaacctgaatttttgggcacaggtctcggaaatttgaatttttagtaacatctcaggctattatttgttgtaccaaagtttgagagccaccacattaagagagtatgaatctcaatctgtaattgggctgtgaactcaacttagtgtaggccacaacccgaatttaaaaagagaatgaaatagagaaaatatcagagtatgtcacatgtaataaggacaaacataggttatatttatttgtatgtgtgtgtgttctgggtcagcatacattgtgtatttcttactgatttgcaggcagaaaaaaagggaaaaatttcgctttaagaagttgtaaggccataaattatatagtagtatcaaaatgttacatcttttattctgaattttcccacatactattatgatctcagatggggacaaaacagtaaaagagaaggaaatgtcaaatagtaaagccacagacacatttaaaattaactttttaactgtaataataaagtaataattaaatctgaggctattaagactgttatccaaggtagcgtatggttattgattgtttatactaaagatagcattttgaccaccagttatggatattctctcacataccttctttatcatgtgttctctatttttgttgactgaactgaacattttgttatctttaaaattgactgcctgtgttattgtaagaataacaagcataaacgtacacatttgacagagaaaatatgccaatcataatgggctaaatgacttttcttaattttaggaattatatagtcagtggcagaaaagtggccaattttttctggaatcaatagcacacaatataacctgggatcccacaggtaagaaaataagcaggattaactaaaatgaaatatcacttgcctagttgttcttatttttattactcttatgtatttcacttctgctgggtgtgaggttgtggggaataccaaagaagtaaaatggattatgcccttttagagtttatactgaaatgaagacagatatgcactgtaagaaatgagagaatgttctaagtgccataataggatacccattgtttttggaaagagatatttctctggagaattaacgtttcattgaaaaggagcctttggacctgagagtaaacagactttagcaatgagagttgggtagatggaacaggaaaaaagtgaaatttaagaaaatatatgccaggcgtggtggctcacgcctgtattcccagcactttgggaggctgaggtgggcagatcacctgaggttgggagttcaagacccgcctgaccaacatggagaaaccctgtctctactaaaaatacaaaaaattagctgggcatagtggcgcatgcctgtaatcccagctacttgggaggctgaggctagagaatcgtttgaacctggaaggtggaggttgcagtgagctgagctcatgccattgcacttcagcctgggcaacaagagtgaaactgtctcaaaaaaaaaaaaaaaaggaagaaaatataatgaatatatgtatcagttatctatttctgcattagaaaagcatcctccaaaatgatggatggcttaaaacatccatcattttattgcttatgattcttttggtcaggaagactctgtgggaatggcttgtctattgttccatgtggtagtgactgaagcagtttatctgcagctaaaagatccaagaaaggctttgttcacatatctgggccttgctgcttgctatctactggaatgcctttgttctcctccacatggcctcttctgtggccctctgtagcagggcagcctggattttacatggtggctgcattctgagagtgaaagtagaagctgcaaggaagtcccagaatgttattgctgccacattatatggtcacaggtccagctaatattaagggttgggagacatagactccccctcttgatgaaagatatggcaaagtcatattacatggaggcatcaacacagagagacataatttattgggagccatttttaccattctacgaaagtgagggaaggcacagagagagaaagcataagatacattataataaggattagtatttcactgggctgagtctcagtggtggtaaggagataagaccttaccatgttataggagacctttaaagtcatgctaaaaatttgaatttaattctttatggttgtctaaaaactataggttttcaaaagaggctagtcatacaagatttatggttttgcgagatttgtctgctagcagtgagttagaagggtcagtggcaaatggaacaggagaaggagtgacctttggagaggttgtattctcattagtctggatgagaaataagaacttatttcaatgccttttccatagtaggtgttcaattaatattaaatgaattaatgaatagtgaaaggtatacatggatatgaaatgtgtttaggcagtagaattgacattacttaacaactggatttgaaattactttgagagtatctatgaccacacaaagagtaatatgtaggagttagaggtagtggaacataaggtattaattggatatgtggaccttgagaagcttgtatatcataaagcaatatatagacatttgaatctagaacataaaaagttatctttggggctgggcacggtggttcaaacctgtaatatcagcactttaggaggctgagtggggagaattgcttgagcccaggagtttgagaccagcctgggcaacatagggagactccatctctacaaaaaaatttttgaaaagttagtcaggcttggtggctggcacctgaggtctcagctattcaggaggctgaggtgggaggcttgtttgagcccaggaggttgaggctgcagtgagccatgattgtgctactgctttctagcctgggtgacagagcaagaacttgtctcagaaaaaaaaaaagaaaagttatctttgagacatagaagtcatcagagagagatataaaactattggtaaactgattaatgcctttcttttgtgtccaaatttaatattttatgttgcctaattcataagattttctgttttagactttttatgcttttttcctgctttactatccataatatcctgctttaatatctgtaatttaatatctgtaatatctaattcttagagtttgaaatcagtataccatattatatcttacctacttttgttccattccatacctgggattaagtttatattctgtattaaattcttaatcttttatgggatatcttaatgttatcttcagtttatattaagcaaaagaaaagttgtatctgttggtaagttcaaaagtggaataatcaacatatttaaatggaatgtttcattacttcttgtgcttttttttggcccctgtctatgaaaccttctgtctagttgctctactatttattgagcttctgcttagtgcctggcctgtgctagagactttgtgcatattatatagctaatccttacaacaactgtatttaaacctcaaattttatagatgagaaaattgaagttcagaaattacccaactagatcaaattcacatggctaattaagcatcttacttgggatttagacacagggatttctgatctaaagtctatgccagagatccactttccttttgaaacaagaaaacgagggcgaagcatgctggcccatacctgtaatcccagcagtttgggaggctgagttgggaggatcgcttgagcccaggagtttgagaccagcctgggcaacatagcaagaccctgtctcttcaaaaaatttaaaaaagtgattgttctagaaatacacaaatctatagtcttaaattgccaaggtgaatgccatctttattgtcagcttttttgccaaaattgcttgtcttttgtatggatgatagcacggccttctacttaattcccaagtcatagagttggaatctgtcctttaaccctcttgttttttctctgtatttatttggtgtcaaatcttgacaattctttttttcattttttcttgagacagggtcttgctctgttgcccaggctagactgcagtagcacaatcatagctcactgcagccttgactccccaggcttgagtgatcctttcacctcagcctccctagtgtctggtactacaagtgcgtgtctaactaatttttgtaatttttttctgtagaggcagggtttcactatgttgcccagacaggtcttgaactcctgggctcaagcagtcctcccaccttggcctcccaaagtggtgggattacaggtgtgagccactgcacccagccttgacaatactttttgaaatggctttcaaatgcttgctttttaaatatttggttgagatcctcattatttaccatctgaattttttttcctttttttttgaggtggtgtttcgctcttgttgctcaggctggagtgcaatggtgtgatctcaactcactgcaacctctgcctcccgggttcaagtgattctcctgcctcagcctcctgagtagctgggtttacaggcatgctccaccatgcccggctaattttgtatttttagtagagatggggtttctccatgttggtcaggttaatcttggactcccgacctcaggtgatccacccgccttggcctcccaaagtgctgggattgcaggtgtgagccaccgtgcctggcctaccatctgaatttctatagttaattaaccaggtttaatagtttaatagttggttaaccacacacttatggtttccctgatgttgtctgtctctggagttgttttctaaaaagtatttttaaccttctttgtatactagagtctttgaaatttcgatgtaagttacatattatctttctggaaaaatgcacatattgtatgtgtgatttttgtatgttatctcaatagagggagactcacaggcctctccatctgttgactgcccctcttccagttaagccctcttgttctgaaatacagatccaattttgtaacaactcccccacaatcccccactgccacttgaaaatcttttactcccaactacctataacaaagtccaaacgctgtgaacttgaaaaactcttcacagtctcaccttggcattttttccgtagtaattttttttctagcctatctgtgtacgttattcgttaacctataccagattaagaggcattcttgggaaaatacataaatttatatgtcttcatgcctttgttcatgttaggtttcctttctgaaatgcctgtctcttctgcttattcatccattaaggaccaggtttcatttcctcacttttcctggcacttttactacaggtacacattaatgtctccttcctgtgggcttccataaagctttgcatgcatttctatcatgtatgtaacacttccacatggtatcatatttccatgtctttctgctgaaatatgaactcatgaaaaacgacaatgttttgtttgtcattgtatttccaatgtctagcacagtgcccgggacaaagaagatgctcattaaatacttgttaagtgagagattataagatttcttcctttctatctcaagctattttaacgaaattaaaatacagccttctcctccgttcttcaaaattttttttgatatttgacttttttttagaagttgttttatatgaaattcttgagcatgtaaattaagtcactattaaatacctaaataataaatgaggaataatattttttttaggcagtcgtcttttaactggttccagctatttgcaactctggtccaatactaacttggagaagccaactgaagatgaaaatttaaataaaacagatcttaactttggagattggaaatgcatttggcattgcaagtaagcaattaatcaggggagtaaactgataaacctgttgttctatgtggttttattataaatgtattttagttgtgtaaaaccacactgacataaaaagtattgatttttagtctatgatatgctttttcttatacacagataattctctatttcccgtgttctacaaatacattttttaaaaatgtcaattaaaataggaagaaacaaatgtgtaaggcttacatgaagaccattaaatacaaacttgccaaattatatgaaaagatagatgactttcatgcttttgaatggaagacttcctattctgaagaaatctatttttcccacataatctatatattgaacataatccttgccaaaatctgagtggaatttctattaagcatagttctaaactctacttaaaaggacaaatatgggaaagtcagagaaattctgaaagaaaagaagaatgaagatttgcagtatagtaaaatgaattctaatgccacagatgatcaagcattttgttattgatgtaggaacagacagattaggatccaggattagactctggagtgcaatgatgtgaggcttactgcaacctccacctccctggttcaagcaattctcctgcctcagcctcctgaggcactgggattacaggcacgcgccaccacatctggctaatttttgtatttttagtagagacggggtttcaccatgttggccaggctggtcttgaactcctgacctcaggtgatctgcccgcctcagcctcccaaagtgctggcattacaggtgtgagccaccgtgctcagccttaagatagtcttttatagcagggaaaactagctagctctgtagacgggaaattaaattagagtctttcatacctgataccaaaacaaatgtgagatggaaaaaatttctataaaatgaaacaaaaatattagaggaaaatacaggtgaaattttatattttagagctacattgtccagtatggtagccactaattacatgttattattgagcacttgaaatgcaactagtccaaattgagatgtgctggacttcaaaaatttagtattaaaaatagtgtaaaatatctctaacattttaaaaaatatgttgaaatgatgtttttatatattaggttaaataaaaaatattaattttgcctgttttaactttttttaaaaatgtggctgataggaaatttaaaattacatatttggctaacatttgtcatttatgttatattgctgttcgacaagaaatgctgctttagagttagggaaagactaagaatgacacccaaactggaaatggataggataggaaaaattaatagttctaaccgtatcaataaaacatttctataaagcaaattgtccataagggaagaaacacaaacatgaggagaaatatgtgcagttttgggcaaatgcgtttttaaaagtaggccttaaattagttagaaaagaacaggtataacaatagtaagcaacattgggcaatggagagaaaattttaacaagatatagcacatattaaaaataagtgcaataagaggtgatctcacttgaaatcaagaatgtgaaatgttcagaaaaaggatgaatgttatctaatagtgtttagagaaataggtgctcttgtatactgtcaataaagcagtacagttgatattatctttattttttttttttgagacgaagtctcgctctgtcgcccagcctggaatgcagtggtgtgatctcagctcactgcaagctccgcctcccgggttcataccattctcctgcctcggcctcccaagtagttgggactacaggcgctctaccaccatgcccggctaattttttgtgtttttagtggaaacgaggtttcaccatgttagccatgatggtctcaatctcctgacctcgtgatctgcctgcctcagcctccccaagtgctgggattacaggcatgagccaccgtgcccggcctgataatatctttctagagcacattttggaagtatgattcaacaggcttaatttttttcataccctttaaataagattgccaggtttcattccttcattcaacaaatatttgttgaatggttccagtcagctttaaagatgcttagaatattgctatgaacagataggggtagatagaaaataaaccagtaaactggtgtaacaggatttaagtgaaactgactaggtttatatgaagtggtgatagcataaatatcacataccaaagtaaggcagacgtcccatatgtagaatttacagaggagatttcaaaggagctcgttccatgtattttgcacccctcagataggtaatgggttaacatgtagaaagggaacagaattttgcataaataattctttagaaagagctgtaggctgggctcggtggctcacgcctgtaatctgaacactttgggaggccgaggtgggtggatcacctgaggtcggcaattcaagaccagcctggccaccatggcgaaaccccgtctctactaaaaatacaaaaattagccaggcgtggtggtgcatgcctgtaatcccagctacttgggaggctgaggcatgagaatagcttgaacccggtggtggaggttacaatgagccgagatcacaccactgcactccagcctgggcaatagagtgagactccatctcagtaaaaaaaagaaaaaaataataatagtattttgtcttaaggatatccttaggattaaccagatgttctaaaaatgtgtgtacaggcatgttcacttctcttttttgttcttgttgcagcaaaaattagaaaacagcagtgaaaaattatttgaaatcattgtatgtatatatatgtaaacatatacagtggaatataagccagtaaagtaataatgtagatctgtacacctgcacacatatacacatcttttgcatctatatgcaaagatgttcatgacatatttttgttgttgttgttgttcgagacggagtcttgctctgtcacccaggctgagtatggtggcgtgatcttggctcactgcaacctctacctcctgggttcaagcaattctcctgcctcagccttccaagtagctgggattacgggggcatgccaccacgcctggctaattttttgtatttttagcagagatggggtttcatcatgttggccaggctggtctcgaactcctgaccttgtggtctgcccacttcaggctcccaaggtgctgggattacaggcgtgagccactgtgcccagcccatgacatatttttttagtgggtgataagtgtgacttcagtttctagccctacttttcccaccttttcctgcagaaagtagagagagtggagagaaggatttggaagtttatgtattaaaatgttaacattggctttgtctgaggaaaggatgtggtggtactggtgaaaaatgtaaatgatttcatttggtttttatctacctgtatcaacttttctgtaatgtattatgcttaaaatcagaaaaaaaagttatttgtatctgaaatgaaatgtgacagaattcctctttggatatctttataaataaatttagaattgacctatctaatcatgcatttgagcaaagaaaaggaaagcagtgatagtggtgagtgtcttgagatcagtatatatgagtagctgtaagggaaggcaatgaagagaaatgaaccaaagttcctttgagaagaaaaggcaagtatctaacaagtatataggtgaagctggtaggctgaattcctaattgttgcaagtcccctgttaacccacacataatctttaattaggtaagtattaccctaaggcaaacttattatatattatccatgaaaatgtatgttggcatatagggatccatggttctggaaactagattttcagatttaaaaaatgaaaccattctctctcattctaagggaatgaaagttacaacttttgttttaggctttaaagattttgacaagccattccttccatgagtctatgggtgtatgtttttatatttaaaatttatcttactaactagttcatttttcaggtacacaaagatgtgggtgtgaaacttataacattttctgtcttttgaaccaattgctgatttataattttgagaatattgaactttttctttttagttttcattgcaaattattccttatctgtttaatttacagaactgcttcccaagttcatttaatgaaattttcaccagatggagaattttttgccactgctgggaaggtaaattgtgaaaatgctattgccaaattatgtgtttatagtttactttgaaactttaaaaacatcaactggcttcattcttttatttatttaacttgaaaataatagtttccattaaaaattgttttttttgtttgtttgttttgtgatggagactcactctgtcatccagactggagtgcagtggcacgatctcggctcactgcagcctctgcctcccaggttaaagcgattctcctgcctcagcctctcaagtagctgggactatagccccacaccactatgcccgtctaatttttgtattttttaatagagacgggatttcaccatattggccaggctggtcttgaacccctgaccttgtgatccgcccacctcggcctcccaaagtgctgagattataggcgtgagccaccatgcccggccattaaaaattttaaatagcaaaaattgactccattattgtggtgttaaaagactgtgtgatataattgaaattacatagacttaggggcagatctggatataaatctgccatttaccagctttatcaccttgggcaagttaatcttattgagcctttcttttctcatgtgtaatatgaggataaaaacacctacctcataggtcattaatcgtaggattaatttagacaatatatgcagtatagagtgaccggcacagtgcctttcatgtagtatacaatcaataaagcatagcttcaatttatattaccttttagctgatgtgtattaggctgtttttaatatataagacttcataggctttctagaaagatactagtaaccatttctttagtgtgtatactttattacctgtctattttaaagcaatgtatttctttgaagttatttttattcattggttcatagagcatttcacgagctgctaataagtcaaattattgttctcatggctcaaagcattctgcaaactaagagtgtaagttactctaaaaccacagtaaggtttttgttttttaggagagaagttgagctgtttattctgattgactttacaggtgggaactcagttatagcttaaaagcagtacctggtacattctagtcccctttgcttttcctttatttcccaaattatgactataaatttgattgtacaaagaatattttatatagtatttatatattaactcatttttttcaccatcaacattttctttgaaaagtcacatgaaaattcatgaaaagtatctctttttttcaataattagcagtcttcataagtctgctagtggtgttgattacttatttaatatttggcttactggaaaagacgtccttaattttatctttcagtgtttcctgaatgactccattccccttactctagtaattagcaagcatttttcttgaacacagaatacacacattcacacacttcagtttttaaagcacagttaggcaatgctaatagaaaagtgccagaatcagaattttcttaattcctctgtgctcaacgtctcttcccatccccaagttcttgccattggggagaaaattcttacttttgctatttgatttaatctttaattctgatctccatgattttctgttttgttttttttttccttaggatgactgtcttttgaaggtttggtataatgtagaaaactggcggacagctgttacttctccagatggaagttcagaaaaacaatcccaaggagaaattgacttttcttttgtgtatctggcccatcctcgagcagtaaatggattttcctggcgtaaaacaagcaaatatatgcctaggtcagtggattggtcatttccctccacatattaagggagcatcatctttgttactttgattgcttctctcacttttgagagtccatagttacaggacttctgagcctatgaagattagagtaatattaaatcgtctctggcctgcacatctctggctgtggctcaactatgtttgatgcttaggataagagccgtattaaaggagtttaagctgggatagtttactccatatcagatgtctttaagtcacagagttgtacatattttctttttctttgtgttttgtgtctaattctgtcatctattttctccagattgttgtttgtttatatttttacataaatactctgtcgtcttgtaccttctagtatgtcttccctggttttcttcttttaaaaaatagctttattaagaggatatatcatgagttcttgtatgtttatttgactacacccagcatatgtgaggaaaagagagagtaggttaataccctaccttattcttctttgaaacagctataagtttaaccacaaaagcacacagtgacacacacatacatatcctcagtatcttcttttttttttctgtagttctggaaagagttaatgtaatactgaattttagtaggttatagagacctattacttaaatacaggtataaattccctatttttgtttgttttttatgtgtttttgttttgtttagttttgagacagggtcttgctttgtcacccagactggagtgcggtgccccagtcatggctcactgcaacctctacctcctgggctcaagtgatcctcccgcctcagcgtctcaaatagcggggactacaggtgtgtgccaccatgctgggctaatatatttttttcttttcggattttttgtagagatggggttttgccatgttgcccaggcttgtcttgaactcctgagctcaggcgatctgcctgcctcagtctcccaaagtgctggaattacaagcatgagccatgtgcgcagccagaaatcccattttgtactatatggccattttcaacttggccacaccatgtggcattttttccctagcttttcactgttctatgaattttgctgactagatgttttgagctatagtgtagctatagccaggacagggatagagaaaagagagtgagaaaaaatggagggagatgggtgtgaggatggggaaaggaggagaaacaaggggttggggaaggaaaggaaaaagatgctaggaagggagaggtaggggacagaaggagagaggtagaaagggaaggtggcctggaaaggctgtgaaagcaaagaatggtgggagagagaagcccggagaggaggtagaaagggagaagaaaacaaggaagtagacagaaagaggagagggcgccagagggagagagatgcaagaatggaggagggaaggagaaggagagagcaaccaatacaaattatgctgttctcccttctgttctgcaacttcttttttagtcagttaggtaagtttaacaaagtggctactagacaatattttgatttctcatttactttaactcactgagttactgataaaacctgctgattgttccgtttttaaaaatcagatatgtatgctggaacaagttactactacaaaatattgtgactttttctttctttcttctaaacttactgaattccctgatggaaggtagtccttgctgatagggtttcaggctttgagctcttgttgcttgttggacttattaacatatatgtaattgatttttgcttttattttaaggaggtggcaaaaaggaaattaactgaaagtcaaggatgactaaggagggggaagtgtttagtactttatcatgaatattcaattcttgcatttcactgctttgggcatctgttaggtaaggagagaataagtgtactcagtagttactgtagctttttgtgacagtgtgcaggtgcctttataggaagtagaaatgaagcatatgatataattcaaagaactatccactcaataaatcagaaaatcttattagaagatgtggttatttcttatgtgtcaactgagagattgtggcttaatctcagtctttgtttttttagatgtaaaaagaatcttattgagtgctgggatggtggcacacacctgtaatcccaggatgaggcgggaggattacttgagccagaggattgcttgaatccaggagtttgagagcaccctgggcaacatagtgagaccacatctcttaaaaaaaagaaagaacgtttggcaacattattgaaacaagaactactgaattctaggcagaaaagaaataggttggcaagcatttgctgtgatgaaatctgtacatattgatattttcttcattggtaccttagttggtacatttaagtaattacagaaacatcgtagaatttctgtgatactatgtgaaatttgtatttttgcttctaaaatcttttcattccttagggcttctgtatgtaatgtactgttgacttgctgcaaagataatgtgtgtcgtctttgggtagagacatttttaccaaatgattgtttgctatacggaggtgactgcagccattggactgaatcaattaatttaacaaataacttcaagagaaatgcttccagtaaagaacgagttcaaaatgctttagaagtgagtgtttttgttacattacttactacaagttttaaaacctttggtacattgcctttttggtaacacagtaatgttataaaaaaactatatcctaggaaaataattcttagaaaattttcagttctatttggttcaaaaaacatatttttatctagattttgtctggaacacaaaactacctataattatgaagttactcttaggtttactgatgatgataaaaggatgattacatttgacttggctgaagtaacatgaagtaaaatctgagaatgcagagatttaactctgaaaataacttattttttctttcttagagcttgagtagtttgtcctattctgttcttctaccattttatctttagaaaacccaccccacccccagaacttggggtctttacaaattaatattgaaagtaaaagtcaatttttgatttttggacatgctaaaggtagaatagtaatacatttgatcgtagcctaaaggctgagaaacaatagtagaatagtaatacagattcttccaatttttttttttttttttctgagacagattctcactctgtcaaccaggctggagtgcagtggcatgatcttggctcactgtattcctggccttagactcctgagtagctggaattacaggtgtgcatcaccacgcccagctaatttttgtatttttagtagggagagggctttaccatgtttgccagggctggtctcgaactcttgacctcaagtgatctacctgcctcggcctcccaaaggactgggattacaggcataagccatggcgctcggcctattattttcttaatattgaaaacgaagtgattttattttttgtggattttttttttgggtgggggagttgttttgttgttgttttttgagacagagtctctgtctgtcacccaggatggagtgtagtggggcgataccagctcactgcaacctctgcttcccgggttcaagcagtagtccctcctcagcctcccgagtagctgggattacaggtgtgtgccaccacgcctggctaatttttgtatttaaagtggagatggggttttgccatgttggctcaagtaatcctcccacaccggttggtctcgaactcctggcctcaagtgatctgactgccttggcctcccaaagtgctgggatcacaggcgtgagccaccatgcccggccctgaaaacagaagtgattttgaaacaatttatctttgaatgctttgtatgattatgcagcaacaatttttctaatttgaatagtattctgatgcctcagaatataataaattctgtattgattcaacaacgaatagaatggttacatgtagtaatagctgaaagaagttactgaccaggaatctgaagacttgttctaccttttgccctgcctcttcttagctagatgatcttgggttctatatagaccattttatcatatgaaagatgggaataacaatatttgcactgcctgcctcatggcatcaaatgggatgatctctatgaaaatgctttgtaaattatgaaatgttccatgtgcagtggtaatattatttaatactgtgtggtcacaaggagttagctatagacaaaagacagtgtatgtagagatatcagtcacaaacaatagtattgggaaaaaaatttttaacatttgattttaggaaatacattttaagaaaataagcctaataaaaattgcaaaacactgtgtgaggattaagagaacagccaggtactttaagtcataactttattcttcaggattcaaatttgctataccaaaatattgaaaggtgtttttacatataaaatgttaaaaggcgtttttacatataaaacatgtaaaatgttctgagctaggatatatgtaacttctgacaatcattatataacctatacgtgtatgacttttgacaatataggtattagttttgtttctattcacacaggtaaatctgagacattttcgtagaggtcggaggagatcacttgctcttgtagcacatacgggatatctaccacatcagcaggatcctcatcatgttcacaggaacactccactgcatgccaatgcactttgccactttcatattgcagccagcatcaacccagccacaggtaatgaaacattgttcaaaacatgtttctgaaattgaatagattgattttataacaactaagttatacttttagttttcaaataagtaaaatattggaggtgactgtcttagcctatttttcttttttttttctttttttttaatttattatttatttttattgatcattcttgggtgtttcttgcagagggaggtttggcacggtcataggacaatagtggagggaaggtcagcagatcaacaagtgaacaaaggtctctggttttcctaggcagaggaccctgcggccttccgctgtgtttgtgtccctgggtacttgagattagggagtggtgatgactcttaacgagcatgctgccttcaggcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaacatgaaaagtctcccatgtctacttctctctacacagacacggcaaccatccgatttctcaatcttttccccacctttccaccctttctgttccacaaaaccgccattgtcatcctggcccgttctcaatgagctgttgggtacacctcccagacggggtggtggccgggcagaggggctcctcacttcccagtaggggtggccgggcagaggcgcccctcacctcctggacggggcggctggccgggcggggggctgaccccccccacctccctcccggacggggcggctggccgggcagagtggctcctcacttcccagtaggggcggccgggcagaggcgcccctcacctcccggacggggcggctggccgggcagggggctgaccccccaacctccctcccggtcggggcggctggccgggcggggggctgacccccccacctccctcccggacggggcggctggccgggcggggggctgacccccccacctccctcccagacggggcggctggccgggcagagtggctcctcacttcccagtaggggcggccgggcagaggcgcccctcacctcccggacggggcggctggctgggcggggggccgaccaccccacctccctcccggacggggcggctggccgggcggggggctgacccccccacctccctcccggagggggcggctggccgggcagaggggctcctcacttcccagtaggggcgaccgggcagaggcgcccctcacctcccggatggggcagctggccgggcggggggctaaccccccccacctccctcccagacggggtggctgccaggcggagatgctcctcacttcccagacggggtggctgccgggcggagaggctcctcacttctcagatggggcggctgccgggcggaggggctcctcacttctctgacgggtcggttgccaggcagagggtctcctcacttctcagacggggcggccgggcagagacgcccttcccctcccagacggggtcgctgccgggcagaggcgctcctcacatcccagacggggcggcggggcagagacgctcctcacttcctagatgtgatggtggccgggaagaggcgctcctcacttactagatgggatggcggccgggcagagatgctcctcactttccagactgggcagccaggcagaggggctcctcacatcccagacgatgggcggccaggcagagacgctccttacttcccagatggggtggcggccgggcagaggctgcaatctcggcactttgggaggccaaggcaggcagctgggaggtggaggttgtagcgagcggagatcacgccactgcactccagcctgggcaccattgagcactgagtgaacaagactccatctgcagtcccggcacctgggaggccgaggctggtggatcactcgtggttaggagctggagaccggcccggccaacacagcgaaatcccgtctccaccaaaaaaatacgaaaaccagtcaggcgtagcggcgcgcgcctgcaatcgcaggcactcggcaggctgaggcaggagaatcaggcagggaggctgcagtgagccgagatggcggcagtacagtccagcttcggctcggcatcagagggagagcgtggaaagagggagaggggagaccgtggaaaggggagagggagaggagggagagggagaggagggagagggagaggagggagagggagagggagaggagggagaggagggggagggagagggagaggagggagagggagaggagggagagggagaggagggagaggaggagaggtagagggagagggagaggcctatttttcattgtagcaagctcactgatttctgtttgtttgccctttaaggccatgacttgacttgtgatttaggatcttgataaggcattgaagttcattattagtttattcaaaaattgatatttgaactgttacttaataaaggttagtactacagatatagtattgtatttttttaatttttattttttataggcatggagtctcactgttttgcccaggctggtgtcaaactcttggcctcaagcaatcttcttgccttggcctcccaaagtgctgggattacaggcgggagccactgtgcctggcctttctttacctttcttttaaaccatagatttgttttggagaaaattgtttacactccttgagttcattctagcctttacagtttagcagacaccaacatgatccaggtttgatttaatgtgatacttaaatttttgcttacttctactaattagggattatttgcagcaactcactggattagtacatcagtgtactcaatttaacattcatatcaaaagtaacaccaaggagctgggcatggtcactcatacctgtaatcccaacactttgggaggctgaggcaggcagatcacctgaggccaggagttcaagaccagcctggctaacatggtaaaaccccgtctctaccaaaaatacaaaaaaaaaaattagccaggtgtggtggcaggcacctgtagtcccagctacttgggaggctggggcaggagaattgcttgaacctggaaggcagaggttgtagtgagccgagattacactactgcactccagcttcctgggtggcagagcgagactccatctcaaaaaaaaaaaaaaaaagtaagaaagaccaaggaacaaatgcttttttagctgtgtgactgtcttgaatgctttccttgagcgtgagaagggaacctcaacttcagtcttaatgctaacaaataagcagtccatcttagaattagctcattaaagaggttgataggtcagtctattaagtaaaaactagttgttgttgatattaagatacatatgttactagttcctttgacattatggtgatgactttttttttttttttttttttgagacagagtcttgctctgtcgccaagctggagtgcagtggtgtaatcaaggctcactgcaacctctgcctctcgggttcaagtgattcttctgcctcagcctcctgagtagctgggattacaggcatgagccaccatgcctggctaatttttgtatttttagtagagatggtgtttcaccatgttggccaggctggtctcgagctcctgacctcctcgtgatctgcctgccttggcctcccaaggtggtgggattacaggcgtgagtcactgcacccaaccaacatttttcttttattgtggatcagtttaaaatttgcttgttaccaaaatttgttataaattaagatacttctattaacagagctacaaattatagacattttatcatgtgaatatttttcactgttaaacatttatggttaaataaattatactgtatgacctaggacatataatttaatctcctttgcaatagatacattaaatttaccgtttaaatctgttactgttaataatagtggcaaacattatgttggaagtcttcttttacatcacaacattgttatgtgaatttttgacagtagaaacaaaaatagagaactacaatatatgaatatagctaaatacagaatggtgacttttttctcttcaagggtaaaaagactttttttctcttctagtgaattagactgcataaatagaaaaagattgattcattagctttacagttttgcctaggaatgatctataaatgcatttccccacctgctgcttacggaaagtataaaaaggaagttaaaggaaagtttccttgttggttactaccataagaaaggtgctatattctattttagcagggccactatatggaaaatatctaaattaaatgttgttacaaaaatgaattactaatgagattctagctaaggagggcactaaatgtggattttgtgtgtgtatatatatatgtaattattattattgttattatttttgagatgaagtctcactctgttgcccaggctgaagtgcaatggtgtgatctcggctcacagcaaactccacctcccgggttcatgccattctcctgcctctgcctcccaagtagctgggactacagacgcccgccaccactcctggctacttttttgtatttttaataaaggcggggtttcaccatgttagcaaggatggtctcaatctcctgacctcgtgatccacccaccttgacctcccaaagcattgggaatacaggcgtgagccaccgcgcctggccaatatatatttaaaaaatccaaaacaaacaaaggttgctataaaaaagctctgtatgtactgtaagcatataggtttttttctttttttcatgtgtgtttttaaacaatggaagagtcaactgtgttagactaaattatgttattgactgggttcgatggctcacatctctaatcccagcactttgggaggccgaggcggtggtgaagtcaggaatttgaaaccagcctggccaacatggtgaaaccccgtctctgctaaaaatacaaaattagccaggcgtggtggtgtctgcctttaatcccagctacttgggaggctgaggcaggagaatcgcttgaacctgggaggcggaggttgtagtgagctgagattgcgccattgccctccaccctgggcagcaagagtgaaactctgtctcaaaaataaaataaggtaaaataaaataaaagcattattgtatgtgctgcattgaatggaacgtttatattataattatcaaaaaagtttgcgtcatagcaatttatcctcattgaaaaccttgcagcatccttttattttggaatatcctctcaacagtcataccaccaggacatgactgtataacaataaaatattctcttgcattaaattggggatatctattcaataaaagacaaaaaagaaaatgtaggaagtgtacttagagctgttactttctaagtgcccaacaccgtggacaattcaagcatcgtaatctctgtaaataacaataacaaaaaaaatttttgtcctgctgttaaaatccatcattatagacaaaactggtgaagattgattagacagattcatctaacactgatgtccaagctggcgttggcaactaatgcataactggtggtcaatagagattttgaaagatcttcactttctattgttcttttccaggggtcttgaagagttctgttctaaaatatgttgttgagttgagcttctcagtttgctttttcattctcaaactggtgacgtttttcctctaattctttgtgctgtgcttaaattcctttttgctcttggcaccgttggagctcagtttcagagtccttcagtttttgaacttttttttttttgaccttcatcttgaacgcctgcttcatctttgtccccatcttcttcattttagctacatgctgtcttctttcctcttccatttgtgccagagggctcttagtaagctgccctttattcttgttgttttcaactccattgtaagtcaggtgccatttttctgcttctgtggttttcgtaatgggcattatcaggaacatctttcaagtcttgtatgtgtgttcctatcaagatactccttagaattgtaaaattacagtgctcaccatattcaacatcagcaacacccttaggatactgccttcctctgactctcttgccattaacttcaatggtagtattattggctaccacagcaagtggtaaacagtcctttatcctttttttttttttttttttgagacagagtctcgctctgtcacccaggcaagcctggtgatagctggttgtccaggatagaattttagttcaactttaaacttaccgaattactcacagaattttacttagtctggtaatctggagtgcagtgaccgatagctcactgcaacttctgcctcctggcttcaagtgattcttgtgactcagcctcccaagtaattgggattacaggcacatgccaccatgcctggctaatttttgtatttttagtagagatggggtttcgtcatgttgaccaggctggtctcgaacccctggcctcaagtgatttgcctgctctggcctcccagagtgctgggattacagacatgagctgctgcacccagccagtcctttatctttttaacaagtttattttcttcatcatgtgtttttggaaattcatatatttaattttatgttcttagatttctttcattatctgtttttaaactattggcatttctctggtatcagcatgtctgctttggcaataagtgggaatgatattcactttttcaagcaaaagcttcataaacttagtatcaaatggtttaagtccatgtcctgaaggagaaatgaagtataaacaaccctgcaccctgttatgaggcatctgacatctgttttatcatgattctccatttaggtggtcctcaatttactatcagtgtagtcagtaaccaacaattactattacccattgcaagtctaaatcatgggatatcaactcttgtgagcagcaactgaacaccaccttctttgattaaaactttgcatagttccacctgcacggtctttttaattctgtgagaagaatctggatactctggagaatacagagtgaagaataatgagttgattaatgtaaagtttctgaatccagatttccccactgccataagtatgaattccaaccctctcttcactgattttctggatatttgatttgggagactggaaaatcccacgtagacttcagggttcttccgttgagctaccatgctgctgttgatgcttctctcctcagcagcagatctcttgctgactgacataccctccccactccatgactagccccagctggaaatcttatttagaggttaaataaaatgtgttccagagatttaaagataaatgaaatattataaatttgttcagacccgtagaatgtacaacaccaagaatgaaccctaaggtaaactgtagacgttgggtgatagtgatgtgtcagtgtagattcatcaattgtaataaatgtaccacttttggtagtggatgttgataatgtgggaggctatgcatatgtaggatggggaatatggctgtacctttgaattttgctgtgaacttaaaaatactctaaaaaatagtatttaaaaaatcttaaaataggccaggcacggtggctcacgtctgtaatcccagcactttgggaggctgaggcaggtagatcacgaggttgggagatcgagaccatcttggccagcgtggtgaaaccctgtctctactgaaaatacaaaaattagctgggcgtggtggcgtgtgcctgtaatcacagctactcgggaggctgaggcaggagaatggcttgaaccagggagtttgcagtaagccaagatcacaccagtgcactccagcctggcaacagagcgaaactctgtctcaaaaaaacaaaatctcaaaataaaattaaaaagtgaaagagaaggactttcaggcaaacaaaatataaatgtaatagtaataaaaatatgaaacatggatgtttcatatgctagaaggtaaaaattttaattttatcttttttttctcttatagacattccacttcttccatctattacatctctgagtctaaatgaaaatgaagagaagaccggaccttttgttgtacactggctaaacaataaagaactgcattttactttgtccatggaagtttttttacagcaacttagaaaaagttttgaacaaccatcttctgaggccagtgtagaagattctaatcaggcagatgtaaaatctgatgaaggtaaactttaagaggaaaggaaaatttaaagttttgctcaaaatagcaaacattttcatattagggtaaaactagctacttgtaataaactttaaagttgcaatgacatgatccaaacatggactagctcatttaataatctaatgtagatatttctgttataggtagctttcttccacatggttatttaaggactgggggttctcattcttctggttttgttagcccttaggactttcctatataaaggactatctgtagactagcagcattggtgttacccaggagcttgttagaatgcatgtctcaaggtccacacagacccaccaaaccagaatctgcaatttaatgaaatttccaggtgatttgtatgtacattaaagtttgagaagcattgaaactaggacattaaatttctctgcctttggccttcagttggtatagagagagagttagagagaaagaaagcatagctatttgtcagctaccttgattgacgcatatcacttacactgtcattcagctggcaagaacattcagctggaattcacagggcccgtgtagttcctgactctgtagcctttatatgctgagaaatggaaagtaagaaactgtggtgtgcagctagccatctctgtgacagtctgtggttcataaatgtgtttggtttttttttttaaagttttgttttaatttgtttaatttttaatttcaagatggtttatgatcattaggtaagaaaaatcaaacaggtacacagatagttatgaagtttccacattgttaagtttgataagtatccttccagtttgattctttgcttatgctcacacaaacatctaaatacagacacttaaaagttgtactgtgggtgtgcatttttatacagaaataatgttctgcactttgtgttttttttttgtttgtttgtttttttttgatggggtcttgctctgtcacccaggctggagtgcagtggcacaatcttggctcactgcagcctccacctcccgggttcaagcaattctcctgcctcagcctcccgagtagctaggattacaggcatccgccaccacacctggctaatttttttatttttagtcaagacagggtttcaccatgttagtcagactggtctcgaactcctgacctcaggtgatccatccacctgggcctcccaaagtgctgggattacaggcgtgagacaccatgctcggcctgtgctttgttttaattcagtcagtaatgggcagtttttcatatcattgtatttaacggctgctgagtattccatgtctaagagaaatgtctaacaggtcttctattgataaacatttaaattaatttaaattgtttttcattattctaggtacaatgacttgtctttttcttttttctgtgagtttttctataatcttgatttctagatggggaatttccagggagtgtagcaatttaaaatatcaataacttctgacaaattgccctccagaaatgttttaccagtttatacttcctctaagtgtatctaaatatatgctttacatccttatcaacattggatgttttcattatattacttttttttttttttgccagttgataacgggacaatggacatcttgttttactttgcattttcttgatgcaaattaagcagaatatcttttattatatttttgcccttctgtggcttgccttttaataccctttatctaatttcctgctgagtttttttttttttcttattgatttgtatatcttgacttactttttaaatctggtaaacagtcaaaacttaaaaaaaatatatctcttcagagaaaggctctatattgctaaccaggaattgggggagggtgaggggactgggatttttgaaagaggaaagaatatacatatttacctgtattgataagttgatacacagtttattttttgttactaaggtgttgaaggaaacctggaaattggcaccataaatgcatttccttgaaatgatttctttaagatgccataccagttacaagtccatacacctagaggataactaatgtagcatactgaggtttggataaacctggtactttagagataaagtacaaattacactcaaataatgtattttaaaaactcagtcccaattttagttccaattccaattccttctttttaccatgagcaaaactgaggtccagaaaagtagtgtgtgttactaaaggttaactgagtggttaaatatagaacatctgcattgagaagccagtttacttattttccagtttaatattaggtcttctaccagtaatccactgactcagtcctgtatggctactgattactcagtgaacttcagtgaccttatattcctggagcaaagttacttttaatgcagagcccatttcttattaatatgaaaactgttatgtttttcatcttgaatccatttataaagatatttgtgtgtgtgtttgtactaattgtattagttttgctaaggcattttatgttcctcacactcaaggcaaagagataaaacataatctgaagaaaaatatatacttcttcaaaataaaaagagtcttcttcattatgcagatctgggcatattgtacaatacttaatggctcaaggggatcaaagtaccagtttgatgctgattcactaaatagaatctcattcatatttgatgactggactgtttgcgggctgtgatagattgaaccattctggtgatatccccagatctcactaaataagaaaaggctctacactagaatatgtgacaattgatctggctataaattatgtctataggctctttattattataaggtggcgaaagaggcccctttcttgagcacatgtttaataaaagtattattgtcatctatagattgctggattgattttgtgttgttataatgaagataaggtgcatataccactgtcagattaagaaagttacataacttggccgggcacagtggctcacgcctgtaatgccagtactttgggaggccgaggcaggtggatcacgaggtcaggagttcaagaccagcttgaccaagatggtgaaaccccgtctctactaaaaagtacaaaaattagccgggcgcagtggcaggcacctgtaatcccagctacttgggaggctgaggcggaattgcttggacccgggcagcagaggttgcagtgagctgagatcacgccactgtactccagctggggcaagagtaagactccgtctcaaaaaaaaaaaaaaaatggagcaagtcccttttctgggttgacaattagtcctatattggcattgctgctggctatgaaactcaccaccaaaggtaaacgattaatttgaactacttggtaggtgttatggtaacaaatgatacttttattttttgaaagtccaagttttctcctttcatctgtgcaagggcaaaagtagataagaaactagatctcaaagtatgctctggagcattatcattaagcattacatttactggtttacttaaagtatattgcaaagaatacggataaagagatgtgtagggtgaggtgtggcggaaggggtacagagcttccatgctctccttaggcatgagatctccatgtgttcagctatccagaagctcggtaattcttaatttatagtaataacctgtttgtatttacttggttcatgaactcttttgcttatagaaactgatgatggtgttgatgatctgaaaataaatcccgaaaagaaggaattaggctgtgataaaatggtaccaaactcaagttttacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtactactgttatttctggagagctacttccttgtttatgtgggtactattttctaatacctctttatataattttatatgttctaacacttgctttcttgattctaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaattaagtatttttacgcctaatgttatgatgatatcaaaacatgctgatggttctctgaatcagtggctggtcagttttgccgaggaatctgctttttctactgttctcagtatttcccacaaatccagatattgtggtcatcgttttcatcttaatgatttagcttgccactcagtattaccattattgctgacaacatcacaccataatgcattaaggacaccagatgttgataacccagagcaaccttttgatgctctaaatattgaagaatgctctttgacacaacaaaataaaagcactgttgacgtggcatttcaggatcccagtgcagtttacagtgagcttattctgtggagggttgacccagttgggccattgtctttttctggaggagtttctgagcttgcccggattaattctcttcatgtttctgccttttccaatgtggcatggctgcccactcttatacccagttattgtctgggtaagtattctggtttttattacagtaatttagatttgctgacattatcatcaaagggtgaaattttaatatttgtaaatactttctaggtgcatactgcaactctcctagtgcatgctttgtagccagtgatggacaatatctgagattatatgaagcagttattgatgctaagaaacttttatctgagctttctaaccctgaaatttctgtaagtaatgtcttttaaaacagcttaagtatataatattatgttttcagatagtttatatttattgggcatgttctacaattgtgacctataatttgtaataagcatttgtatctttgttttattttttcacatttgtactcttgtaatgatttaaagctcctttaaaaggaaaccatttctttcactctttgaaagaaagtagagtctcatctcctgtaatatgtttctgtaacacttctttactcatagataaatgaggactactgacagtataatgtagaagttatatcggcccccctgcaattattttataggcaggaggagctggaacaacaggaatagaattttaatcttaaacatgaaaagaaagagcccttagcttggttacagttcagacaagagttctttcagtattgttgtaaggcttttgccttatgacaggccacatttgttctcatacccacctaataacaaccttctaactgcattgtcttgggacatccaacaagcaagcgtttccacttttctggttttggcgatttttcttttggtatccccagaggcagccttcggctgtaccaagctttctatttaggagattcaagccatctccctgactaccaattaatgtatttgttaatgctcggcttacagagttgcataaatgtcagtgatctgttccaatcctgtttttttctgtaagttaattttaatgcataattttgcagaacacaaggttttccaaagcatgtatatagtattacagtagaaatgtatatattttggggggggtcttctatttatcaggcatttttaagtaatgggaatttagatgtgaagaaaacaggtaaaaatttgtatcatagagcttatattcgggtgaagggagataggaagaaaacagataaaaatatattaattaaaaatactatggatagaaacagtgttgcagaagaattaggaattgccaagtaagttgctggtcagggaaaatttcacagaaaaagtactatttgattaaagatctgaaggagatgtgggaactagatacgtagatatttattaaagagaatgtgatttgggaaaacggacagccagttcagagatcccaaggccggagcatgtttggtatgtgataaggtttggctctgtgtcccacccaaatctcatcttgaattatacttcccacgtgttgagggagggacctggtgggaggtgattggatcatgggggcagttctcccatcctgttctcatgatagtgagggagttctcacaagatctgatgatcttaaaagtggcagtttcccctgtgcacgtgccgtctcctgacacctgtgaagaaggtgcttgcttctcctttgccttctgccatgattgtaagtcctgaggcctcctgagccatgtagaattatgaatcaattaaacttatttataaattacccagtctcaggtatttcttcatagagtgtaaaaacagcctactacagataattggtaccaggagtggggcactgctataaggataacccaaaatgtggaagcggtgttggaactgggtaacaggcagaggttggaatagtttggagggctcagaagaagacaggaagatgtgggaaagtttggaacttcctagagacttgttgaatggttttgaccaaaatgctgatagtgatacggacaatgaagtcccggctgaggtagtctctgatggagatgacgaacttactgggatctggagcaaagatcactcatgttaatgctttagcaaagagactggttgcattttggccctgctctagagatctgtggaactttgaacttgagagatgatttaggttatctggcagaagaaatttctaagcagcaaagcattcaagaggtcacctggcttattctgaatgcattcagttatatgtgtttacaaagagatggtttgaaattgaaatttatgttaacttacgtttaaaagggaagcagagcataaaggtttagaaaatatgcagcctgaccatgtggtagaaaagaaaaactcattcctggagaagaattcaagggctacagaaatttgcataagtaaccaggagctgaatgttaatagccaaggcaatggggaaaatgtctctgggacatgtcaaagatcttcatggcagcccctcccatcagaggtccagaggcctaagcgggaaaatggtttcatgggccaggcccagggcccagctgctctgtgcagccttgggattcagtgccctgcctcccagctgctctagctccagccatggctaaaaggggccgtggtacagctgcggctgttgcttcagagagtgcaagccccaagccttggcagctgccacatggtattgggcctgtgggtatgcagaagatgagagttgaggcttggcagcaaccacctagatttcagaggatgtatggaaacacctggatgttcaggcagaggtctgcggcaggggcgaagccctcatggaaaacttctactagggcaatgcagagggagaaagtggagttggagcgtcccacagagtccccactggggcctcatggaactgggagaagaggaccaccatcatcctccagaccccaaaaaggtagatccactgacagtttgcaccatgtgcctggaaaagccataagcactcaacactagcctgtgaaagcagccacaggcactgtaccctgcagagccacaggggcagagtttcccaaggccgtgggaacccacacctgtgtcaatgtgccctggatgcaagacatgtagtcaaaggagattttggagcttaagatttaatgactgcctggccaggtttcagacttgcatggggcttatggcccctttgttttggccagtttcttctatttggaacagaacatttacccaatgcctgtgctcgcattgtatcttggaagtaaccaacttgcttttgattttacaggctcataggcagaagggagttcccttgtctcagatgatactttggacttggacttttgggttaatgctgtaaggagttaagactttggggaactattgggaaggcatgattggttttgaaatgtgaaaaggggatttgggaggggcttgggtggattgatatggtttattgctgtgtgctcacccaaatctcatttcgaattataattgccacatatcaagggaggcacctggtgggaggtgataggaacatggtggccatttcccttatgctgtttgcattatagtgagcaagttctcacaagatctgatggtttaaaaagtgtcagtttcccctgcatgctttctttcctgccaccttgtgaagaaggtgcttgcttctccttcatcttccgccatgattgtaagtttcctgagggctcccctgccatgcagaactgtgagtctgttaaaattacccagtctcaggtatttatttatagcagtatgaaaatggactaatacagtatgtaaaggaacagcaaaaaggccactgtggctggagcagagcatgtgaggtggaaaatagtcagggataaagtcggaaagttagcctggccaggtcatatgaagcctgataggccattgtggtaacttcaggttttactctgaataacatggaaactatagaagaggtatgaaatgatttaggttttaaatgattcctctggtggctatatagattagacgtgggatgcggaagtagatccagagagaccaatttaggaaccaattacagtagtccaggagagggaaaaaaggagcttagaatatagcaagtggtaatggcagagatgataaaaatggccaaattcaagatgttgtttagaacattgaatagctatgaatggactggatgcggtatgtgtgagaaaaaaagaggactcccaaggtttgtgattgaatattaggaagaacagaattgctgtgaattgagatgtggaagaatgtagaagtagcaggttttgaggggcagggaaattcaagagtctggctttggtcatattaattttgagatgcctgtttgacatccaaaagacatagtaggttagtatctggagttcagagagaggtctggcctgaaaatatacagtagttgtcagcatataaatttgaagttgtggaagtgaatgagattgccaagggtgagactatagttagaaaacagaagtgttaagccaggaacgatggctcatgcctgtagtcccagcacttttggaggccgtggcaggtggatcacttgaggtcagaagtttgagaccagcttggccaacatggtgaaaccccatctattaaaaatataaaaattagccagatgtggtggcaggaacctgtagtctcagctacctgggaggctgaggcaggagaatcacttgaaactgggaggcagaggttgcagtgagccaagatgacacgactgcactccagccttgggtgacagagagagacaccatcttaagaagtaatagattgaatgtgtgctcacttcagcagcacataaactgaaattggaataatactgagaagatgagcatggctcctgtgcaaggatgacatgcaaattcatgaagtgttccatatttctccagaagagactggggacctatattcaacatccttaaagaaaaaaaagtcttcaaccaagaatttcatatctagtcaaactaagcttccgaagtgaagaagaaataagatcctttttagataaaccaatgttgagggagtttgccttacaagaggtcttgaagggagtagtaaatattgaatggaaagatcactaccacctaatataaaaacacacttaaatatacacagaccagtaacactataaagcaaccacacaagccagcatagtaaccagctaacaacataataacacaatcagatccacacatgtcagtgctaaccttgaatgtaaacaggcttaatgccccacgtaaaaggtatagagtggcacactggatttaaaaaaacaatggtatgtggtcttcaagagacccctctcacatgtaatgacacccataggctcaaaataaagggatggagaaaaatctaccaagtaaatggaaatcagaaagaagccgggttgccatcctgatttcagacaaagcagactctgaaccaacaaagattagaaaaagacaaagaagggcattacacaatggtaaagggttcaattcaacaagaagacctaactatggtaaatatatatgcaaccaacacaggagcacccagattcataaaacaacttcttagaaacctacaaagagacatagactcccacacaataatagtgggagccttcaacacttcaatgtcagtattagacagctcatcgaggcagaagagtaacagagatattccggacctgaactcaacattggaccaaatgtatctgacagactgctgcagaactctccacccaaaacaacagaatatatattcctctcattgccacgtcacatactctaaattggaccacataattggacataaaacaatcctcagcaaatgcagaagaaccaaaatcataccaaacacactgttggaccacagtgcaataaaaatagaagtcaggatttaaaaaatagcttaaaccagtcaattacatggatattaaaaacatgctcctgaatgacttttgggtaaatagtgaaattaagacagaaaccaagaagttctctgaaagtaatgggaataaagatataacatgccagaatctctgggacacaactaaggcagtgttaagatggaaatttatagtactaaatgcccacatcaaaaagtcagaaagatctcaaactaataacctaacatcactactgaaagaactagagaaggaaaaacaaatcaaccccaaagctagcagaagataagcaataatcaaaatcagagatgaactgaaggaaatcgaaacacaaaataccattcaaaagatcagcaattccaggaaatggctgtttgaaaagattaataagataagtacgttgctaactaagccaatagaaaatccaaataaacccaattagaaattaccaagggaatgttaaccactgactctacagaaataaaaacaataatcagaaactactacgaacacctctgtgcacacagactacaaaacctacaagggatggataaattcctggacatataccccctcctaagactgaaccaggaagaaattgattccctaaacagactaatacgagctccgaaattgagtcagtaataaatagcctaccaaccgaaaaacccaggatctgagggattcatagctgaattacaccagatgcacaaagaagagctggtaccattcctactgaaactattccaaaaaattgaggaggagggactcctccccaactaattttttgaggccagcattatcctgataccaaaacctggcagacacacacacacaaaaagaaaactttagcccaatatcctctatgaatatcaatgcaaaaatccttgacaaaatactggcaagccaaatccagcagcacattaaaaagctagttcacagtgatcaagtaggcttaattcccgggatgcaagttttgttcaacatatgaaaattaaatgtgatttatcacataaggagaactgaagacaaaaaacacataatttttttgatagatgcagaaaaggtttttgataaaattcaacattccttcatgttaaaaactctcaataaactaggtgttgaaggaacatacctcagaataataagagctatctttgacagactctcagccaacatcatactgaatgggcaaaagctggaagcattccccctgaaaactgacacaaggaaaggatgccctgtcttgccactcctattcagcatattattggaagtgctggccacagcaatcaggaaagaggaataaaaggcatctaaataggaagagaggaagtaaaactatcactgtttgtacatgacatgtttctatatctagataaccctatgtcttggcccaaaagctcctagatctgataaacagcttcagtaaagtttcaggatacaaaaattaatgtagaagaaatgactagcattcctatacaccaacaacagctaatctgagaaccaattcaggaagacagtcccattcccaactgccacaaaaagaataaaatacctaggaatacagctatccaggggggtggaagatctctacaatgagaattacaaaacattgctcagataaatcagagaagacacaaacacatgggaaaaacatcctatgttgatggatagaaagaatcaatatcattaaaatgaccatactgcccaaagtatggcccaaaaatttacagattcaatgctattcctatcaaactaccaacaacattgttcacagaactagagaaacctattttaaaagtcatatggaaccaaaataagaggctgtgtagccaaggcaatcgtaaaaaaaagaacagagctttgaggtatcatgttacccgacttcaaactatactgcagggatacagtagccaaaacagcatagtagtggtacaaaaacaggcacattgaccaatggaacacaatagagaatccagatataagaccacacacctacaactgtctgatctttgacaaacctgacaaaaacaagcaatggggaaaggattccattaataaatgatgctggcagaattggctagccatatgtagaaaattgaaactggatcccttccttacatcatatacagaaatcaactcaaaatggattaaagacttaaatgtaaaacctaaaactctaaaaaccctggaagacaatctaggcgataccattctggacataggaatgggcagtgatttcatgacaaagacatcaaaagcaatcataacagagtaaatagacaacctacagaataggagaaaatatttgcaaactatgcatctgagaaaggtctgaatatccaacatctgtaaggaacttaaatttacaagagaaaaacagctccatcaaaaagtgagtaaaggacatgagcacttttcaaaagaagacatacgtgtggcaacaaacatgataaaaagctcaatcactgatcattagagaaatgcagataaaaaccgcaatgtggcaccatctcacaccagtcagaatggctattattaaaaagtaaaaaaaaaaaaaaaaaaaaagatgctgatgaggttgcagtgaaaagggaacacttacacagtgttgatgggagtgtaaattaattcaaccgttgtggaaagcagtactgtgattcctcaaagagctaaaaacaaaactgccttttgacccagcaatcccattactggctatgtacctagaggagtataaatcattctgtggtaagggcacatgcaggcaaatgttcattgcagcattattcacaatagcaaagacatagaatcaacccaaatgcccatgagtgacagattggattaagaaaatgtggtacatacacatgatggaatactgtgcagccataaaaaagaatgaaatgatgtaatttgcaggaacatgggtggagctggcattcataaagcaacttctttatggaggccattctttaaggaggccattatccttagcaaactaacaggaatagaaaaccagatactgcatgttctcacttacaagtgggagctaaataatgagaactcatgaacccaaagaatggaaaaacagacactggggacttcttcatgttggaagttgggaggagggagaggaccagaaaaaataactctcgggtactgggcttagtacctggatgatgaaataatctgtacaacaaagccctgtgacatgagtttagcacacgtactcccaaacctacaatgaaagttaaaaaaaattaaagattgaatgctggaatgctcggttaaaagtagggtggaaatacaagggtgaatgtggtgtataatggaaggcaaaagaaaaaaaatatttcaaggaggaagaaggaatgattaccaagatcagatactgctgataaaggaagtctgataaagatttgaaaatagaccactgaatttagcagtgtgaccttgactaaagcagtcaggacatgaatggctcaagagatcagcatatttgaatagtatgtaatcttgtttctttagctctatccttcctatctcaaaattaatgtttaaaaagcactaattattagaacatttctaggagattgaaatcaatttttcacatttatggatgtaatttttttccttaacagttatcaagcattacttttatttttctctgtaccaactgagctgtaatgctttttcattcgtttgttaattcctataaagactaaagacctagaatttttatagttgaaagggactatatttaggcccacttgaattttattgttatttatctgttatgcttgaaattttgttatttactcttatttgcatatgaattgtttagtaaattataaatttttttaaaaaaaacagaaatatgttggtgaagtctttaacatcgtcagtcaacaatcaacagccaggccaggatgcattattgcattagatcccattaccaaacttgtaagtattaattttgggggggaggtatattaaaaaaaagtttatgaaagcattttgcataaaatctatatattaatgtaatttgaaaatttgctatatatttacaggtagattcagtaattaactcatcacataatagataacatattattgtatattttacttcctagacttcaaactagaaaacaaattatcctcattactatattcacagccaaataaattttcaaactttgactcaaacatattagaaatattatcatattaccattagatttaataaagtggtgttaggttcctcatccatggttattgaaaatcactgaaaagaaaactaggttccaatttgtggctaaataaaaaacattggtggatattatttcttacttataaagactcattgtaatgaaagcaaatcatcttgacctaaatttttatattcatctgtttaatctaatggaggtgccatacgcttacgttctgctgaacttttgacttcttattctgcctttaaatatctcattatgaagtattatttttctggctatttagcattaggtaaataacacataggtcaacttacgttgatatttatttatattcagcatggcagaaaaacccaactgcttcatgtttttgaagaagacttcattttgaataaccttgagaagaaaagccttggcaaagacagcattttatctaatgcaggtaaggaagaattatttatggaatgagaaatactatgtacagtatgttaggcagttaataaagatgaattggtaaaatgctttacattgtctatttgaagtaaaaattggggtaggtttgtttattaaatatttatcataaatatgagtatctttttattcttaaccaggtaataaatacgaacaaaattaaaggggcatcttggttgtatgttttttaaactgcataatagaaatgctttattattaacatatgagagctttttgcatggatggggtcctacccatccatttggatattatggacctcctgccttttgaaaatttataatttaaagaagtagcttaaaacttcaagctagaaggtccttaatttaaaaactaattgtcttaattaatgcttttataataaaagtttttaaaatgttaaactcctctcatcaacactttacatgaaggcacactgagtaaaataaagctacagtctcttggtcatcacttgcgattacagagccaaaccaaactcaaaaatggcattcttgaatatcacaatcttataaatcaattatacagtatgtgcctgttgcacaaagaagttatcaagattcatatgttaaatatcttctccatttgttcagacttttttcttctcttttacatcatgtctttctgccaccttttccatttttcttttatgagaagtactccttagagttctgcacttttatgttgacatctaatttcttaccattgcttttagtcttctatcagttttctctgagttaatgagctgtgcaaatacactttatgtgttttttaaaactctgaacatgttggaagtatgctaaaaatggggattaaagatatcaggcgtaagagataagattatttattgtataaacaaaactatccttttcatattaaaatattaatgaacatgttaatattgttaacaatttaagtctctttaaaacttttaaaagaagttactctcctttgcataataaggttgagtttttctgtgttcttcttgtattctagcatttgcttttttcggattcttcaatttttaatgtattttaattctctttaaggctaagatttttcttaaaatattcaggaaatttttacttttacccaaaaactattatgttcattattagagtttcctagaaaatacctaaggagttaatggtttcatatcttttgctctattatgaagaagaaaaatgttttacaaatattttcattattggagcattttttgttgttagtgaaattatcaaaactaggattgatttctattctgtttacttttgttataatctttatccttttctcttaatttctgtattttggatgcctaacttagaatacattaccaaagttaccttttcatttagtctctcaatacaagatgatttaaaacatttatggttaccttttttaatttttttgctatgcaaatttataaaagggcaaagtctttgtgctctaataatacctgctttctcatgttttacatgttctacgatttattttgtttttataatgtaattttcgtttacctaattgtgcacatagtgaataatagattataatgaagaaaacttggattaaaatctattgttaaaaaggtttttcaggcaataataaatcattgatttttctgatgtattttaaaaagatatgtttattttgagcaactcgtgtgctgtttatgcaatttgggagaagacaaattttcttgaatgatatgttttataatgaaaacttatggtttggccattggataaatatcatgaagtcatccattatagaacttattcatttgaaaaatgtttggcaccaccatttcatcatgatatgttgagttgaagtacatattacatagttcctatctgtttagaaatttcctacttcttatggtttaatctttgtgaacaatttgatgatgatgactgtaaacctatcaattcaaacatgaaatagcatacatattattgtaaaaattttaagttaatacaaattcatgtggtaaaggatttgaatatattttataataccacttgtgtttgaagccttaggtaaaagtttttaatcttctttttttaaagtccaattattttaacttggcatgtttagcaagttgtctcttttacacatagtaacagtgaaaaatatcattaataccaacaggcagctcacctaatggattttctgagaagttctacctaattgtaatagaatgcactcaagacaaccgttcactgttacacatgtggaatttacatctaaagtcaattcctgtctcattaggtgagtcttttgtgtgtgtgtttgtgcaactttaataggtgtaagttaacaaattacacaaaattagataatttgggacatatttcttaaagccattctcattaaatggtgataactgtagattattcaattaattcaaaaagcttttcttattttctttctgtgaagaatcatattaatatgtttactattttatcttttacaaggcagttttggattgtaaaatgtaacaatcgtaatatttatagggttcccctgcctcagtttttggttcttttcttatgttttgtagatgaaaaagtagatacaaaattatccgaagcggtttggcagccagaagaacattattcttcttctccagagaagatcctatctcctttttcacaaaagtatcaggcttgcagagcaaatctccagagtaccagcaggttgactctgttttcagaaatggtttatagccaagaattgcatttaccagaaggagttgagataataagtattaagccatcagcaggtttgtaaattttatgaaaagagactaattttgtaacacatgagtatttaccaggtatttaaaaataggtgctgcaactatctcttaaatccacacagaactagaaatggaaataatatattcaagtaccctaaattgaagacttatagttctcattatgttttcagattactctgacatttatcagccagttctagtcttaaatattgatttctaaaacaaattttctttgtctttttgggaagacaaagggacagtttctggagcggagatggtaactaagttgtactttatttgcagactttgatggtattggcaatagctgcctggagccatgattctgattgtgtggtttctgctatatatttattatccttattccagagcagtggttttcaaagtgtccccaggccagcagcatcagcgtcctggaaacttgttagaaattggccactccatttcttgggccacccagggttactgaatctcagactctgggatggggcccagtggcctggacttacaaacctttaaagtgattcttatgcttgcaaaaggtcaagaaccactgttctggagtatcaagaatactaatcaaaaatacaaattaaggcttatgttttaggaaactaatagtgcatgattactttaagtctaagcaaatgttaagttgtagttaggaatcttctcagcatttgttatggcaaatatacctcaatcatgaagggccctgtaaagtgaccattcagtacttaagtaaacataggccattcacatttatattgaaaaatgtgaaagagaaggagccagtgagtgttgacaaatttaaaaaaatgcattgatacctttaaaattagatttataatgtataaaactagcaaagagctgtgaaacaaattcgggattaactagaattaaattctgcctatgcctaagttgtttgatttaggcccaagatgtttaaccttcaagaattgaagtaaattatctcagagttccctttcaactctaggttttggtgatactttctttttatatacctttctgatgtcattaaaagcctctttcttactattcttgctgcccctttttaacttaaataaatataggctgtctattatgcagtttaaaaaacatacagccaagatgcccctttgattttgttcatatttatagtagttaatacaaaagactaaaatcgtaagtacataaaaacagaagtatttaaccaaatttgacattttgttaacggattatttttattttaggacatctgagttcatcttctatatatcctgcatgcagtgctccttatttattggcaacttcatgttcagatgagaaagtaagattctggagatgcagagtaacagatggagaatctgccacgtcaaagaatggaaaaattgatcttgcatacatttgggaagaatggccattacttattgaagatggacttcagagcaatagtagtataactgtacctggtaggcctgtagaagttagctgtgcacatacaaatcgtttagcagtagcttataagcagcctgcatctaatagtagatcttcccaggactttgtgatgcatgtaagtatttttgaatgtgagtcaacaggaggttcatgttgggtccttgagcagacaattcatttagatgagttaagcacagtattggattctggcattagtgttgatagcaatttagtggcctataataaacaagacatgtatttatctagtaaagagaatatcacatcaaacacaaagcatttagttcacttagattggatgtctagagaagacggttctcatatcctgactgtaggaattggatcaaaactttttatgtatggacccctggctggcaaggtacaagaccaaactggtaaggaaaccctggcatttcctctctgggagagtaccaaagttgtgcccctttctaaatttgtactattacgaagtgtggacctagtttcttctgtagatggctccccaccttttcctgtttctttatcgtgggtccgggatggcatccttgtggtaggaatggactgtgaaatgcatgtgtattgccaatggcaaccatcttctaaacaagaacctgttataacagattcgtacagtgggagcactccatctataacaagtttaataaaacagagtaactccagttctgggttacatcctccaaagaaaactctgactcgatccatgaccagtcttgcacagaaaatctgtggaaagaaaactgcattcgatccttcagtggatatggaagattcaggtctttttgaagcagctcatgtactttccccgactctacctcagtatcatcccttgcagcttttggaactcatggatcttggtaaagttcggagagccaaggccatcttgtcccatcttgttaagtgcattgctggggaagttgtggctctgaatgaagctgaatctaatcatgaacgccgccttaggtctctcacaatcagtgctagtggaagcactaccagagacccccaggcattcaacaaggctgaaaatacagattacacagaaatagattctgttcctccacttcctttatatgccttacttgcagcagatgatgatagctgttactcatctttggagaaatctagtaatgagagtacgttaagtaaatcaaaccaattatctaaagaaagttatgatgagctttttcagactcaacttctaatgactgatactcatatgttagagacagatgaagaaaatacaaagcctagagttattgacctttcacagtacagtccgacttactttggacctgagcatgctcaggttctttctggccacttacttcattctagtttaccaggactcagccggatggagcagatgtctttgatggccttagcagatacaattgcaactacaagcactgatattggagaaagccgagacagaagccaaggtaaaactaaactccgtactgataacatttttacttactttcacagaaaataattttaaataatttttattaaaatgatgccattggctaggcacaggggcttatgcctgtaaattcagctctttgggaggctgaggcaggaggatcacttgaacctaggagtttaagaccagtctgggcaacatagttgagacccccatctctatgaaaacaaaaaaaaattagccagatatggtgcctcatgcctatagtcctagctactcaggaggctgaggtgggatgatgcttgagcccaggaggttgagctggcagtgaactgattgtgccactgcactacagcctggacaatagagcaagaccctgtctcttaaaaaaaaaaataccatgaaggttttttttggaaacatctttgctaccttcacaacagttttaactttttttccccccgagactatcataaacagcaaactcttaatatgcactatttatcctgtaaatcatagtactatgagcgagtgcacaaagactcgttatgctgttcatttttactaattttctgctcaatagtataaaagatccaactgaatctttctgagtttagcaaaatttaacagattcttattaaacaattattttaagtacctaaaaatgtggtttctgggttttttcccctcattttgtaataatccactattaacaattataatttggtttttaaaacattgagttttttttaaattagcattaatgtatgctcctacctagaaaagcataatgtaattaggtcttttcctcacccagagagcatttaaaaaaaaaatactgccaagttatgaacagtttgccataaaatctcaagtaagttctgaaatgaacaaattgagccttgtagaccatatatacgtcagtatccctttgaatgaaacttgaaaggaaaatatagggtaaatttaatataataacaaaatttaaatttaagaaaaattaagttggttatgaatcttgacacttttagagatattactagtagatactatttttgatgtgaatatgttataggtgttttatgtttttagtttttgcttcaaggaaaaaatatcaggccctcccaccatagaactgtttctcccagtgttaacagcagattattggggtggatgtatgattcgaacaaactgtattggttaaagataatactgtacatgtgccacagaaaaggttaaactgttcaaaaatcagtcacattttaatttaaataagatttcagtcagaagaggtcagtttataaagagtatcagattctctttattctctttattatttttccaattgtttatactattttttctgtaatgtaaaattctgtagaaaaagataaatgttagaaaatattttacactgataacttttttcttggtcaggttaagaatgttatatgcctatattgggtgttcttttgcttacaattttttttttaatacattgcttcccctttctcccattgcaggtggagaaactcttgatgaatgtgggttaaaatttcttttggctgttcgactccatacctttcttacaacttcccttccagcctatcgagctcaactccttcaccaaggtgattttgatagtaatctattaaagggaaataaagcgagtagaaaatgagagacttgggagtttttaaacttgtttttacccaaaaatgataatgatgacatatttaacatattttaagtttcctttatttgttaaaatgtttattttgtcataatctttgcttaaaacattggaatttttaatggtaggcaaaaggagttaatgaagaaacatactggagatgttctgtgttatgtttttaaatgcatgatatgttcaaggcaaattagtattgtttcattttctttaatttcttctttagattgtcttttctctccttttttttgacatttatctaaattcagtttttccaccaaacattgaataacatttgtgttataatacattctcaaattttaaatatttcacagagtacagaatattgaaagtgtaaatttacccacacttaaaactactgataaaatatgtatttcagatattagtttagtatatttcatgtattctatatttagtgctgtatttcagatactgttagttctcttactttgaactatcttagactttgaactgtcttagcataacgtaatagattcttattaaacgattattgtaggtaccagaaaataacattgtcttagagagttcaaagtaagagaaatctcacttaagttcacttaaacaaaacagcatgttttttggctcatctcccgggaagttcaagaaatagagctgactttcagcattattggaactataggtttaaaaagtgttattgggactttgcagtttagccttttagcctctgctccttggtctcagtctcttgctcgtaccttatgtctctgtctctttgtttctctcactattttctttttctcattttgcatatagctttgaaaaaagtaaagttgaaaattctaaatcaaattctttttagttttttttttttcttttttgagatagagtcttgctctgtcacccaggctggagtacagtggtgtgatttccgcacactgcaacctccatttcctgggttcaactgattctcctgcctcagcctctcgaatacctgggactacaggcgcacaccaccacgcctggctaatttttgtatttttaatagagatggggtttcaccatattggccaggctagtcttgaactcctgacctcaagcaatccacctgcctcggcctcccaaagtgctgggcattatgggcgtgagccatcttgccaggccaaattctctttaaaatttttagattgtaatttagcacattaaaattgtatgtatttatagggtacaaagtaatgttctgatatatgtatacaaagtggaatgattaagtcaaactaaacatatccatcacctcagatatgtaaaatatttgtggtaagaatatttgaaatgtactctcttagcaatattgaaatatacaatacactattattaaaggtagctaccatgctgtgcagtagatatcaaaaatgtattcctcctaactgaaactttttaccctttgaccaatgtctcccttctcatcctgtccccagccttgggcaaataccgtttattctctgtttctttgatttcaattgtattcgattccacagataagtgagatcatgcaatatttgtctatgactggcttatttcacttactgtaatgttctccaggttcatccatgttgttgcaaatgacaagatttcgttttttaaggctgactggtactccagtgtatatacaggcatactcctttttattgtgttctgctaggttgcattttgcaaatacagcagtttttacaaattgaagctttgtggcaaccgtttgttgagcaagtctttcagcaccgtttttccaacagcatgtgttcacttcatgtctctgtgtctcattttggtaattctcacaatatttcaaactttttctgtcatctgtgatcagtgatctttgttactattataatggttttggagtgccatgaactgcgcctatgtaggacaatgaatttaatcaataaatgttgtgtgtactgtggctacaacactgatcagccattcccctgtatttctccctctgctcagacctccctattcactgagacataacaatatagaaattaggacagtttaacaaccctacaatgtcttctaagtgttcaagtgaaaggaagagctgcatatctctccctttaaatcaaaagctagaaaggactaagcttagtaaggaaggcatgttgaaagccgagataggctgaaagctaagcctcttgtgccaaacagtttaccaaattgtaaatgcaaaggacaaggtccaaaggaaactaaacgttctccattgaacacataaatgataagaaagcaaggtagccttattgcttatgtggagaaagtttgagtggtctagatggatcgaactagccacaagattctcttatgccaaagcctaatccagaacaaggctgtaactcgtcttaatttcatgaaagctgagagaagtgaggaagctgcacaattaaagtttgaagctagcagaggttggtccatgaggtttaaggaaaggagctttctccgtaaactacaagtacaaggtgaagctaggtcttctggataacatgctgaagcttctacgtcattcagcacttgcttcagcatgttttccagaggatctagctaagataatggatgaaggtggctacacaaaaggacagatttttaaagtacatggaacagccttctgttggaagaagatgccatctaggactttcgtagttagagagcagtcagtgcctggcttcaaagaacagactgactcttgttaggggctaatgcagctggtaactaagttgaagccaatgcccatttaccattctgaaaatcctagagtgtttaagaattatgtgaaacctattctgcctgcgctctacacatggaatagcaaagcccaatggcagcacctctgtttatagcataatttactgaatatttgcagcctactattgagaccttctgttgagaagaaagatttcctttcgaaatattgctgttattgacagtgacctgttcacgcaagagctctgatgcaggtgtacaaggagattaatatagtttttatgcctgctaacacaacattcattttgcagtccatgaatcaaagaatgcctccaacttttaagtcttatcatttaagaaatacatttcataaggctatagctgctatagataattattcctctgatggatctggacaaagtaaattgaaaaccactggaaaggcttcaccattctagatgccattggggacatgtgtaattcatgggaggaggtcaaaatatcaacattaacaagagtttggaagaagttgattccagccttcacagatgactttgagaggttcaagacttcagtagaggaagtaattgcagatacggtagaaatagcaggggaactagaattaaaagtagaacctgaatatgtgactgaattgctgcaatctcagggtaaaacttcagcagagccaggcacgatggctcatccctgtaatctcaacactttgggatattgaggtgggaggatcgcttaaggccaggagtttaggatcagcctgggcaacatagacgccatctctgaaaaaaatttaggtaggtttagtgttacgtgcctgtagtcctagctattcagggagctgaataggaatatcacttgagtccaggaggtcaagactgcaacgagctatgatcacaccactgcactccagcctgggcaacaggaggagaccctgtctcaaaaaaaaaaaaaaaaaacaaaacttcagcagatgaggagttgcttcttaaaggatgagcaatgaatgtggtttcttaaggtggaatctattcctggtgaagatgcagtgaacatggttgaaatgacaacaaaggatttagaatagtctgtaaacttagttgatagagcattggcagggtttgagaggactgactccaattttgaaagaagttctaaattctatcaaatagaattacatggtatagagaaatcttacataaaaggaagagtccatctatgtggcacacttcattgttgccttattttaagaaattgctatagccatcccagccttcagtaacctctaccctgatcagtcagcagccggtaacatcaaggcaagattctccatcagcaaaaattatgacttgcttaaggctcaggtgattgttatgttttagcaatgatgtattttttaattaaggtatgtacactcattttagacataacgctattgcacagttaatagaccacagtatgatgtaaccatagcttgtatatgcactgggaaacaaaaaattgtgttactcattttattgcaatatttgctttattgtggtggtctgaaatcgaacccatggtatctccaaggtctgcctatatatacgatattttctttattaatttattgatggatacttaggttgaattgataactaaactattgtgaagaaaacttcacttaacattggagtgcagctatctcttcaacatactgatttcacatcctttgactatatacacataagtgggattggtggatcatgtggtaattttgtttttaaattttttctttttttttttagttaaaatttcttttcttttcttctcttttaataaaacattgtcccagaatatttttagatatttgaggaaccttcataccctcttccataatggctgtactaatttatgttcccattagcagtgtaccaggctccccttttcgccacttctttatgaaaactgtttgtttttttctctttctgataatagacattctagcaggtgtgagttgttatctcattatggctttaatttgcattttcctgatgattatagatatcaagcgcttttttcatttatctgttggacattcatatgtcttcatttgagaaatatctgttcagttcatttatcccctctggtttttttttttttcccccaagagttgagggtcttactctgttgcccaggctggagtcaaactcctggcctcaagccatcctcctgcctcagcctctcaaatagctgggtctacaggtgtgcaccacttgtgcctggcatgcctattttttaattgagttgttttcttgctattgggttacttgagttcttgatatattttggatattaactccttatcagatatacagattgcagatattatttcccaatccacggcttttctcttcactctgctaattgtattctttgctatgcagacattttcagtttgatgtcatcccatttgttcatttttgcttttgttgcccgtccctttggtgtgatatccaaaaaaatcattgcccagactgatgacatgtagttttccctctgtgttttcctctagtagttttacaatgcaggtcttatgcttaagtatttaatccattttgacctatttttgtatatggtgtaagataatggtccaatttcattcttctgcatgtggttatctagttttcccagcaccattttttgaagaaactatcctttcccattgtgtgttcctggcacgtttgacaaaaatcaattgagtataaatgtatgggttgatttccgtgccttctattctgttccattggtctgtttctgtttttacaccagtatcatgctattttggttaccctagctttgtaatatagtttgaaatcaggtagtgtgatgtctctaggtttgttctttcatctcaagtttactttgagtatttggtgtttcttggtattcctaatgaattttagggtttttttcttctatttctgtgaaaaatgacatcagtattttgatagagattgcgttgaatctgtagatcattttggatagtttggacattttaacaaattaaaaatttaacaaattaatttttccaatctgtgaacactggatatcttaccatttatttgtgtcttcaaatttctttcatcaatattttatagtttttattttagagctcttttatctccttggttaaatttttgtttttaatgagatggggtcttgctgtgttgcccaggcttttcttaaactcctgagctcaaatgatcctcccaccctggcctcccaaagtgctaggattacagatgtgagccaccggcctggccgatatatttctaaggttttttttttttttttttaagtagcaatgattaatgagattgttttgtttatttttaaaatcagatcagataatttgttgttactgtatggaaatgccactgctttttgcattttaattttgtatccttcatgtttaatgtagttgtttattagttctaactgtttctttggtggagtcttatgtgttttctgtatgtaagattgtgttgttagcaaacagtgacattttcacttctttatttcctatttggatgcctttttatttctttctcttgtctaaatgctctggcagggacttctagtactatcataattgagtagaagttgtgagagagtgcatccttgtcctctttctgatcttagaggaaaagcttttgaattgtcactgttgggtatgatgtttagctctgggcttgtcatttatggcctttgttgtgttgaggaacattccttctacacctaatttgggagagtttttgtcatgaaaggatgtcgaattttatcagatgctttttttgcatcagttgagaggatcatatggttttgtccttaattttgttaatatgaacagaatgacatcagttaatttgcacatgttgagctaatcttgaacccatggcataattcctacttgatcacagtgggtgatccttttattgtgctgttaatttggtttgctggtattttgtggggggttttacatttgtatttatcagggataatggcctataattttttttaattcattttgcctggcattggcataagggaaatcctggtctcataaaaagaggaacttttctttcctttctgttcttcggaggagttcaagaaggattggtgttagtttttctttaaatgtttagtagaattcaccggtgatgcgatcagattctaggcttttgttttgatgggttgatgggagactttttttttttctttgagacagagtctcgcttctgtcacccaacgctggagtgcagtggtgcaatctcggctcactgcaacttctgcccccgggtttcaggtgattctcctacttcagcctcctgagtagctggggtatttttagtagagacagagtttcaccatgttggcaaggctggtttggaacttctgacctcaagtaatctgcctgccttggcctcccaaaatgctggggttacaggcgtgagacgccatgcccggcctgatgggaaactttgtattactgatttatgtccttactcatcatcaatctgttcagatattttattttttcatatttcagttctggcaggttgtctgtgtctaggaagttatctatttcttctgggttatccaatttgttggcatatatctgcatattaatctcttatgattatttgtggtatcagttgtagtgtctcttcgttaacttctaattttatttttagtctttggtttatttatttattgagatagagtcttgctctgtcgcccaggctggagtgccgtggcgcctcgcagctcactgcgacctgtgcctcgtgggtccaagcgattctcctgcctcaatctctcaagtagctgggattacaggtttgctccaccacacccagctaatttttgtatttttagtagaaacagggttttgccatgttggccaggctggtctcgaactcctggtctcaagtgatctgcctgcctccgtcttctaaagtgctggtattacaggcatgagccactgcgcctagcctttctttttcttaatcttgctaaggagttgtcaattatatttatctttccagaaaactggaaagtgttcaggtttttttcccctgtcatttttctagtttatactttatttatttctcctctgattttcatttcctttcttctgctaactttgggctgagtttcttccaatttttgttccttgatgtataatagtaggttgtttatttgacagagatatatatatatatatggggggaggcactgaatgctgtaattttctctcttagaaatggttttgctgcatcccataaattttagcatattctgtttttgtatttgtttgtctcaagataatttttaatttctcttttggtttcttctttgactcattgttttttcaggagcatgttgtttaatttccacaaattggtgacttttccaagatttctcctgttatttatttctcatttcatactattgtgatcagaaaagatacttcatatgatttacatacacttgaattttttaaaacttgctttgtaatctaacacagtatctattctggggaatattctttgtgtgcacaaaaaagaatgcgtattctcttgctgtttggtagaatgttctgtacatgtcttttaggtacatttggtctaagagactaaacattctgtctggatggtctgtcctttgttgcaagtagggtattgaatccccctattattactgtattgtaatctatctctccctttagtttctttaatatttgttttcgaagtctaagtgcctctgttgttgagtacatatatatttataattattaatatcctctggatgaattgacccctttatcattatgtaacatacttctttgtctcctttcacagtttttgacttaaagtctattttgtctaagtatagctacccctattctatttcggtttctatttgagtaggatttatttaaataagaataaatttattttaattttcctctatatattcaggtagttcactgaactttttaagtggattattccaaatattcgtcagtcatttcatagatctgtttcctttgggttcattattggaaatttattagtttgtttcgagatataatgattccctgattcttcaccattctcgtgtatttgctttggggtctgctcatttgagcaagctatctggccaagatagagcttcactattaaacctagcctctgattatgcgtggttcagcctgaaatgaccccagggaggcagggcttgcagttgggttctctaggtggctaggcccctgcctttaggttctgaggttggatgttgctgctctctaggttctgctgtctggcaagaccactgtcaagaccactggctggtctctgcagtcagtcagacctgctggctgggcactgcgatagcctctaattgggctgggttacaggatgtgttctctggccaggcagtattatcgtttgggttctgaagttgggcagggttgcaggctggccccgaggttaggcagagttgttactccagatggacagattcagaggctatgttttatagaaatgcgtgtttgaagcttgccctcctgcctgaacggaaccttggtgtgaggtctggggctgggccaagcccctgtttggcctcccaggttgggcaggcctgtcttctaaggaaatacacagtgatcggtgtctccctgcctgggtaggacctgggagtggtgtttgaggctgagccaagccactgtttgaactctctggttgggcaggtctagcccctgagctttgctgaaatatgctgaggtagatgtctaccagtctgggcggggctttggggtgggctctgaggctggttgtggaggttggccatttaaggactgaagccaggttgaattttttaccatgcttctggaagcaaccagcttgactttgcaggtaggataggctattggctgttacctctaattggatgctaccactggcaggaacacagagctaccaccaacgtctgcaggctagttgctataaggtctacctcctttctttgtttctacgcaacaccagatgatctagctgtgacattgcccacattgtttcccttgaggtgagaccagcgtgagcttcctgggaaacattttagaacactggggaagctcaatgtctgaccgtggctttctttttccactgtacaaactgtggatctagggaattttcttcttgtaccgcaagcaaatcagctgggatgggaacaggtgatgtgctcaaagtgagactgttactcttacccttctactgcagtttttgtttggttctgtggtcctcgcaggtgtctcagctcattcccaagtttgggggtaaaatggcattttctaatctgtggctagttgctacttaaactctctttgtgcaggggtgtctgtcttttggggcttctataacaaatatcttagactgggtaatttgtaaataggaacaagttatttttcatatttctgcaggctgggaagtccaagatcaagacaccagcagatttggtgtctggtaagggcttgatctctgctccatagttgacaccttcttgctacatccttaaatgatggaactggtaaaaaggactacctatgtctcttgatcccttttataaggatgttaatcccattcacgagggcaatggctagttatctccttaaggctctgcctgttaatgctgttacattgcaggttaagtttcaacatgaaatctgaagggatataaatatgcaaatcatagcaaggaatgaaacctggaacttctattcctgccatcttactgatgtctaaatcagattctttaattatttatgaaaatgtattgaagttgctggagagataacaggaatccaaaaatttgatttagaataatagtccattcacaatgtagggtttttttgttttgtttttacctttcatttattttcaaagtgttccgtatagaaagcatttcacattgcttggcatgggaggtgattccttgcttggcttaggttaaaaatttgaggccatatatctcaaagccacatgctataattaatcatttactttacctagtaatgctaaacaaaatgtattatgaaaagtgaaaatagaagctgagcaataaacatgtgtaggccactgggttgagagaattactgacataaatgatgttgtataaatatacaaatatcttattaatatggtgatatggagtaataattactgtgtgccagattctattctaaattttataactatattatttaattatcaaaactatgttataagatagttccatgattatttgcattttttacatacagagagattgaggcattaagagacaacgtaacttatccaaagattatatgaatatattatgctggtacaaaagcaactgcagtttttgccttttttgatggcagaaaccacctgcaattacttttgtaccaacttaatagtcaacaatagagctggaatttattttttgtttttattttcatttttgagacagagccttactctgttgccgaggctggagtgcagtggcacgatcttgcctcactgccatgtctacctccccagttcaagtgatttttctgcctcagcttcttgagtagctgggattacaggcacataccaccatgcctggctaattgtatggttttgttttgttttgaagacggagtctcactctgttgcccaggctggagtgcagtggcacaatctcggctcactgcaagctctgcctcctgggttcacgccattctcctgcgtcagcctatcgagtagctgggactaccatgcccggctaattttttgtatttttagtagagatagggtttcaccgtgttagccaggatggtctcgatctcctgacctcgtgatccgcccgcctcggcctcccaaagtgctgggattacaggcatgagccagcgcgcccggcctaattgtacgttttttgagtagagacagggtttcaccatgttggccagactggtctcgaacttctgacctcaagtgatccacccacctaggcctcccaaagtgctgggattacagcgtaagccaccgcaccctgctagagctggaatttaacatatgcattatgattctggagtctttgcagtgctattcctaattcatcaacctgaactgcttgcttgatgtttttttttttttttactaattccatggaattacatccacaaaacaaatgttgaccaaacaaaggtgaaaagcagctttgaagacagaaatatatcaacataaaataatgctttaagtgttactcattttttaaaaaggatccgaaatacatcagcacagtggaatttgccataagcattttttcttttcctttcaaaaaaatgctatttttgcaaaacatatatgtgctcattggagtgatacagttatttgaagaaggaaaaacttaaaaaagcccatatttccaatcttaaactgtgagtctcatagaagtttacacatttatattgaaaatatggaacatacatttctgataatcatataagcatatttataattcttataaacatcattttttacatttcttcaggcctgtctacaagtcattttgcttgggcatttcactcagtagcagaagaagaactgctgaacatgttgccagccatgcagaaagatgatcccacttggtctgaactaagagctatgggtgtggggtggtgggtccggaatacccgcatcttacgcaaatgcatagaaaaagtaagtgttttattttggtgtataagtgaattaatattttttggacgtttctttaaatggcatttcatatcttctctgccattactccctcttgtttttgaagcagcaaaaggcttttgaatagtctttacatttcatttataacgtgtttcaaaatatctaaagttttaaaatgtatattctaattcccaagtttttaattgacaaacttgttagtagtatatgtctgatttttacaaaataatatatatgtttagaaaaatttaaaaatagtacagaagaacttgtaatgaaaggcaatagtcctattattctctgtatccattgaagccaccactgtaagtcacttttgttattattttatatatacatgcacatattattcatatacatatttttaaaattttattaaacattcaatggatatgtgccagcctttcatatgaaagaaattacttgttcaaaactgtttctgtgaaattttgatcaatattttttgattataggtagctaaagcagccttttatagaaagaatgatcctttagatgctgccattttttaccttgcaatgaaaaagaaagctgtgatttggggattatataggtaggtaaaaaaaaaaaaaaaaaagggtgcttcaatgtgaaaacctgttcataagaagtaaatgaatgaagtaagatttgttgttcttgttgatgttgattcatgtagattcttagttgttttatatttaaaagagagatttcgtaaggaaaaagccccaagtgtttttcagagtggaagaaacctgatgaggtcagtttaatttgttttcagatttatcaatccagaaacaatattttgcttaagaacttctcattatgctcctataaaacaaaggtaatgtattagtccgttttcatgctgctaataaagacatacccaagactgggcaatttacaaaagaaagaggtttattggacttacagttccacgtggctgggaaggcctcacaatcatggcacaaggtgaaaggcatgtctcacatggcagcagacaagacaaaacagagcttgtgcggggaaactcctgtttgtaaaaccaacaagtctcttgaggcttattcactatcacaagaatagcatggaaaagacttgccccaatgattcagttacctcccactgggtccctcccacagcacttgggaattcaagatgagatttgggtggggacacagccaaaccatatcaggtaactaaaccagaaacttatgcttgggacagggaagaagatgaattaaatggtggagtctggaacaggcatttacctctgcactatgggccagcctaccccacaaaactatctccttcctgtgggccccaccttctttctgagctgaattcacttagaatttttctctctcacttctgagcaagactggtgaacatgattatcataaatagttcatcatttgttttgagtttatttccagatgacccacatgaacagcgacctttgggggaaaaatcacgataacaaatcggttttctaagagacttgatgatttacggttgttttgattcaaggcacattctttagatttttatctcttaggtcattctcagatggcaggggtgaaaagatactgatgagtttcaatggtggcacccaagttaatataaatcaaacattttgcatggatttaaaagtaattttcacagtcctgctaatgtagttttctttgtatttagaaagaaaaattttttgtaatctctgagacttatataacaaatgtttacctaatataatttttactgggaaaagaagcagatacatagtaagttatgaactggcagatgtttctatttagacttagccaaatcttaactttagaaaattgattctgatgtaaagaaaattgtattccaaaattttcacaccattttttttcctttatagagctgaaaaaaacaccaggatgacacagttttttggacacaattttgaggatgagaggtggcgtaaagcagctttaaagaatgctttttctttgctaggcaaacaaagatttgaacattctgcagcattttttcttttagctggttgcctcagagatgcaattgaggtaatgagtgaaatttaaataacaaagtatagcaatgtcatcttttaaagctccttagtgcttaaatttttatttttttaaattcaactttattggaaataacacaaggccaaatatctgaaataactgttaatatttaataaagacatttaaaattttgactgttaacttgaacggtatttatacagaattaagattaaccaaatggtgtttgttagttggtagagataggtaattgatttgactcttgagaatattcaaaaaattaaagggtttgtcctaccagtttaaacatatttgaaccccatatctggctctctattatttgatgaatgttagaaaatccttaactgattatttcttagtaaaccttaaaaaaattatgaatatttaagatacaacatttctgtctcaaattgcccttttgctcagagtttcatacaagtaattcaaaacaaccttttaatatggagactaaagtctccaggggcggatggagaatagtagaggttcaagacagaaataaaataatatagcttaaattgacgtcatttaaattatccattgtttcctcatttagtttaatttttgcacatatatatatatttagtactagaaggtaggtttgcagttattaaatgttgtcaagtagatttgctaaaatctaaaagcaagcagcatatgttttgtttcttatccttctttgctaattttggatatttataagcctttatatttttctagttattagtgagttaacagaatttatcctaaaatgaaacctgctcctgcttatttaaaaacaatatttttttttaaaggtatgtcttgagaaattgaatgacattcagttggctcttgtaatagcaagactctatgagtctgaatttgatacatctgcagcatataaatctattttacgtaaaaaagttttgggaatcgattctcctgtcagtgaactgtgttcattgaacataaatatgcatcatgatccttttcttcggagcatggcatattggattttggaagattatagtggtgctctggaaacattaataaagcaacctatcagagagaatgatggtaagctgcacttctaagatgttaatgattaagaatattattggtaattgctacatgtgcagatcactctattaggtggtaagggtaatacaaacaaattgaattcatggtctttataacagtttttggttggttgtttggtttttttctccagaaagataaatcctttgaaaacaaagaacgttggattttctgtttttacaaaatagatttacataaatattgaacataaatattgtcaacacttgaatataaacattttgaagaaatactgttataaagccagtttttaaatcttaggttgaatttagtgtgtttgtcaatcagttttagaattcttacagtgaaaaatgtgttcagtgtaaaaacaagttgacttaagtgatgtgataagaaaatctttagctagatgaacttttgactgtcttgttatgaactggtagagcttatgtactcttttgagtctgctagtaccttttcttttagaaatcctctttgctaaagctttcttagaggccagtataaaatggaattttttatatagatgcatataaaaatgagatttacttttcagatatgttttcatagattgaattgtgtttggtagctgataaaataggtattatattatttggaatactaattggaaaagggtctagttcatagatttttatgtgctatcatttaatcaggaagtggccttcgccttacttcctaaacctttgagaaagctgtgtgactcatttgtttaagtctcctagccatttaagctaaagattttcaaactagcctctatgtaatgaagggaaaatgtaaatgccttttccagccactttctttttttagtgtttttatttaaaaaaaaaaaaattagacacagtatcttgctttgttgccctggctcatctcaaacacctggcatctagctgtcctcccacctcagcctcccaaagtctggaattacaggcatgagctactgtgcctggccccctttccctttcccttcctctttccttttgtcttgtcttttctcttttctttctttttcttctttcttgaggtggagtctcactctcacccaggctggagtgcagtggggctatctcagctcactgcagcttccacctcccaagctcaagcaatcttcccaccccagcgtcctgagtagcggggaccacaggtgtgtgccaccatgcctagctaatttttttgtatttttgctggagatggggtttcaccatgttgcccagggtggtcttgaactcctgagctcaaagtgctgggattacaggcatgagccaccacacctggccctggcccactttcttatacttaacacatattcatgtaaaaattgtattttgatttgggactagtacatttttacatacttttattatgaattaaacttgtattcttctagaagaaaattgcaaaaaataatagcggcttggaccagaatgattggaatggaggcagagagatgtggttggatttgggatatgattttaagattgattacataggactggatttgataaggagtgtaaaggaattaggagtcaaaggtaactcctggctttttagattgaacaataggtagatgatatggggaagaattgttttagatcatggagctttctctgataaggtgaactttgatcagagaactggttgaaatgagtgagttaatcagtatagatataggtaaagagtggtttgggtcaagggcacactaaataaaaaggccccaaagcaagagtttatacacataagtaaaaatgaaatgtaggcctttggatataggagtttaggttttcagtgtgaagttgggactggagatagagatgatgtccaagttatcagtgtgtagatgttattgaaagtcatggggactatatgaattcaactcagggaatatagatagaaaataagtcagcagttgaaccctaggagactctcagtgttcaaaggtagagaagatgaggaggactagcaaagcagactgaggagaagtgttcagggaagtaggagaaaaagaactaagagtctataactggacgttttaaattatcctagaatattacctgaagagacttgtttcaatgggaaagcatcataatctttgttttcctactttgttagaacatgttcattataaatgtgttgttgtctcttcagtgccatggatcattgtggcctattagtaaaattttgtcaaaagactctttagataaaggtgtcatagtagatagagaaaagacactacaatagaaacacacagttcataacttttcttggctcataaaatgaatttactttcagatcaagttttatcagccagtaatcctacagtttttaatttctacaattatctaagaacacatcctcttttgctgagacgtcattttggatcatctgatacattttccacacatatgagcctaacaggaaaaagtggactggcaggaacaattaatttaagtgaaagacgtttattttttaccactgccagtgctcatttaaaagctggctgcccaatgttggctttggaagtattatcaaagatgcctaaagtcatcaagaaaacaagacctttttatagggcttctagttttctggatactagtaaagactgttctccttcttctccattaaagttggatgcaagggaagataagtcttctgctgttgattggtcacagtcactgataaatggttttggatcttcttcagagggttcctcagagaagcaatcaaactccactctttcttttgactggagccaaccaagtgttgtgtttcaggatgactctttagagttaaaatgggacagtgataatgatgaagaaaatgaggatgtccctatttcaatgaaagaactaaaacctttacagagaaaaacagataaaaagttggatgacataagttctaactacacagaatctttcagcacactagatgaaaatgaccttttaaatccatcagaagatataattgcagttcagttaaaatttagagcatgtttaaagattctcacagtagaacttcgtactttatctactggctatgaaatagatggtggaaaattgcgttaccaactataccactggcttgaaaaagaggtgatagctcttcagaggacttgtgacttttgctcagatgctgaagaactacagtctgcatttggcagaaatgaagatgaatttggattaaatgaggatgctgaagatttgcctcaccaaacaaaagtgaaacaactgagagaaaattttcaggaaaaaagacagtggctcttgaagtatcagtcacttttgagaatgtttcttagttactgcatacttcatggatcccatggtgggggtcttgcatctgtaagaatggaattgattttgcttttgcaagaatctcagcaggtatgtaatttacttgatagtcaaaaatggtacatgtctaaaactgtttttggtgtttcttttttggttttgaatactaagacttgattttctttattacggttgctttagggaaagctcccttttgtgtggtccttcatattatgaattatagagttgtgtatttatagtagttacagacgattcagtatcaggccttatgacctgcttaattcacactccaaagtgttgtctgaatgcctttgtagggtgacagacttcttattgcaagaggatattgtcttattttttttttccctctctgtgcccctaaatgtcttatttttaaatatgattattgaaatgctgacttcttcacatcccttctaactctaagtttctattatgcttttattttttaattgttttgaagtgttttaaagagcccttgatttactgaagtaatggtttgtaactgtaaatagttggttaaccttttatccctctttgtttttaaggaaacatcagaaccactattttctagccctctgtcagagcaaacctcagtgcctctcctctttgcttgtacagccaatgccaaaacagtagttgccaatccattattgcaccttagtaatctgacacatgatattctccatgccataataaactttgattcaccaccccaccctgatatccaaagcaataaagtaagtatgcttggtttcaagcttttacttcatctgtacaatgataaaactacaagataaatattaaggcttttttttaagtaattttaaacatcagactaagcatagcaattgttacattgccaagtttatgttgattcctattaaagaaatcttctggttgtagactggcttatcttactcatgttacttacacccggtagagttcttgaattttttatcacaatgcctagttatttagtctagctgctttaagaaaaataggtacgtatgagtcctttagtagtacatttaaccaaaaagctcattgttttttaaatatagaaacttaatattttaatgtaaaggcactaatatgtaaacgaagttttcccttgttaatactaaagaaatccacattttaaggataatgtgaactatttgcccctgtcatccttctaggataggcagtactttgtgaaccagctacaacagaatcagctgcagtgcttgttaaaagtctggattctcaagttcactccaaacttattcaatcagtttgtgagagtatgtcccaggaatgtatatttttaaagaagttccttgtgtgattctaatgcatgcaactaattatattgttatagttaattgtctaatcaaccaaagcatcctattcatcattactttatctgctgttaatgtcatattttatctttacttttcagacatattgaaatcctttgaagtataactgactttgaccattttcatatatccctagtggtttttgtttttttttaatagtctatcatgtagctctcatccacctcacaggttgtatcacaccaattcgattttctgttttcctgatggtggactgtcctacaattttaccctctttagttaccttaatccttgtaattaaatttcactacttatttttctgtactgctctgtagtataaatgcccatagtgcttattatacagtttggaatttaatttctttcagattgtgctcattttagccaaactatatttcatatttaaaactaattatagcatacctgtggtgtatcagttaccttttgctgcttaagaactgtcctgaggccagtgtggtggttcacgcctctaatcccagcattttgggaggtcgaggcaggcagatcacctgaggccaggaattcaagaccagcctgaccaacatggagaaaccttgtctctactaaaaatacaaaaaattagccaggcgtagtggcacatgcctataatctcaggtgtttgggaggctgaggcaggagaatcacttgaacccaggaggcagaggttgcggtgagccaagatcgcaccattacactccaacctgggcaacaagagcaaaactccgcgcccaccccccgccaaaaaaaaaaaaaaaactgtcctgaaacattagtggcttaaaaagccatcatttattttgcttataattctgtgagttggttcattagttctttggtttgggccagctatactaatgtctggactctctcattcatctttggtcaactggtgggttagtcaggttctagatgatctaagaaggcatcatttacatttctggtggttggcgcatgttgacagcactgacaggagaatctgggtcatatgtatctcatcctccagcaggcaagcctaatatatttgtctggattcaccaaagaaacagaatcagtaggatgtatgtgtgtgtgtgtgtgtgtgtgtgtgtatatatatatgtgtgtgtgtatatatatatatgtgtgtatatatatatgtgtgtgtatatatatatatgtgtgtgtgtatatatatatatatatatataatgagagagagatttattataaggaattgttttatgtggttttggaggctgaaaagtcccaagatctgcagttggcaagttggacacccaggagagctgatggtgtagttccggtccaaatcagaaggcctgagaaccaggagagctataatttaagttcaggtcagaaagtcagcaggctgaagacccaaaaagagctgatgttttagttcaagtctgaagacaggaaaagcaatgacccagctcagtgcagttagatgcgagttactcagcctttttgttctgttcaggtcttgccagttgagtctactcacattacagagcacaatctgctttaatcagtctgattcaaatgtttgtctcatctgaaaacatttcacagacacccagaataatgtttggtcaaatgtctgtgcaccccatggcccagtcacacctagatttttttcaaatggtagtttcaggggttcaagagcagcaagaatagaatttgcaaggctttttgaggtgtagattcggaactcacacttcacttctgttgggtcctcttggtcgaacaagtcaagcccagctcagattcagtgagtggagaagtacgtccaactctctcttgcagaagctgcaaaatactgtgatcatttttgcaagctcccatatatagtttttgtcatcttcaattatataatatcttttaattcatactacgttttattgacatttgaaggaaaaattagcaattagatttgatctgtcattctccatttttatctacaaaatgactggcatacttcacaatcagatgaagaacctggtcttttaatattctagtctggtttgctttcttacctagctgaagtttctccttcatcctcagttctgcctaatgttatggcccttgccatgccatgtttagagtcttctcttccttaaaacaaatgcctgactccactgcctttcagttactgccttttataccttatatcctttctctttctctttcctctagtttcactctcttcaaattgtttttaaggtaactagaatatgtggtagcatattcttcagtgacctgtccgttggtgaactgtcagttatcaggctgtttcttcacattttggttgaggaaaaagcagattgagtgttggagggcttactttaatacatggttcatgctctactggagagctgacatctgttcccctttgctctagaaaaagaaattaggtagcaaatgtgtgttttataatttctgctgaagactttagcgtgttttctttaaattttctgtagtaagactcatgtagataaaaatgagtgttgtagaaaaaaaggaaatagttcatgaaggcaaagaatcaaaaattttttcattcttttaaaaatgctgattatattaggtcttgaaaaaaaatctgcactttaaaaaggttatacttaaagtaattttgtttttgttttccaggtgtatgtaatgcatactttagcagcttcactttctgcttgtatttatcagtgcctttgtggtagtcataactacaggtaactatctttttatgaaatttaagaatgcttacagtaagcaatgaggtttcatattttgtatgttagtggtttagaactatatataacagtcttttaaataatgcaaaaagcatatggttgaggttttgagtactttttgttcatatttgaaatttttatggcagatgaatctcaaacccttattctgtataacttatttagcagcctattactggtcactgccttatgtcagacattgtgattggcactgagaattttaacgcaaataatatgataaagtctatttcttagggccagtctagttagagacaaacatgtgagttgataaatgatatgtatataatatggcatagtactaaaatggtaactataataagacagtagatagtaaaaggctcagggaccacatgggagggagtaacttggaattgagaaaaattttaccaaataattgatgtataggatatttctctgtatttctctttatgttataaagttttactgaaatttatctaggcttcaaaaaaatagtttgttaccctctggggtctttctatatctatctttagttgtttgaagtactctatttcttcaagtattgtctcatctctcttctatctttcctattaaacagatattgcaacttctgggtcatttcttaatgttctttaactttcccctcctatattccatttctttatctctttttgtttcatttcaggagaaattctagcttcattttccaaacacggattcattattcagcaatgtcctgtcttatttagcaagaatttatattttagaaattctgtttttcattttcgggatctcttgttgaatttagtatttgcttctgtttctataacatttcttgattaaaaaaaattattttgagtatggagtactttactgataagttgggtttctcaggtgaagatcttttgttgagtttgttatttcttacatggtgtcagccttccttgttaatttttggttgtctgtccagtttgtgtttttgaattttctgtgggtagccttacttaccactctggttgtatatttcccaaggtaacttcaacttgatttctttaaccctcatccttcaagaattcactttcttattatttaggctttattttcattaacttctttttatctttcctatctatgatttctataggaatgagggagttttttttgttgttactctgccatcttgaaactggaaagtaaagcaagggaaactacaaaggcatcaaaatgttataaccaatgagatttgccaatcataacacatttacaccaataaatgcgctatatttaagtatattcatgtacttaatgtatgatataggaatttctaaaggaaattccttataccattttctgtcagaattatttcatagtttatgtcaagctgcaggtttttttgttcattcatctgttagtcttagctttgcatcttttacttggggaagcttatcctgaattctcaaattgtgtgaaatactcctctgtattgccttgatagcgtcatatgcataggtttcatcttttaagagtagtatgataacattatttgtgttttgttccactattaaattttatggggacagagacattgttattccttatatgcctagtacctgctacagtgcctgatgtagggtaggctagccattatacatgaaagtgagcctaaacggacttcattttcaaccagataactatgtttttaagtcaaatatgtaatcttgctacttgtggtacatagcgatttagttttctcatttgtacttattctgtcccttaaaatgtgttttaatttagaaaatgtgtatatttacacttaaaggatactttgtttttatatagcactagactgtacattatattacttagatgtactagcagtataattaataaacaaaaattgatactcttgaaagtagatctgaaacatgaaaatattatataaaatttatcatagatttaaatattgtttttttctcttagttcatttcagacgaatcagtttactggaatggtatatcagacagtactgcttcctcatcgaccttctttgaaaacaggaagcttagatgaagcattaactcccaatacgtcaccagctcaatggccaggtataatttttatgtatagatcagttttttcttagtcttatttataatcttagataagtagaaagacttttagttttgccacatgataatcattgttaaatactgttagaattgataccagttaagtattcaccactcattctgaattacagttacttaacattagtattcccttgatcattatactaatataactcaaatgttttgtaataccgttttttaaatcattttgcttttgacatactagaaaaacccgtctatgaaaatttatctatgacatcttagtcatgaaagattttaatgtttaatattaaagatttttaatgtttctctcaagtaactcatttgtgcttaactataataaccgctactagtctgtgaatctagggaagaaaatacagtattaactcctgatgcaatacattttttcctgaaattagaaaaatatagttaatttttaaaattttaaaaatttatagtcagtgacagctatgtttgtttgtcgttctaggaataacttgtctaattcgacttttgaattcttctggcgaggaagcccagtcagggcttacagtcttgctctgtgagattctcacagcagtgtatcttagtctcttcatccatggcctggccacacattcaagtaatgagctatttcggattgtggcccatcctctaaatgagaaaatgtggtctgctgtgtttggtggaggtgcacatgttcctagcaaagaacagacacattcaaaaactttacctggtgagtttaaaaaatttttttaggactgaagctttatttatctgagtgatatcattctcaaacgtaattacattttaatttagttatagaaagttctggttagagaccatttgcgaaaagcataaacaaatagtcatacagtgaaaatgcagtattaaagtttctggtgcagtttttaatctttaagatattcctgtaccaataattagaacgatcttatgtaaatttattaaatattttactactgaaactttcatttgttttgaaacacactgtaatattggtttttgttctatcccaaatacggattctttcttctttctttggcaggaaggcactttgctatgcctagcccccaccaggtagtggtattctccatggaatgtgtgggcttttccaaagctctttcagccatcagttctcatagccctcccagtcttgcaggcaagatatgagctttagaaataggcttttatcattcagcttgctttgtgttgttttgaggggttggggtacagtgggacagttttattttgtttggcatttatagaaaattgagaagtttcctttgatcaagccatatttttgatttaaaacaatgattagcagtttagaaaactatctctgctattttattctgcttttaaattctttgttttttatatttctgtcccttagactttaacattttaaagtgtgtaaaaataaaacactgtcagtgctaatcatagaaaatcagactatggcttgaaatgactagaaaaacatttcaaattaggctgctttatgatttgcatattatgattccggccattggagtttttggatttctaagtgttcataataccatgaaaagtaaatattttaaacaattgtatccccgtttaaaaactttctaatgttaaaactgtatttttttcatgtattagcccatgtgtgataatcttagttttccaattatggagggcatgaggagtagctttatttttaatacatagtacttgaaaacttatttcattctatattggtgttgaataaattgaaaatgttaaatgtttttccaaaaaaaaaaaaaaaagccctatgcatacatttgagagaagctcagcaaggttatttatctctttatgagctttcattcacttcttccctgacgtttacactgaacatatgcttgtacatataggtgtatgtgggcttggatatatatgttttgggaggtcaagcagttggtgagggacatgagagaataagaaaagcttgaatttggcttcattatttgggaaaaaaattattgccaaaatctttaccatgattgatgaatattctttgaatgaagctatattaaaaagaatttagaaaagttattaccttgttaaaatatttaaaagttattagtagcaatgttggcatatattatacttttcaaaagcagtttccactaacctgtggccctgcatgactatatagcaaaaaatcatgatggcctagcttctacttcctctccttaattgaaattgtttcttcagttacctagctaggactctcatactttctagtctgggtcctgcctctttcttccatcaagaaaaaacaggcaggaatttctttatgtataatacttaccatgaggcaaattcagtttataactttcagcagagttcaactagctttttctgtaaaaagccaaatatatattttaggttttggagtccatttggtatctcacaactatttagttctgcccttgtagcacaaaggcagccatagaccatttgtaaacagatgagtacagctgtgttctaagaaaacattatttatttgttggattgcaatttgccaacccctgctttacaagtagaagcattttattattggtctatttggaatagaatatttgccttccctgttaaaggaatttcaggttttaagaacaactgaagttaatattttgggagatagagttcactgtgggtctcttaacgtatttgacctaaccacaaattgtacttatggaatagtataagtggcatcagagggataatttgtaatcttccctgccatggcccttagcttcctttagccaatctaggggctaattcagtttttgctgttgtaaaatactgaaaatgtagaatcctaacatgacttctccagaaacctgataccatcctgcctattactcatccacctaccacactttgcttactactttgatggctgttttatctctgtggtccctcccatttgccttaaattaaactcatttacttctcctttttcttcttatgcacatcagatttcatatgcaaatttaccttatttgccaagtttacctttgcttattaaaatattaagtattttgtttttgtaacattccttttctgttttttaaaaagttgtttattgtgctttttgtatagatttttttaaaagactaatttcacatgaaatttgccttggactatatttatacttgagatatctgaattcaattaaggaaaaactttcaaagtctaagggaagtaggatccatagctctgttgagtttaattttaaattaaaaattggcaaattaattttgaccatatttttaatatgttctgagaaaaattcatttgttaagactttgatcttgttgatgtaaaatgttaaaaagggataaattattgctaaggaatgtgcagatatccataaaaaagaaaatgaaaaatacattcttactagccatcaggtctcaatttcatccatttttcctgagcacagatatgtgtaaggaaccatattgaaagtccaggttgatctttgtataaggttggtgcaaaagcaatggcaaaactgcagttacttttgcaccaatcttattaaccactctagttgttggttgtaggcaaaaataccattacataaattattttgggggggccattataagtccgtcataagctgtatcctaccacttatttaaccccaagtaaaaaataaagtgacctaaaattatctgcatctatatgtttaacctcagccaataataaggaatacttaaaacgtattgttcacttagtggtagggctggatatagtcatatccaggttatatggtgctcatctgtccttgagtacccagaaagtattctaaatacaatcatggaagtaactgaaggagtacttaaagaaaacatgaatggtacgatttgtccatttgctaaccagaaaaaaaggaatatattcactgaatgatgaaaactaaaggcctgctggtttcaaagccaagctaatttgaaaaggagcaggagggctggatgtggtggctcacacctgtaatcccagcattttgggaggcctaggtgggcagatcacctgaggtcaggagtttgagaccagcctggccaacaagtgaaacactgtctctacaaaaattagccgggtgtggtggcatgtgcctgtagacccagctactcaggaggctgaggcaggagaatcgcttgaacctgggaggtggaggttgcagtgagctgagattgcgccactgcactccagcctgggcgacagagcgagactccatctcaaaaaagaaaagaaaaggagcaggcagaaagaggaaaggaaagaagcgaagagaaagggaaagaagcgaaggtcctgtggagtacggatccactgaaaactagagagagaaaaatctcagaacagaaaatcaaccaagacaaggaactactagcagcattggctttcaatataaagtaacgttcagaaatctcagtttttttaaggcattattatgttgccctgaaaacttaccgaggcaggacagcaacctgataaattttaggttgtaggtaagcagtcctgtgtgtttggattactgctaatcataatcattgatgtgccaagagtctaattgcattaagtaatgttcaatatacattgttgaccaagggaataaaacagtgtattttagaaaagttgacttgaatccagttaaaattaatgtgtatttaaaattttttatcttttaaatttggccagtgaaagctgacaaatctagaatatttcattttcctgactactcaaacgtgtcaaagcattgtatattgaagatgaaatacgtgcatattgaaatacattgtatattgaagatgaaatacattgtatattgaagatgaaatacccttaaacatgttttctaaaagtgttccataagtttaggtactgtattatgagaggaatttgaaagccatcatttgttttccttgttctgttataaatttggatttaaattttctttgcaatgatggcctcatgaactagattatatttctttctatatatctattatatacttaatgtattcttgtagtaacataatatttaaagataagcttcataactgaaggaaattatagatttttattagactctagtctggcaggtcaaaattcttaacaaaaatgttaatgtacataaattaacttaatcaaattttttttggtgaattccacattatatattaatgaagagtttgatttttctaattaactaaaactgcagtgcaggtatatgttcatggaactctgaattgttttgttatggtcaattttaaagaagagaaccagctaagcaatagcaattttcaaaaaattactttttctgctaacagttagaaatccatacttttgctttttattctgtattataaataaagcagtgtttttaagaattgttattgtgttttgtgatacttgcatttataagaactgtgaattacctctttatcttaataaattcatagtaatgacttttttatgtctccaagttgaggaatggaaatataaaatgaacattttatttgtggtaagcatgtcatatattttttactatgagattgctaatgatattctagacataaagtttatttctgacttattacgctaaaacagatcagaaaatccactttttgctttttcttataaaacttgtgtaaaaacaaaagttctgtattcagtagtcagtgattatcacatgtcattgctaacattcctttagcaaagtaagcaaaacagcaaaatatcttgaccagaaaagacttgagcatattaaaatataaaacaaaataggtgatttaaaatataattgaatatgccaaacatttaactggtggtttattataaggaacttttaaaagactgctgaacttcaaagtaactaattctgtggaagggaatactttccttttcttttctttgtgaggcagagactcgtaccgtcgcccaggctggagtgcagtggcgtgatctcggctcactgcagcctccgcctcccaggttcaagtgattctcccacctcagcctcccaagtagctgggattacaggcgtgcaccaccacacctggctaatttttgtgttttttggtagagacgggctaggctggtctcaatctcctgaccttcagtgatccgcctgccctggcctcctaaagtgcttggattacaagtgtgagccaccacgcctggccaggagtacatttttgttagacttttcattgaagaccatataatataaattttaatttaaagtttaaaaagtgttctattcattcattttacaaatgagtcaggaaggcaaatttttatacaagagtagagaaagcgtagaagataaaagaaactccaagaaatgtgcatgtatagatttttacatgtaattattcttttatttcactgctaaagcctgatgacagtagaagaaactaaccctataagaaatgcaacattcatttatctgacctagactccctcattcaatgttttcttctcttttttttttttgagacagggtcttgctctgtcgcccaggctggaatgcagtggtgtgatcacagctcattttacagccttggcctcttgggctcaagtgatccttccacctcagtgccccaagtagctgggactataggtgcaggccatcattgattagcctagttaattttttaagttttatttttatagagacaaggtctcactatacccaggctggtcttggactcctggactcaagtgatcttcccacctcagcctcccaaattgctgggattacaggtgtgagccaccatgtcctgcttaattcagtatttctgtgtaccttactgagaccaatcatgtgatctctctcttcaacccagttttctaatatttctaagtcctaagtcctgcagcaaaatggcttgaatatattttttccattatagtttttttattatgactaaaaacacatgatataaaatttagcaagtgaaccatttttaagtatatagtttagtagtaagtctatcatgtggtgaaacaaatctctgtaactttttcatcttgcaaatctgaaactatacccattaaacaattcccccacttcatacaatccctggtaatcactattctactctgtttccagggatttgattactttatatacctcatataagtggaattatatagtgttttgtctttttgtgactggcttatttcacctagtgtaatgttcttccatgttgtagcttgcgacagaatttccttcctttttaatgctgaatgttccgttgtgtgtgtatactccattcacattttcaataagtttgttgagtttgggttgaaatcttatatacagaaccgtgttgtggcattcagggtgattgaaaagtaagtactactctagggcagtgacttcaggcttttgaagacattaccttatccataaaacatgcttgaccaaattctcaatatatgtatattgatgtctactactatcgatccagatgttaaacattgacaaaatttagtttcttctccttactttccttcttccccttctttcctctgctttcacctccacctgcccccatctctcctttcttcttgtcccttctcctttccctctacttcttcccctgtcactttctgctcctctacctccttcccttctccttctgccctttccccctatttatcaaaaaataaatctaagtagaagttgtagtattttccttccatattctggtgaatcattttgtacaactaccgtggagactcccttgctctgtggtttggagacaaatcaccactttctattaagatatttattatttcatttttatagatatttatggagccatgttcaagatacggtgtatggtaatgatcctaggaagactttgagggtcagtctttctaaaagctggatagtatcatcttccagactttttttgtttgtttgtttgtttttttgagacagagtctcactttgtcacccaggctggagtgcactggcatgatcctggctcactgcaacctctgcctcccaggttcaggtgattcttgtacctcagcttcccaagcagctgggactacaggtgcacaccacgacacttggctaatttttgtatttttagtagagatgaggttttgccattttggcctggctggtctcaaactcctggtctcacgtggtctgcctgtctcagcctcccaaagtgctgggattacaggcatgatccactgtgcctggccagactttttttttttaatcactaatcttattctttgatgattaagaagtaccttcaattaattgcttctttaatccttttatttttggaatatttgaagtttacttggaaaatcatgttttacatttaattttgaggatttgttttatacttagtgttcacgtacatttgtagttctcaaactttttacctgaagataaaggttaacatatacctcttaggagactgaggacttagactgaattggcttgctgaaagcaagaaataaatttgaaatctgtttgtcttaaacttgcatgacttttatcttttccatatttggggggctcagttagaaggtccagactaatgtgcctcctgaagcttcgtgtatactctggcacactcatgaatagctctgtggatatgggtgccttagattgagaaatagagagtgagacctgctggttactttaagttcagttattttgttgtttgttttgttgttgagacaggttcttgttctgttgcccaggctggagtgcaatggtgtgatctcagctcactgcaacctccacctcctgggctcaagtgatcctcccaagtggctgggactacaggcatgtgccaccatgcccagctaatttttctatttttttgtagagactgggtttcaccatgttgcccaggctggtcttgaactctaagttcagtttttaaagaaatgacatttaaatctacattcagaatattaatttcattgtgctgattttaaatgataaactgaaaagtaaatattaacttaataaccttccccttatattttagttttaatcacagcaatatatgtgtgtggtaacaagtctagcagtacagaagaatttataggaaggaatgttgtcttattcctctgctcctccccttccctatgtgtagcctgttagccatttctccatttctgttttgggttctttggggagttacttttataattcttagaaaaccacagtgcagatattctgagggtgaggaaaggattgttaagggaaggaaggtgtatttgtctgtacagtctactatcttgacatggaagctttgttttaaaaagtacgggaaggggaacatcacacactggggcctgtcgtggggtggggggatgggggagggatagcattaggagatatatctaatgtaaatgacgagttaatgggtgcagcacaccaacatggcacatgtatacttatgtaacaaacctgcacgttgtgcacatgtacgatagaacttaaagtataatttaaaaaaaaaaaagtgcttcctgggaaagcaactgaaacttatttttaaaatttatgtcaggacattattctgtttttcctgtgaatgccttagtttttcttcagccactttgtagcctccctatacctcttaaaattcataaattctatattcaagttgctcttaatttctccctaatactattttctttcttctgttactaataaagtagcggttttcccataatagtagaaccatagggttagtttgcacccaaggaatggcaaacgttcttgatatttgattattagcattttcaaaaacaaccagttgaacacccagcagctatagtttttatcggtgcccctaagcttcacgaccaatctgacccagcaggattcaagcataaaattgccttaagtcttcctacaattggaggacaaagaagagggagtaactaccctattgacaagtcacaggtcatttcttgtttactgggtggcatcgctaaggtctttttagttaaagcatctaaagtaatacacattcattactgtgaaactgccgattttttttcctttggtcctgcttcattaaaagtgttgtttttgttgttgttgtttttgagatgaagtcttgctctgttgcccaggctggagtgcagtggtgcgatcttggctcactgcaacctccccctcccaggttcaagcaattctcctgtctcagcctcccgagtagctgggattacaggcacgtgccaccatgcctggctaatttttgtatttttagtaaaggcagggtttcaccatgttggccaggctggatcctgacctcaggtgatctgcccacctctgcctcccaaagtgctgggattataggcgtaagccaccgcacccagccaaaaagtgttttaataagtggttttatacttcctggtgttgagtctgtaaattttaaacatttcctcccagtgtggttaatattttcatgtcacgtgactggattcacagcttgtagtttcaaatgtttctgtctttaaaaactctcttatattttacttttaaaactatttttatctaccagtgggtcagtaaaagaaaaaaagaaaactatttttatgacatactaatcttggcaaaaatctattaatttaacattgtacgtgtttttttttcagagattgtctatacttcttggttcacatgctttttaataacataaaaacaaaaacagccaggtgcagtggcacaagcctgtagtcccagctactcaggcgtctgaggtgtggatatcccttgagtcaagggattaaatccagcctaggcaacataaggagacctccatctcttaaaaaagacaaaacagtaatgttaaagccaaatgataaattgatatatttatcttaaaacttagcattaagtttttgaaaggtaaaaaaatatctctatagttctcacttttcacttgatgagaagttggtaaactaccgtttaagttttagaatgtgtgttaatgtatgcagcagtaatactggaaacttgattgttggttatcaaatgttagtaagaacaaagaaaaaaatttgcacatttaatctcacagttccttttaaaatcatttgaaagattaagtaataatcatgccactttttagtaatctcttagaatactaatattttattcatctttccctttttctgaaataaccaaattactttgttaaactcagcttgactatagcttgttataatgcatgtgcatgatgtgtctgcaagctgagacgcttcaaacaataaaaccaaattgtattacagcacaagtatttgcattcctttggaaggtgagtaaaatctcatcggagccattaaaggagaatattggtgtgccttaatgtggaattctttgcctgtgtattagatcatgcctttgtctgcaaaatccttgattgtctactgatgatttgcattttgtaactcaaggttgattaaagatttgtataatttttttaatgctaatctctttagtattctgaggtaatatactaaaaaaatactatctaattatagagtgttcacaaaataaaacaacaaaattgcattattttcttctttgtaattccattgactggaaaattctgtctctgagccgtttccgaaagtttgaatcagtttaagtagttatggtgcctgaattttgtttatattttctaatgaaaaatatagttttagatataaggccacatcattaccgaagaatctcagaagggagttgttgcttttaattaacactgacatcccatgataatctttaaaaaaaagcaaagtagaaggatgttggaaatttcctatcgtgttcctagttaaattgtggactgatttatgggcggatattacatccttctatttttcacatacaataggtaagtcagcatttagagagtgagggacaaattgaggaaaaagcagaggttgctagacagaaatgatttttgtcttcctctacttattttcttacctgctgtgtactttcataatctcaatcttatttttttgtgtgtgcttatttgtagttaaccttagctcttatgtaaacacaggtgaaataaatgcaatgaaaatagtacttcagtaacattttattttctttttgttagtttcttcactagttgaagaaggagaaaaacagaacaaacgttttaggccgtcaaaaatgtcttgcagagaatctgccccactgaccccttcctcggcaccagtaagccaggagtcactggcggttaaagaaaagttcatcccacctgagctcagtatctgggactatttcatagctaaggtaattaaaatgctatctagatcaatattttcatagtcaaatagaaatgagaatatcagaaataagtgtcatttttggtgcttccaaatgttttcccactttggtttagaaaattttcattagtatcaggctacattccaaaaatatataccctagaatattttgaccatatttcatatagtttttaaggcagttttttggtaaattatgacatttgcattttaaacaatagcttttgcattttattatatttcttataagataaaagagaatttgcgtaacatcttcatgttaatgtacttgatggtgattaaggaatcaaagtgctctggtcatctattatccatatactcttttttatactacagcagtctctcattattctgaaatccataaatttcaattaccagtgttaagtaacattattccctcaacaacatggttcacatttgttaccacagtgtattaaatatgagtaaacttccctgctagcgcttcattctagaaatcacttcgtaaatgtgcactttttgatcagtgaccaatcatgtcagttcttttaaagtctttcagtgattgattatgtagcacctgttactcagttcatacacagcaaagcatgcagttgttttgcttcatctcctgtgataaatccatatgatagtgtacaaaattggatttgatcaaaagagggaaatggccaactaagatgaaagtgcatccataaaaaaagtgatagtactgagagtgaaattcaagttgaacataaatgaagttagagagaaaatagccaactgtgggtatgttgacagtgctgccatttgaaagactctagatgaacagccagaggaatttagtgaaagtgaacttataaatgtagaaagtagttgtgataaaatgatgaagatgttcagagatagtgactttgccaaaaaactttacgttaaagggattcacaacattgaaaatgcaaagaacagtatgttggaagctgataaaatcttagaaatgtgacagtttgtttaaggcacagaagaaatgcttgcttcatatcctgagttacagagatagaaggcaattgctattcaaactactcttgataaaatgttttatttctttgtattcctaatgttttaattacagtatgttaaaattagtttatttaaaaaaactttttctatacatttatagctaatggtaagagtttttagggttttgacaaatatctttaaaggtcacaaaacatttgtaacttttcccattgattattattgctctgtatagtttatgcgtgcgtggtcatttttgtaggcatgcaatactgtgcaaaacaaggactgcctatataagtatctttcactttttgtgtcatcagccacatccctcacattctcaatttccagacgttctcctgcacaaattgacatctaactgtaactgttctctggtgacacaagtctcccaggcctgctgagctatggcttttatttttctcatatcctaaatgtttaagggtagtgaagggagtttgggtctccttgttcctcactgcccttttttgagtcatttattcattcatatattcaacaaatgtttattaagcacttcatttatctaggaatatctttatttcacctccatattttgaaggagagttttgctggatataggattgttggttagcaaggccttctttagctatcttgtttctgaatctttttgttaaatatttagtgtctgcccttccacccaatcaatatcacaacctcaaagtagttgagatgttaccttccctaattgtttgttactgagatctctgttgcttttgataatgcctgtgggcctagaattttaaagacaatcctgtctggcagggcatcagaactcagtcttcacagccttccctgctgaccctggtggaacacctacaccacagagattggggtgggatgggaacagctcctgaccaagttcttactgttttacccagatcagatcccatagatttttaaaaataaatacttctctatgtgttatatgcatgggtcaaccattgtttgttttctacaattttgttcaattttattgttgctttttggagaaaggacttaccaagctctttactcagctgttccagaagttccactctccctgctgtgtttctttgttggtcttccaaggttttccaacctttttttcaaacttcctgcatctccccttccatcctatcctcactcttaattgatgacctcaccttgtaagtcactgagaaaaataaaatcagacaaaactttttcatcatcccaatttaaagttacagatcaattacatttgctcctgtcttatttcctcctgttataatggagaaagtccttctatcagacaccttttctcgagttttactctgaattgcattctttcttttcttctctactctcccctgtgttttcagttctcttcctctctgttgaatccttcacatcaggacagaaatgtgctttagtatctcccattccaaacccctgctttgaccctgaaactttttccagctgctatcccatttctctgttcccactcacattcagcttttcaaaactagacacatttgctttctactgcctttttcccctttcatacttacttatataactttctgacccagttacacccgttaaaactgatcttgttgagattcacgtgatatccatgtcaaatgtagtggaaacttttaaattattttcttatctgtcttcttagcatcattcaacattcttcactactcccatattgaaatgcttttctctccttttctcttgatgacaatctcttgtagctttttttcttaaacttactatttattccttcataatcttctttcttcatccttcctcttctgtttgacacataaatcttggtcttcatgatttgggcattttatatcgatttttcccaaaaccttccctctcatacccagtctttccattttatgaaattgtatattcacccttatagttgctcaggccaaaaacctaagagtcattcatttttcctcaacttctcttgttctccaaatctatcagcagacctgttggttctttctccaaaatatatcttaaatctactacttgtctctagcttcattactaaccacctatgtccaacctgccaactcctgttttagttactgatgtctccatttctacccttgccgtttagcttttctctcataagagagtgatcgtagtgatatacttagcatataaacctcagtacctgtcttctacgtacaacttattggtggcattcccttacattcctttaccatggcctacaagaccctgtctgagccgtcatttgctattctctccaacctttctcccagcatttttttgcttagcagacttgatcaaactactattttcaaaccaaactctttcccaaactctttctgcattatttttcccctgtctaaaatgcttttcttccctcttattatatggcttgttccttcttgtcatttagttctcgtacttttcaaagaggccttccatggtcagcttatctcaattctccttattctccatttcttttctttgtagcacataatacagtttgtatttagttttctgttatttgcctatttttttccagtaacatgtaaaaagtaaatgagggtggtgattgtatctgtcttaaaaattcttaaatccggtagaattcttgccgcacagtggatacttaataaatttttgctgaatggatgaataaataatggaatagtatcaattgatgtcaaaggcataggatggtaagataatagttacttaactctcttataatgaagtatctgcaaatgagatgaattattactattagactgtatgtttgaatgtattaaattagatatgtggctgctaaatttcatgatttctttattttagccttttctaccctcttctcaaagtagagccgaatatgattcagaggagagtctgggaagtgatgatgatgacaatgatgatgatgatgatgttttagcatcagatttccatctccaggaacattctaattcaaattcatataggtatggtatattttattttaaatttctttttaaaaataatggtgtatataaataatatttttgaaaaaattacatgtgaaattaatagcttgttgactttataacacattataacccagatttctttagttgaaattgttaaattcctttccttaacaataatttctctgttgactttataacacattgtaactcagatttctttagttgaaattgttaaattcctttccttaacaataatttatcacatacctttggttgtccattaatggaccatccgtaatttgcatcattcctcacagatcttgctccaagattataccttgcattttgggctctaacataaacaagttctactgtttttgtctggaaaatatattttcagtagaacactagtactataagatgtcaataggtactatcttcaaaaagtactctgtatgtcatacacatgttctaaatgctcacctctagctccaatactgcgttattcttacattcatgaatgatggaatattatctagtctctattgatatgtttacatctaaaacgtgtatgttttactaaaacatggtatgttaatggtgtgataaaaaatgtgaattttccaaaagaagtaaatatatgagggacattgaagtcattctttatttgaaagttaccatgagatttttacttcctggtttattgaggtttttccccctgctgaatgaattttactttttgaatatataaatcatttaaaagtcaaactgcacaactcaacaacaaaaaggtaaataattaaaaaaatgaacaaagggctgggcatggtggcctatgcctgtaatcccagaacattgggaggccgaggtggtcagatcacttgagcgcaggagttcaagaccagcccaggcaacatggcaaaacccgatctatatttctaaaaaaaaaaattttaatgaacaaaaaacttgaatagacatttctccaaagacgatatgaaaatagccaataagcatatgaaaagatgctcaatatcattaatcattagagaaatgcagatcagtttcccaatgagacaacatctcatatgcattaggatggctaccaaaaaaaaaacaaaaacaaaaacaaaaaaaataacagtgctggcaaggatgaggagaaattggaatctttgtgcacttttggtgggaacgtaaaatcgtgcagcaactgtggaaaacggtatactggttccttaaaaagttaaaaatagaattaccatatgatccagcatttccactatggatatatacctgaaaatattgaaaacagggactgaaacaggtatttgtacttcccatgttcttagcagcattatttacagtaactgaggggaagaaacaatcaagtgtgttttaacagatgaattactaaacaaaatgtgctatgtacgttcaacggagtattattcagccttaggaaggaaattctgacacatgctgcaacatggatataatgctaagtgaaataaatcagtcacagaaagggttatagtatgtgatttcacttacatgaggtacctagaatagtgaaatacataaagaataaaaataaaatagtggttttcaagggctggtggtggggggagaatggggaatgaatttagagtttcagctttgcaagatgaaaggaattctggagttggatggtggtggtggttgcacagcaatgtgaatgtacttaatgcccctgaactataaacttaaaaatggccaaaatggtaaattttatgtttttgtattttaccattaaaaaattactaaaaattcaatcctttaagaaataaatatgttccacttgaaataaaagagaacctgacttttttaaaaatcaaactatataaaaatgtgaaatcacaagttttacttaaacttctctttactctatccaatttcttctgcacatcctctacagctaaccacttttattagcttctggtttatccttctgtttgcaaaaataagcaaaagcatctatctaaatttattccccctgctttcttgcagagagggtggcatactacatacagtgttctgctacctgctttttatttattactacataccgaaactgactccatattaacacttagagatccttcttcattcttccttatggttaccctaatattccataggtcaaaaatagttattcaacaagtactctcctcatggacaattttggttatttctacacttctgctattgtagataaagctgacatgactacctctatgcatatattattttgttttcatagaggggtatgttcaggttgattcctgatagtggaatttgttgagtcaaagggtagtatactcttctaaatccctatagaaatagttaacagatccatcgttgctttatttttagttggtccttgatgcggttggcgatggtgcaattggtgctcaacaatttgaagactttttatcccttcgcaggtcatgatcttgcaggtaataaatagctcaacatgagctaatggtgccattgcttttgacttactactctgttgtttttttttttttttttttggtctggactggggggaaaatttagtgatttcctgttacagaagttagatttcttttaactaaaccaaccatctgtaaatgtatccgtcatactgttaggtgcttgaggatggcaacatccaagaaatcaagggcactgaatgtgatgtgattgactgtcttgagactctatttatactctagccaagtgttgagggattttacaatggagagaaaactaagcaaatgcaaaagctagcaattattaacttcaaaggaggaaaagattgtacaggaaagaaaggggcatgataacatactaagtgattctgctatgaactatagttccctatatatgataaggtaaacacaaaaataccaatttaaccaaagatttttataagacactatcataatgatggacagaggagtttattctcattatgccgtagtagtaaatcagtaggtcatttctaaaattgaaaaattaagtattaagcatgttatttagatatagggaggtaagtagtaggaataactaaaagttgaaactgagatcagtactcaagagtatggatgggcagaactgctaagtgctgagttccatggcaagtattatttaattttaactttatgtattgttttcattttctacagatcttaaagagttatatgccatacagaaattagtctgatacaaattaaagcaggggtgtccaatcttttggcttccctgggccacacaggaagaagaataattgccttgggccacacataaaatacattgatactaacaatagatgatgagctaaaaagaaaaatcacaaaaaatttcataatgttttaagaaagtttatgaatttgtgttgggctttattcaaagctgtctgggccgcatgcagcctgtgggccatgggttggacaagtttgatttaaagcgattaattttccccacatacatattttcataatcttcagatacatttttctggtaatattaaggtcaaaagcagtaatgttgaaatacttacacagatttatggcataccttttgtaatccactgggtttctttgcccacctcaccttgcacatcttccctgccaaagtgtatgttaatatttcatctcagtctttttttttttcctgcatctgctctcccctctctcatttcagtctttcttaaaattgaatatggcattttactgcataagattaatatgagtcaatgttcccattttagagcttccagttagttcacctctttgtcatgcggttctaaaaactcttcaatgttgggaacaagttcttctccgacgacttgaaatccatggtgggccacctcaaaattatatcgcaagtcataccgccgaagagagtttgtctgcaggtcctgcaattcttcgccacaaagctttactggaacctacaaacactcctttcaagtaggttttcttatgaatgctatttgggtttttttgtttgtttgttttttgagatggtgtctcgctctgtcatccgggctggagtgcagtggcacaatctcagctcactgcagcctctgcctcctgggttcaagtgattctcctgcctcagtctcctgagtagctgggattacaggcgcctgccaccacgcctggttaatttttgtatttttagtagagatggggtttcaccatgttggccaggctggtctcaaactcctgacctcaggtgatccacctgcctcggcctcccaaagtgctgggattacaggcgtgagccaccgcacctgccctgaatactgtttttaagataggagttttactttttgtgctgtacattcttgtcataactactcaaccctgccattgtagaataaaagcaaccatagacaacatgtacacaaatatattcagtttttgtccaataaactttatttcttaaaatggtaggtaggctagatttggactgtgagctatagtttattgatgcctgctctagaacgatgcttttcaaaatagctggtcacaaaagtgttaagaggaaagtttatagcactaaacaacaagcagtcaacagattcagcacaattcctgtcaaattaccaacatcattcttaacagaattagaaaaaaattattctaaaatcagatggaaccagtagagagctggaatagccaaagcaatcctcagcaaaaagaacaaggcatcacattacctgacttcaaactgtactacaaagcaacagtaaccaaaacagcatggtactggtacaaaaatagacaaatagaccagtggaacaaaatagagatcccagaaataaactcacatcgtgaggatttgttctacaaattatttcatcactcaggtagtactaagcctggtacccagtagttatttttccttttttggagacaaagtcttgctctattaatcaggctggagtagagtggcacaatcacagctcactgcagcctccacctcctaggcacaaacagtcctcctgtctcaccctcctgaatagctgggatcacaggcacacaccaccatgcccagctaattttttgtattttttgtagagacagggtttcaccttgttactcaggctggtctcaaactcctgtgctcaagcagtccgcctgtcacagccccccaaagtgctgggattttagctgtgagccaccatgcctggcccccagtagttatttttgtgatcctctttctcctccccacttccccctcaagtagaccccactgtctgttgttcccttctttgtgttcatgagttctcaacatttagttcccacttataagtgagaacatacagtgtttggttttctgttcttgtgctagtttgctaaggatagtaacctccagctccatccatgttcccacaaaagatgtgatctcattcttttttatggctacatagtatttcttgtatctgtaccagattttctttatccagtctgtcactgatgagcgtttaggttccatttctttgctattgtgaataatgctgcagcgaacacttgtgtgcatgtgttttttatggtagaatgatttatattaccctaggtatatacccagtaatgggtttgctaggtcaaatgatagttctgtttttagctctttgaggaatcgccatactgctttccacaatgattgaagtaatttacactcccactgacagtgcgtaagtgttcccttttctctgcaaccttcccagcatctgttattttttataaataatctgttatttttaaatgataaccattctgactggtgtgagatggtatctcattgtgcttttgatttgcttttctcaaatgatcagttatattaagcttttttcttaggcttattggcacgtacgtcttcttgtgcaaagtgtctgttcatgtcctttgcccactttttaatggtggtgtttgtttttcttttttaaattggttgaagttcgttatagatgctggatattagacctttatcaggtacatagaaagtattttctcccatttctgtaggttgtctgtttactctgttgatagtttcttttgttttgcagaagctcttaagtttaattagatcctatttgtcaatttttgcttttgttgaaattccttttggggtccttgtcataaaatctttgcctgttcctgtgtccggggtggtattgcctaggttgtttgctaaaatttttgtagcttttggttttacatgtaagtctttaatccatcttgagttgatttttgtgtatgttgcaaggaaggcattcagtttcaatcttctgcatttggctagccggttatcccagcaccatttatagaatagggagtcttttcttgattgcttgtttttgtcagctttgtcaaagatcagatggccagaggcgtgtcaccttacttcccagttctctattctgttccagtggtcaatgtgcctgtttttgtaccaatactgttctgttttggttactgtgtttttgtagcatacatcgaaatcaggtaatgtgattccagttttgttctttttgcttaggatcgccttgctattcaggctctttttacgttccatattaattttaaaataggtttctctagttctgtgaagaatgttggtggtggtttgttaggaatagcattgaatctgtaaattgctttgggcaatatggccagtttaatgatattgattcttcttctccatgaacatgggatgttttttccatttgtttgtgtcttatctgatttctttgcacagtgttttgtaattattgtagagatctttcacctcctggttagctgtattcctaggtattttattctttttgtggcagttgtgaatggggctgccttcctgatttggctctcagcttagctgttgttggtgtataggaatgctagtgatttcttgtacactgatttttgtatcctgaaactttgctaagttgtttatcagatctaggagcttttgggctgagacatggggttttctagatatagaatcatgttatctacaaacaggcatagttttacttcctctcttcctatgtggatgccttttatttcttcctctttcctgcttgctctggccaggactttcaatactaggttgaataggagtggtgagacaaagcatccttgtcttgtgttggttttcaaggagaaagcttcctgcttttgcccattcagtatgatgttggctgtgggtttgtcatagatggctcttactattttgaagtatgttctttcaatacctagcttattgagagtttttacatggattgatgttgaattttatcaaaagccttttcttcatctattgatataattatgtggtttttgtctttagttctgtttatgtgattcatcacatttgttgatttgcatatgttgaaccaaacttgcatcctgggaatgaagcctacttgatcatggtgaattagctttttgatgtgctgctgggtttggtttgcaagtattttgttgaggatttttgtgttgacattcatcaaggatattggcttgaagttttgttttttttgttgttacttctgccaggttttggtatcaggataatgttgacttcatagaattaggtgtgaaggagttccacctcctcagttttttggtatagttttagtatgaatggtaccagcttttctttgtacatttcgtagaatttggctgcgaatccatctggttctatgccttttttggttggtatgctattcattactgattgaatttcagagctcattattagtttggtcagggaatcatttcttccaggttcagtcttgggagggtgtatgtgtccaggaatttatccatctcttgtaggttttgtagtctgtgtgcatagaggtgtccatagtagtttctgatggttatttttatttctgtggggtcagtggtaacatctccttggtcatttctaattgtgtttatttgtatcttctctcttttcttttttattagtctagctggcagtctgtctgtcttactaattttttcaaaagaccaactcctggattcgttgatcttttgaatggttttgtgtgtctcaatttctttcatttcagctttgatatttgttattttttatcttctgctagctttggggtttatttgttcttgcttctctgatattttccattatgatgttaggttgttaatttgagatctttctaacttttgatgtggacatttagtgctgtgaatttccctcttaatgctgccttagctatgtcccagagattttgctaaagcatacctacttttgttagatcctatggccctaggttagggatcaacaaactatggccatccccacaggtgaaatccagacctctccatgcttctttaaataaagttttattggattatagccataaatcctctcaattgcatattgccagtagttgctttcccactgcaagttgacagtccctaattcaaatctgaaatgctccaaaattcaaaattttttgagtaccaacatgatgctataagtagaaaatgccacatataactatttaacacaaactttgtttcatgcacacaattattaaaaatataatttctcaccttcactgcctgtaatgccagcactttggaaggccgaagtgggtggatcacctgaggtcaggagttcaagaccagcctgccaacatggtgaaaccctgtctctactaaaaatacaaaaattagctgggcatggtggcaggtgcctgtaatcccagctactcgggaggctgaggcaggagaatcgcttgaacccaggaggtggaggttgcagtgagccaagatcgccctgttgcactccagtctgggccaaagattgagattccatctcaaaaatatacatacatatatatatatatatatttttatatatatatatatatatatttatatatttttatatatatataatttcttaccttcaggttatgcatataagatgtatatgaaacataaatgaatttttaatttagacatatatattcaaatatttcaaaatctgaaaacatatgaaattcaaaatacttctggtcccaagtactttagttaagggatactttacctgtacattatcagacttgagtagttgtgacagagaccatatggtccacaaagcctgaattatgtactaatcctttaaggaaatcctttaaggaaaaggttggccatatgatctgcctccagtcatacagtctgattgcagttaatttattataatttatatggcaccaaggaattgttatcaagttagtcagaaatttctgaagtttatcattaaatttgctgtctctctctgtagatccaaacaccatctggcactgtctgtgaagaggctttggcagtatttggtgaagcaggaagaaattcaggaaacctttatcaaaaatatattcacaaagaaacggtgtctaaatgaggtctgtataagttaaaacctgtttactattttattattgaagtcttttatattatcatgtaaccattaaaatgagttgtattttacagattttttgaaaacacgtatcataaacataggcaattaatgcttagaacagtgtaatttataaaaggggcagtattttcataaatcaatttaattaattcaaatgtatttgggacttttttctcgataaaaatgtttaatattccgcatcttgttttgaattgtcatgatcatcaatttaagagacaagatagaaattttctatgattttcatgtgacagttaaaagaagtctatcttagaagtttaattgtaacttagaagtttaattgtatactgaaaattttttatttatttatttatttattttttctttggagatggagtcttgttctgtcacccaggctggagtgcagtggtgcgatctcagcttactgcaagctccgcacctcccaggttcacaccattctcctgcctcagcctcccgagtagctgggactacaggtgcccgccaccacgcccaactaattttttgtatttttagtagagacggggtttcactgtgttagccaggatggtctcgatctcctgacctggtgatccacccgcctcagcctcccaaagtgctaggattacaggtgtgaaccaccacgcccggcctgaaaaatttttattgtatttatttatcttttttgagatggagtctcactctgtcacacaggttggagtacagtggcaccatttcagctcactgcaacctctgcctcccaggctcaagcgatcctcccacctcagcctccctagcagctgggactgcagatgaacgccaccatgcctggctaattttttgtatttttggtagagactgggtttcaccatattgcccagggtggtcttgaattcctgagcccaggcgatctacctgccttggcctcccaaagtgctgagattacaggcttgagccactgcacccagccaactttttaaatatgtacattttcttttctgtggattatgcttaaattaatgaaattttacaaacccaaattaacctgtagtgtaactggttgcttataccttgatattatcataatgggtttttttttttttttgtcatttagtttagtgctagtaataaatatcagtctgatgatatggggaacttgtttctttcattgggtaagttttgttactaaaaagttcaggtgaactgaacagtagatgcagtgatgtagtcaattctttttgtctcctggactggtaacgaagagttcagaactgacatttggtatgtgaaccacattttgagtagcattgaactagtctgaaagcaagctttgtacagtttttgaagttggaggaaacactgaagatatttcagttgaagaaataaattgaatggcttcacaatagacaagtaagcaaaaagcaagattgacatctaacctttctaccttaaaggaaaattacatatatatctcattgtctctcaatttaagcaccaattttaagtggaaactgtatatgctgttatttactatttgcctcattttgtaaatatattcaaatcgaccaagtcaggaaatagtatgtagtgttcttgctgacttagaagacttttgacctgagtaccttggtgtaatattgaaatttagacaaacatgaatgtatttcatttgtttatttgatctttttttaaaaaaattgacatatttgattaatcttagaaaaatcttatttttctactgccgatatatttgggtatttgggaaatgaagtagttctgaaaacaatacaaaaaaactattgagccattagattgtctagttgattcaggaatagactcattaaagaaatagagtagtatagtcaagccagagtacgtaaacatagcaaataataagtataactacacattttaaaatttctgttattctttggagtttcatgatatctcaagaaaattttaaaattatttttattgtaattattttaatcaggagcatgaatatgaatgttggactaacagttttgtgactatcagtaagctgaatattttctctgaattttgtttttttaatgcacaatgactataatagcccttactttgcaatgttttgataaatagatttaacttatttaaaccttgacacaattaatggtagttattaaaagtttgttgttattgctttgttgttttattcttgatagtgatactcttaaaatagtgtctttttgatagagaatatgaaaagaaaaatgttacatagtaaagcatagatttgaatggaattaaatagaatatagagtttgtgtgaaattaatctttaccggaaaggttactagcctatttttagtattaacaaaatcaccttccatctcttatttttctaaaatgatgattatgcttaaatattttagtcaaagtcactgtgattttccagatggttaggagatacatatatgacaggccctgtattttggatggcaggtgatgggagagtattctgagaactgctctttctttatttctttatgtgtttgaaaatgaaattttacagtttcttcatctgaccctaaaatcctggttttctcagatcttttcttttcctgtttggtaaagtttactggtacctgtgttttaaaatagaatgtcctccctttgtatttaaatagaaagtacagacaactgcaattagattaagtcattcttaataaaaaattgggacttgacaactcccatcattgttcccaattcctttttctgtttttttttgttttgttttgtttgagtttctgagaagaactaaaagtcttggaacaactctttctttaacaagtactactattcccttttaagaagtgtatgtgcttcccagcaatttattgactatttctggcttcatcagtggaagagaattagatacatgtagaaattgaaattttctaatcaagagattttcctgaaggttcagatgtggagataagacaaagcagcgagtaagagaataattcgactttgttcatagtactctgacaccagtagctctgattattttaatataaagtattttggtttcaatcgtgctttaatgtcaacatttcgaaattgagtaaaaacttcttagggttagaataaaatttatagtggtagttaatgagttctgagggattaagttttgctcatttcctaaccatgcaccctcacacatgcttcttataaggtgtatgaaattttgagaatagtaactccatataatgttcttttctagtaaatttggtttaaaatatagcattgaaacaatccccagtattttgcatgttacatctcatctttactctttgtcatgtggttattctttcttgatgaagtcattagaggacaacagtgaaaccatcaaaaattctatgatggaggagccaaacatcaataaggtacaaaatatcattcaactgaaattaaaaattgcattctttcacaaaagaacaaagcatttgcattttacttttaaactggtctttgtttccaatggatttaaagtattgttccctcaaattattctccttttattttaacaacttaaatactgcagttgtaaaagtggtttctgttttgttagataagagaatgcaattttaaagggagttgaatgtatcttgttttggctacaaatttttctgagtaaatacaactaaagttcttaatacatgtgattacaatagcaattgtctagtagtattgttttaattctgcaaatatcacttctgaagttaaaattcaaattaggaattaatgatactaaaattaggaattaatgatattaaaattaatgatattaaaaaattcaaattaggaattaatattaattcctaaaaatatagtaaatactgttacatagcatttattttactggtagcaatagcatgtagcaaagtgccttaagaggatacatagtaagtactcatggtacttgagaaccaaagcacaaaagatgagaatctgtataattatgaaaaaactcctaggcgtcctgtgattgcatattcaactatgactatattttattttatttttgagacggagtttcgctcttttgcccaggctggagtgaagtgtcacagtcttggttcagtgcaacctctgccccccaggttcaagcgattctcctgcctcaacctccctagtagctgggattataggcgcccaccaccacacctggctaattctttttgtatttttagtagagatgaggttttgccatgttggccaggctgatgtcaaactcctgacctcaggtgatccacctgccttggcctcccaaagtgctaggattacaggcgtgagccaccgcgcctggccaattcaactacgactttatgaggttaatatttaactcatgtttttcatattctatatttaaaacaatctcagcagtgatttttaagtgaaaaattgctcaaaaaaatttttaaggttactaatttctaccccttattctttccaatgggaatcctttggtaaaataggagaaataattctgtgcaattaattaaaaagcctgatttgatatcaggtgtatattataactaaaacttttgcaaaataagtctgtatgtcattcatactttcaaactatctagtggcctttgggggttttgagggaatataattcaaacttttaatcagttaacaattttccttgcctgggttttgatgattacttattactgtctacacattatcaggaatttttttttttttttttttggaaacagagtttcactcaggtttcccagactggagtgcagtggcgcgatctcagcttactgcaagctccgcctcccgggttcaagcgattctcctgcctcagcctcccgagtagctgggattacacgcatgggccaccacatccagccaatttttgtatttttaatagagacagggtttctccatgttggtccggctggtcttgaactcccaacgtcaggtgatctgcctgccttggcctcccaaagtgctgggattacaggtgtgagacaccgtgcccagccacatatcaggaattcttatacaaacatttttgttttgatgctgtttataaaatgctaataatcataatgttgtatttctatagtcagcttcatgctacgtcaaaatacagtctttttgaggggagggttaacatcattttggccagcatttttccaagcccactgctatatagtttaaaaaaaaaatctttgtaaggtatgcctgacctaaaataactacatatatttaaagtgtacaacttgttcaattttggcatgtatatacactagcgaagccatcaccacaaccaggataatgattatatccatcagtccccagaatttaatccctccatttttttttctctcccacctgtgccctcttccccaggcagctaccaaactttttcctggtgttaaagattcatttgttgttttctggaattttatgtaaatagaatcatataatacatcatttttggtttatagtctgtgtccattgacttagcataattatttcaagattcatctatgttgtgtgttttagtagttcattcttgttattttgatgcttattacattatatggatataccatagtttatttacctgttaatgaacacttgagctgattttattttggacctattccaaataagactgctttgaatattcatgcaaaagtcacattttatggaaaaatgctttcatttctcttgtgtaaatgcctaggagtagaaagactggatcatgtgtaggtatatgttaaacgttttgtgaaactattcaaatattttccaaggtggttgtaccatttatgtatattctcaatggattgtgtacgaaatcccattctattttttttttttttttttaaaaggcagggtctcactgtgtctcccaggctgggtgtagtggtgtgattgcggctcactgcagccttgacctcctgggctcaagcagttctcttgcctcagccttctgagcagctgggactacaggcatgcatcaccatgcccagctcaattttattttttgtagagatggggtttctccatgttgctcaggctggtctcaaacttctgggctcaagcagtcttcccacctcagcctcctgaagtgttcggattacaggtgtgacccaccatgcccagccttgcatcacattcttaccaacagttggtgtgtagtctatattttcattttaaccattctagtaggtatgtagtagtagttcattgtggttttaatttgcatcaagcatcttatcacatgcttatttgccatttgtctatctttctgcatgaattgccttcaaatcttatgtttattttgtattaggttgcttgttttcttgattcaattttaacagttatttgtatgttctggataaaagtaatttatcagaaatgtgatttgcaaatattttctcttactctatggcttgtcttttcattctgtttacaaggtgttttcattttatttatttattttttaagcaaagtcttgctctgttgcctatgctggagtgcagtggtatgatcttggctcactgcaatctccacctcctgggtacaagcgattctcatacctcaggtgtgcactaacacacccggctaatttttatatttttagtagatgagtagactgggtttcaccatgttacccaggctggtctcaaactcctgggctcaagtgatctgcccacctcggcctcctaaagtgctgggattaggagcgtgaaccaccgcagccggccacaagttcttttgaagtgcagaagttcttaattttgatgatgtctaatgtattagttctggttattcattttcttttgggtgttgtatttaagaaatctttgcctaacctaagatcacaaaaactttctcctgttctaagtgtttttgagtttcagtattacatttaggtctaatccatttcaagttaatttgtttacatggtgtgaagtatagacctcagttctttgttactgttgttgtttttgcatctgtatgtcaattgttacagcattatttcttgaaaagattatcttttctttcactaaactacctctttcaccttttcaaaaatcagttgacacagatgagtaggtctaattctggagtctgttttgggccattgatccatctttatggtaatagctcactgtctttatcactataaccttataataaatcatgaagtcatgtattgtaagtcattcaaatatattattcttctaagttcttttttcttttttctttcgtttttttttttttttttttgccttatcactctgacttagaacttccagtccaatgttgaatagaagtgatcaccagcagacattattatcttgtttctgatcttggggaaagcagtcttttattattaagtataatgttttctttaagtttgttgtagatgccctttataagtttgaggacgtttctttgcattcctactttgttaagagttttcataaggaaaggatgttggattttatcaaatgattttttttttttttttgcctactattgaaatgatcatccttttttcttttttagtatgataggttaaggatttttttaaaaaatgttaaaccaatctagcattcccagcataagctatacttggtcgtgatgtgttatcctttttatatatagttacatttgataaaattttaagaatttttacatctatgttcatgagggatattggtttgtagttttcttacaatgttgtttgtgttggtctcagattagtgctagactcttagaatgaattgacgaaggttctgtcctctttaattttggggaataatttttatagaattagtgttatttctgaagtgtttggtagaatcctgaagttttttaaatgacaaatttaatttctttaacagatgtagggcaattcaggtttatctatttcttaagtcagttttggtagtacatgtctttcaagaagtgtacatttcatttatgttgtcaaacttactggcataaagttatcatgttgccctattaaaatatgtgtagaatccatggtgatgctgcctctccttcttctgctatgactttgaaaaccaaattatgtcttctttagtatttatattccctaatatttggggtattgacaccattttatgttcacctgattgcttcctattttctttcagttatgccttcggcattctttagatatcattttacttcatatttgtgtcattagagtggcaatgaagtgttccaagtacacaaccttatattgtaggttttagtaaatgaaaatcactactgactacccagggtctcagtcactttttccatggatctgctgtatgacctttcacttcttccactcttggagcctcatttactgacatgtaaaattagggctgataattttaaacctgttgcttctctaattgaaatattccgtaggatcctggtgttaatctattgtaactatctctttctcctccagcttctaagggcagctctgtggaacccaagcaatgttcagatcagtttctgcataattcctttttgtggtaaaatataaataacataaaagttaccattttaaccatttgtaaagcagcccagtggccataagtacatttacactgctctgcaaccaacacaccatccatctccagaactttttcatcctctccaaactgaaactttgtgcccgctaaacaacagctccccattcctctggcgcccactccaggcaaccaccattctgctttttgtatctatgaattttactatccctaggtacctcatgtaaatggaattgtataatagttatccttttgtgactagtttatttcaccaagcataatgtctttgaggttcatccatattttagcatgtgtcagaatttcctttctttttaaggctgaatagtattctaatgtatgttcatacattttgtttatccattcgtcagttagtggacatttgagttgtgtctgtcttggttattgtgaataatggtgctatgaacattgatatacaaatatctgaatctctgctttcagttttttggggtatatacagaagtggaattgctagatcatatagcaattctgtgtttagtttttgatctgcataatctctttaaatctcttttagcgttaatatttggattcttttttcttcacatgtccagcccaatcaaagcatgaaatctttacagagtgtgacttgaaactttaggagatcttttaagaccatattcattgtgattttttttttaactataatgttatgttgtgaggcctttaacaaataaaattacattcatagcacatgcaagttctgtctctatttttagctgactgtatcatgttcctagttccttcccttcccagcttagatttcatgatccatcatggaatcaatcagtcacttgcaaacatccttatccctgttcttcctacttgccttgaaaattcccaaaccttcttaaacccaactttttgtcctattctgtgcctgcactcaagcagctgaacatgtttggaggaaaagcacaaaccctggagcttgcctcactttacatttattagcacaaatccaaaattaatataaaactaccctgcagtcataataaattgctctgtagcaaatttgttttttcattttcattttcatactttttccttgtttcctgaaacttccagtatttgtttcctactccccacagatcaatatattttgctgtcaaaataagtgtagtcagcagtgatttagcctaacctgcccatcatcatctaatttctgctctgtatgcagatattttcttctgcctcctctaacagagtgaactgttaccctttttgttcaaggccagaactttcacttgtgcacagttcttatctgctttcacctacccaagaacttgtcttcagttcttaataactgaagcccatctccctctctccttgtcaataaatgtttacctctctcaaattattctcattagcatgagcaaatatattttaatgttttgcctttaaaaaatactccatttctctagtctcctatgtagcaaaattcacttagagttgcctataaagtccttcaagatttaaacaataatgttgaaacaccataaacaaaccacccagcttaagaaataaaacattatcaattcagttgaatgtctctgtgatcctttccccgtggactccccttcttattcaccagatatcacattctctctaatttggttattatctccagcccactccactgagattgtcctagacacagtcaccactgacttccagtatactaaatttagtagtcaattatctatcttcatatgattcaacttcttaataatcatttggtagtgttgacgcataacatttttctaaaattgtttcctcacttagtttccataatatcaaactaatctatttcttatattagctaattgataactactgaattgtcctttttcccatccttgaaatattggttgccccagaattcagttctctaactttttatctttcctgtctttactctctccttgggttatcttacggtttaaatattaatataatttgtatgctgacaactctcaaatctctctcaactaatttcccgaactccagacattgcctgctccgaacctactccctactgtttccttcacttctgtccatctcagtaaatggtacctttactcacccacctatcaggcctgacactaggattcatcctttttctttccttcttttattcacactatgattacagtccattaacaaaatgtatcccaattccagccacttatcactatcaccattcctactgccctaatccaacccactatgatctctcacttcagctactgtagtcgccttttaactggttttctgatagtcattctcaaaccctttatgttttatctcacagtagcctggcttttcaaaatccaccaatggtttcgctgccttagaacaggatttgaactctttattatgtcttttaaggccctgcaagaactgaacctctacctttatctccaatcttatcttctgccacttatggtcattcacaaatttaatttaagacttctgagataccactatttctttgacccacccccatgacattctgattatgtatctgacatggggttcagagtatttgtatttaaaaaaaaatcacctcagttgattcttattcaggttatcttgacaccaccttactgagaaacaatgtttttagtaaataatgaggacaggaatgtattcctacatagagaaaggttttttgaagttcatacctgcaggagctttcttcccaaactttacatgtaaagttcgaaaaagctccccaggtgaaactggtatgatgccctatccaaccattaccagcaagtggcacatccctctattccatggagccatcatctttctctgtcgccaatttcttcaaaacctaagaatgaacatttagtatactttagatgccaggcagattggtgggtaagttggaattttgtcataaaattatggaatttgacttgtacatcattaacggatgatcggcgttttgtagtcagagctgagactttccttagaagacaagttgatcctcaagtcagccagaatgttcagcgaatactgaaattcttcctaagcaagttatactttagattagaatatatttgactctttatatctggcaactgatttttgtttgtgtagggatattttggtttggttatcttgtaggtctctttgaactttccaattgaacagtgatcttaattgcctttcttttatttatttatttttttgagacagggtcttgctctgttgcctgggctggagtacaatggctcgatcttggcttactgcagtctctgcctcctgggttcaagtgattctcgtgcctcagccactcaagtagctgggattaccgatgcgcaccatcacgcctggctaatttttgtatttttagtaaagtaatttctagttaatttttgtaattttagtaaaattttgtacttttctccatgttggccactcctgacctcaagtgatccactcacctcagcctctcaaagtgctgggattataggcgtgagccaccacacctgaccttagttgctatttttaaaacactgcatattctgatccattctgtggtcaatggccgggcattggtgatatttctatcaaaattttgcagtaagtaaatttattgtatgctgatttcagataatttatgcatttcacaataagtctgaaaacctaattcattttaaaagattgaaagttagaatggctgggtgtggtggctcacgcccataatcccagcatttgggaggccaaggtggccaaatcacctgaagtctggagttccagaccagcctggccaaaatggtgaaaccctgtctctactaaaaatacaaaacttagcccggtgtggtggcaggtgcctgtaatcccagctacttgggagtctggagcaggagaattgcttaaacctgggaggcagaggttgcagtgagctgagactgtgggccactgccctccagcctgggcgacaagagcatccatctcaaaaaaaaaaaaaaaaaaaaaaaaaaaagcaggataatatgaaataatgtcctatattaggcaacatttcaactctttaattgcctcctcttttctgcttattttagtaagtgtcgattttatatagtattcttttctaagtccaaagatgtatacactttgtctggagtaagcagaaggtcaaatatatgtccctcatctaaagtacttagaatggtggtttatttagctactaaaatgattactcacttgggcaagttacattgcctttcagaatttcaggtttctctataaatcaaaggttaactacagccatctggccaaatctcacctgcttctatatagtccatgagctgagaatttttaaagggtttggaaaaaatgcaacagtgaccctttgtggtctgcaaaacctaaaatattgactatctgaccttttaaattttaaaaaataatatgaaagaattataatgctaggaaacttggtaaatacattttgctttaataattagaatgtgttgatcctttaaagttaattaactgtatctcgggaggatagccacttaatgaagttgtatgttgtatcagctgtttttttatgtgtaaaaaagcaagtttgaagaaatttaaatttcccatgtcaaattttgttttagggataattagcatatacaataatacctttagaattgaaatatctactttcttaaaataatttatgcaagtactaattgatagattggcatatattattagttctattactaaaatcagtgcatttttgtgttttgtttccttttatttagatagaagcagatttgggatatcctggaggtaaagcaagaattattcataaggaatctgatatcattactgcgtttgctgttaataaggtaagtacatagacattcttcttttgtttattaagtatttatagttggataatatcttctgttttatcagtttatccagtatttctttcccaaagctgcttccagttccttaaattgcaatctggatacttttttaattttataaaatgatattatttgataatgtgattttgttattatatgattttggagatacagctgatacataatgttttattactatgcagagagaagtaccaaatatatagacaatcgctttagaatttatacaatgtactatagtagttaacccacagaaaaagttttttatgttccttatgaatatgtcaaatgtggttctgggtatttggtaagatttaagcttatatgtgactcaaattctccctctttgatttatacctccgatagctgcccaacgtgtgtattttcttagtatttcttaaatttctacttaacatcctccttagatgtctatacactcctcacagaagaggtggccttaggtactatagtccaagattgaaatctgtcttattaatcattttccccttctgtctcccctaattgccttactgtatggttcctaatgacttctagttattcttttgttttccttccattaacttaaaggatatgtgtatcttctttttatgtattcatagaagatacctaaaggagatattgtatacatatatataagatgttcatatgttcctaattttaaaataattgttaaatgttatgtagatacataccctgtaatatgtatatgtaatatgtaatacagggaagtgtgatatacggggaaattacccatttagtaatcctttcaccagttggttttctgtctttctgtgctatgtctgtcttctctgaattcttctggacagtatctttgttgttctgtgtgcttcacttaatttccttcttagacaccgttgagcaatgactggctaaagggctgattccagatttgcctgcttcagacagttctgttatcaaagaaacagttctgtttgaaacaggcaaatctggagtcagccccttagccagttgtaatatctgtataacatgatattatatatacatgtcaaatacaaaattattggccaggtgtggttgctcacacctgtcatcccaacactttgggaggccaaggcagtaggatcactagaggccaggagtttgataccagcctgggcaacattgtgagaccctgtctctacaaaaaaaaattatctatacctgcattacctgctctttcttgaagaaaatatgatttaaaatagtctgtgctataaaagaaactagttgttttcttcttgagggtttatatataagtactggtaatgaatagctattcacatatataaagtctacaagttactgtctatgaatatgcctgtttaatttttatttccccagatttgctatttttatttattttattttattttattttactttattttattttattttattttgagacggagtctcgctctgttgcccaggctggagtgcagtggcgcgatcttggcttactgcaacctctgcctcccgggttcaagcgattctcctgcctcagcctcccaagtagctgggactacaggtgtgcaccactacacccagctaatttttgtatttttagtagagacggcgtttcaccatgttggttggccaggatggtctcgatctctttacctcgtgatccgcctgcctcggcctcccaaagtgctgggattacaggcgtgagccactgcacccagctgatatgctatttttaatatccttactaaatttgcagctgagaaataatacctcttgctttaagttgcatttttttaaatgccattgagattttttttgccatttgtttagttgggaactacctgtgtcaaaaactatgaagggtctcagattttaccttaaattaaaactaacagttagctttctgtttctgttgccacagaaacagttctgtttgaggcaggcagtggattgtttaaacagtccatttaattgatccattaaacattttagtggatgctgttagaagacatacgactcttggatcagagacaaaggacagtttatgtctaacagcaaaagcaataaccagaaaatcagcactttacactggttgcctgagccacaatttccagagaatgacgggaagagggccagatgatacctaccttacctacacacatagtaggttatattacaggagaggatctctgagtttaggggacccaaatcttttataatcgatagtaagcatacttgccctttgctctggagggagagacgatagttatacaaacatcctggcaattatactgcagaaaaaagggcagacatgactcacttataaaacatgcagaatttgggatacccatggagaataaccacccaataatctagctatatcattttttcatttatttctaaggtctcagttttttcttaatagtttgtgttaaaatctaacataacagtaatggtaatcctattttctctttgctgtcaatatcttcctgttttctgtttcaaagatacacatttaattaattaattaatttatttatttatttatttattgagacagggtatcatgcctggtgcccagtgctgtggtgcaatgtcagctcactgcagcctcgacctcctgggctcaagcaatcgtttcacctcattctcccaagtagctgggactgcaggtgcatgccaccatgcccaactaatttttgtattttttgtagagacagtgttttgccatgttgcccaggctactatcgaactcctgagctcaagctgtctgcctgcttcagcctcctaaagtgctaggattatagacgtgagccactgcccccagccaagatgtacatttttgattcataggcatttaaaatttcatgtcatttaaccttagcaacttttcatttgtgatctttttctggcatacttctcccactatatttctgcccctacaccttttttctgtgaccctttcccacttcttttttttttttttgcctaagattgaaaagctttaggagaaagtttgttttatttaaataattaataattatgtttttagtttggagttccttattgccctcacctttctgtaccctacaggttcctatctttttcagcatcttcctccacatttctgaattgtgcataccttagagcgatcatagcattctagcagtctagaaaaacagtactgggagaggaaataaaatgctgcatgtattgccatttatactggctttctattggatgtacttttcatagaacataaacgtatctccaaactgaagcttattatttcactaaaagtaagaatgctgtatatcctgtactttagttatcactgctagaggttatttcaaaactaccattttcaaaagcagctcatatactatctcttttgcctattgcttttaaaattaccatttgacttatttttcaggcaaatagaaactgcatagcaatcgcttccagtcatgatgttcaagaactggatgtttctggaattctggccacacaggtctacacttgggtagatgatgatatagaagtggaaaccaaagggtaccttcatagtttgtttctatttagtaatgttgcaatatgagtgactatatttactgaactaaaactttcaaaagattctttaaagcaatgtatagattgtaagcagagtagaagctgatgtgctaaatgaggggtggcaagagctttaaataagggaactgagagaagagtaagtgaagggaacagaaattgttgaggtatgaggtcattgtgtgtgagttacaaataagagctgaagaaaattaattttaaagggaactataaattcaaattttagacctttcaagtgtaaaaaagaaagaaatgatgagttgtttttattctggttgacattcctttatagatcagaagatttcttggttatacatgctcgtgatgatttaacagctgttcaaggtacaactccatatacacatagcaatcctggcactccaatcaacatgccatggcttggtagtacacagactggcagaggagcatctgtggtatgtaaagttaaaaataaatttaagttatatgtaacttttatttttccctctaggttaatggataaaggatgatttaaaacatttttcttaattcctaaagttttagtaagtcttacatgttggaaattgtaaattttgataatgaagactagtatgttttcatttgaaagggtaataataaattgttttaaaaatatactttgcttgaaaaccaaagagctatattttaattaagaattatttgaaacatggttcagatcaggcttcagcaaggtgttccccatagatcaaatattacccatgacctgtttttatatagctaatatgctaagaatggtgtatacattttagtgaaatggtttatacattgttttttcaatagttgaaaaaacaaacatagtattttttggcacatgaaaattacatgaaactggatttcagtgtttttttacaaataaagttttataggaacacagccagtcatttgtttccattttgtctgtggatgccttcacactacagtggcagaattgagtatctgcaacagaaagtaaatgcccataaagccaaaacacttgctatccagtcctttataaaaaaaggtttgctaaccccttgtctaggtatcttttaatggatatcaattaataactatatccatattaagtatcacttttttaaatgccaggacaaatattctttttttttttttaacaaaaacaatatataatttcttaagttaagcaaaaagcaatataataatgaactgaaacataatttttctgtagtgttggaggatcttttttagccctgattacctagagatgtgattcatatttgtacttccaagcctttattattacgtaggttataggaactaatgaacggatttgaagaagcaaagaaaggtggtagggtttttcagaatttcataagtactgtagaatgctttccttggccaaaaaaaaaattatttttcattaattagtatgagcaattgttcaagtaaaatctgagttatctttaataataccttgtaatattttgtacctaatggagttcctttatagttgctataaccttataatttgcagtatctgttgtagttgttatttactcgtatttaaacattcttcagatgaagcttgagatccaaaaaggtcaagtggatcaacttatgtcactttgttaaatgtatggtagagcttgttttaaagccctctgttctccttagttcagtgatttcaagtagcagtgttttaaggattaaaatgaacttgaaaagcaatctagtaattattcaaatgaaatgacttgctcagtggtggttaaataatttttccagctgacagatatgttacaattcattggtaaaacttactgatattatattcttttaaaggagaactcaaagggaatatatgccaaagaagtgcataggactaataggcacttttttgaattccaacctcagagattacaatatagttcttcctgtaacatctttcttgttggtctcttcctacttctattctttacacagcagcagccagttactcttttctaaaacatcattcaggttgtcactcgctttctaaaaaatttcagatttcccaatacggcttttaaataacaagtcattaatagggccctacaaaatttaaccttctgccatctcatctccctttattctacatctgattctctttgctgtaattacactggcttctttctgtctcttgaacttattaagctcatggttatgtcaggagcccttgactttccttctgcttaaaatgctctatccctctgttgtaccattcacatctcaactcaaatccccccacatttccctggcttccctaattaaggcatttgcccctacccactctacccccagtcaccttatattttatcatctttattatcccttgcgcttaccagttattgaaattattcattacttagttgtgtttttttttttttttttgagatggagtctcgctctattgcccagtctgcagtgcagtggtgcaatattggctcactgcaacctccaccccacaggttcaagcaattctcctgcctcagcctccctagtagctgggattacaggcatgcactaccatgcccggctaatttttgtatttttagtagagatggggttttgccatgttggccaggctggtcttgaactcctggcctcaagtgatgcacccagcttggcctcccaaaatgctgggatgacaggcatgagccaccgtgccctgccttaagttgtcttttttatatgccctggaatctaagctcttcgagagcttggattctgcctgccttgcagattgatgatttctaactagaatggtattggacgtatagtaggtgttcagaaaaatgtgtttatactccaaagcattgtaatacagaaatctaccataggcataacactaaggattgaattttcttcctacctaaatcttaggacatctttttatttcggataactgtgatttgttaacatgagggttcggattgcctcactctaccctcaacaaaaagacaccagtagaataaggttgttcttttttacatggatcttctaaaataatgattttacatattttacatatgctttcagaaacttttttaaacctgtgtttgtatattttttttacgtatggttctcctgtgaatattaaaaaaagaagacaaaagcaagaataggaaccttcaggcatttctttaattaagaagaacatggaatttaaatatgaagtttactaaacagaagtcatatgcagcaggtttttattttttctagagaactgataaaatattttctttatcctttcattttatcaaatgataaaaactaatagcaaaaaaatatcattatgaccagcttctgctattttggagtataactgcatcaatatatgtgtttcagttttatttatccctcttcttttctctggcctagtctctgttctccctaccaactccccaccttctccacaactttaggctaattgaaccatttaaaatccaaaagaataacaataacaaaacctacctgagactgatgctacaaatttaagataacatatatttgtagttatgatgctatataaattggaaatgttctataaatttttcctttaattttatgtgtttgttttactcttatttgacaggctagttaaattattcaaagcataactttaaaatgagtaaatacatagttccaaactgtttttaaatttatttaattttctcttcttttattttcacatgctcctgtcttttaaacttacactattcaggattattactgaataataaatgtaatgggatcagaaaagaattgacaagaaaggagggaagactaaattcttgaaaggaatttatctttagatcctagtcagtaatgcccaaaatatatgtgcaaatataagagctgcactattaaatttctgttatcatgtttagtatttttagcacccataatgatagttatgaactcatgtaaaaataaataaatgaatgttatttgaatttcctgtcacaatttaaatgtttaatcctttttattatgcctataaaataatttttctattttaccagatgattaagaaagccattaataatgttagaagaatgacttctcatccaactcttccttactgtaagttgaataataattagcaattgtcctttcttattcttaaatctatttttggtaattttattataagaaatgtgtgggaacctttttgttttaattgaaagcatttatttgactttttttctagcgaatatttgccagtaaataaaatcttgatttcaaaactgggtaaaaatagaaaaagatatttccctaaaagagaaagctgatttaatgaagtaaattttttgacattttgactaccaatcaaaatttgcgactaccaatacacaaaatttgtgtatttctaagttaacacattttatctttgaacatttctggatttctttgatcatgctaaattatagtgaataattattttaataatagaaccactgccaacctttattacataagccacaaccgtacctcaattatttattacctcatcgtactcagtttgtattttattactttttttcagttggtcttttatgagacacattaatagtaaacataggaaattattattagtttttatattctaaggcagaatatatgtgttttcagttaatcttcctaggaatcttaaaagtttctcttccttcaaccaagaacttaattaatggggaatttattggaggtattgattctggtgggttggaatcaatactcatactggtgtgtgagtattccaagttttttaatatttttttttaagttatgcccttcgtcaaattgtcctactacatagtaacaagaataatgcatgttaattaatgggtattcatgtcccccagtttaatagcctattaaaaactttagaaacttttctcttgggagatattctgataaaatgcagttaacaaaatcagtattcttttctgcttcatttatgataaatgctcaaataatctattatcaaagttgtgtacgctgtacgaaacaaggctcaagagaaccgtatatgtaaaatgaagagaataacatctgttacttatgctagaggtataacataatataaaaaatttgtctgttttcactacatcaaatttattcatcgctagaagtgtgtattttttacccacaagtttaatgtcaggtgagaactaaaaagcagtcatgaagcctatagtgtaaggagtcaaaatgtgttttatatataaaatttaaataatattattctacatcaggaaatacttgatattgcttaaaactaccctattctatgcagtctggttggaagttttctgagatactgaagggacttcatttttctctcagtcccataccatgtgtcctggcaggtgtaaatatcctataccttaatcccataaacttaaagaggccacgctcaaagcttcaaaggtaattgatggacctattgtcagaggtgttaggtagcatcaattactgctgtcttgagagataaatcctttctctgtttagagaactgccaaaactagcagataagacacctgaaaaattaaaagctaattactggattttttttccagtatatcttttcatgtcacaaacaagtcccacaggtagtaatttagtttgataacaaacacttttcgtgttgtgaaaatgttatgagacaggatttttaaaaatattagtctgaagttcagatacctcaagatagctgttttctttccttggaatagatcttttgaaaaattcttaaagaactttttagaagttagcctagtacattttataattttctgagtagaaaacacactgtttctctatgctgtcatgtacagttctgataccagatgtgttggcttttgtccactccaagccattctccacctctccaagtactggctgggtgccttataatttggtttaattatgacacagtctacctggagttagaatcatatcctacaggttaagggctcagtcccacaaaactgctccttacttcagacaccactcgcaggttatcagttttcacctacacatctggcatactggctataaatcagagtgcccacagctccctccttgggtttgattaatttgttacactgattcacagaactcagggaaaatgctttacttacatttatcagtttattataaaagaaacagatgaaaagtacatagaatgaggtctgtaagactcctaagcagaggagcttctctccccttggagttagggtgcactacaaacctggcacatggatgtgttcaccagccaagaagctcatcagatctccttgttcaagagtttttatagaacttaatctccagctccctttcccacccttttctggaggttggcgagtggaactgaaagtttcaatgctttaggctatctgtgggaccccatctaagacactgcattagcataaattcaggtgctcttccatgggttttagtagctgtatgccaggatccagggacaaagaccaaatatgtattttatgtcacactgggtcattttttttcccttctaaaatgtttaatgtgttttccctgtttaatttttttccccttctaaaatgtttaatgtgttttccctttttaataagtatttgttgaaatcatacacttgataggttctatataagcctagctgagtaaaagtgaagtctgctctgctggaacattaataaggaatctcagataagatttttaaaaacctcttgaggctcagaagtcaagccaaggacttgccatctgatttcacctgcagtcctatagatttgggttgattgctcttttcttgaggtcctcagaaaatcctggggttcctttgtctgccaggaagtgatagtctttactcttctgtaaggcaaccatgtaagggactatatatgtacagtaccaggccagtttttctgttttttggttttttttcaaggtatcttatttgctctgtcagcctttggttccttaaagctgtctgggtgatatctgattctgtgcatagtctccaatatgatatatgagtcaaagccttggtaatacgaccgatgtttccaattatgtcctgctataagaaggacaggttctttttgcttttactcctggcaagctgtaaagaacagattcttactgaacttatgcaaataactatattgccatgaaaataagaatactcactaatagcttccaaattctggagggatcaggtagagagaaaaagtaattgttttatctttgttcacgaaggcatactttgccaaatttccataaactactgaatagcttaagagaaaagaaaaaagttttcttaaatctggaaaacaaaataaagacctagcaatgtttcaaaaccataattattaaaaaaccatagattttcttcaataagttattcagcctctcatacttaattcttgttcgacttgatcttggttagcagtttaatgaatttataagttttttcccttagagttctggaagttcttacactgtccaatgataggatctaaatgttatcagaaaccagtacctttcagagtcttttctatgaatctccttgaagacagagcactttaggattatagttacttgcagacactttcagtgaagatcaggagaaacaataaccatctgtcagtgacaaaagacttaacatggccatgactaaagatcaattcattatcataatgcacaattgacaagtaaatttgattgcttctgtggcatacaatattttaacaaaataactgaaagtatggctgataacattatacaaggacacatcagatttttagaaccttcatgcaatttctggaatacttatctaatagtatatacccatacaaatataatataagaaggtatcaccgttatttgacaatgcttcccatgcaatttaacatatcaattaagcctaattattttaacattcttctttttagagggagtgagaacaaattttttttgagatattgcaagggccctttggaaactcgcaaagttagagtgaggtcaaaagtacttcatttataatgtatttttgggaaatttgtcaaaaatatcaaacagtttaaaacacttgattatagtaaggttactgtggaaaaatatttaaccagagtgataattaaaagacatcaaaggcaaatacagaaagttatgttgttgtagaaaaatccttagctattttaatgttgtaggaaaaaaaccttagatattttaatattgaaatatagctaatttaataataatgttaatattaacattaggtcttaggtaatcaaagacctaaaaagacatgaagcacaggaaattatcttgataaaacaaaatctcggctgggcgcggtgactcatgtctgtaatcccacctcttagggaggcagaggtgtggggatagcttgagcccaggagttcaagacctgcctgggcaatatagggagaccccattctccacaataaaggaaaaaaaaaaaagacaaaaaaacaaaatctcgattttgtagtcagattgcttaaaaggtaaaaataataatattaacattaggtctaggtaatcaaagacctaaaaagacatgaagcacaggaaattatcttgataaaacaaaatctcgattttgtggtcagattgcttaaaaggtaaaggaaaacctttcataatctcttgtcaagagaaaaccaatactccagtaaaactttgcaccaatgtacttctgatattaaggctcatcattcttttaataacatatataaatacacacatattagccagcttggccacacataaaattatttttccaaattcctcttacacaaaccctgtatagcattctcgtatccatgcatattttgttctgtactcttcctctttcccaatatggaacagtctgctttaggacaaaaattattctttttcccataagaaaaacatccttcatacctcatagcttcacattccaaaaacatcttactttcctgacatacaaaattatttatctattttcagtagttttaattacatatattgattagaattcttaactgttagtaatgttagtttctagtgaaaactaggtaataagcagttgtgcactgtcagtcacaccagcattctatagagtagcaaatctatatctttcataatttacagaagcatgttctttttcatagtatagtttttcagtgtgtcacaggacacctttactaacagacccaaatatctttattcttctgcaataagaagccaaaagtagataagcttatgtttagcaattaatgttttagtattttatgtaatttggaagtgatctagatattcaattaatatccatcatttaatttaacttaatgaaatactaagggtataagttgtcaaagggatttggaaaactgttttgaagtagacataacaccagacaaggccagccatcaagttagtcattatttattttttgctgacaaattttgtaacaaagataacatgagtgtatttgactagtaagcctaagtaaaataaaagttgtatatcacattatatttagtgctggtaactcttaaggatatgcctgctttaattaaaccaacaaacttaaatttgctttcatttaccaaagattatcccacatcagatgaacttgaaaaacatttgggtctgtttctatctttctaaaagtttaaggaatacttaatttatataagtgcttattttaagtgcgttagatataattattaaaaattaattttgacaataccatctggtgatagaaaaatattacatatatttaacatatataaagtcatacacaaacatacaggcagaagcagattctatagttttccttctaaattttggcgatctgccagatacaaaatatcaaactcagtcgtttataaaaaggatatctgggccgggcacagtggctcacgcctgtaatcccagcactttgggaggccaaggcgggcagatcacaaggtaaggagattgataccaacctggctaacatggtaaaaccccacctctactaaaaatacaaaaaattagctgggcgtggtggcacacgcctgtagtcccatctactcaggaggctgaggcaggagaatcacttgaacccaggaggtggaggttacagtgagccgagatcacacgattgcactccagcctgggcaacagaacaagactccgtctcaaaataaataaataaataaataaataggatatctggatccaaattgtgtttctgaaaatgggacaagattacccacccagattgctaaaactttactattatttgttgaagacttttaagatttctcatttgtcttttgtaaagactcttttagagagacaatttacagttcatttagtcttctagtagcctctgcataccaatcaaaaaatgcctcccactgtttgtgaagcattagagattcccttttatttagtgcttcctgtagatggacaattttgtgtaaattaaaaacttccctgttgtggccaccataattctaaattgtctttggtaaatatactcatttctctaggaaagcacaggttctgggtccataatgtttatgcataaaattagctggagttccagttggaggagtttttgaattccttaaattcagatgaacccatgatttcttgtccttccaaaatcttatctacctgaggcctctgactggacccaatccagtcaggttcagtctgacttctagacctgatctgaatgaaaaatgcttaaaggataaaagttgcaggtttcaggtcaagcggtaaccttcaaatgcacagtgagaaacagtaggcacaaggggcctaccaggaggtaactgtgcctggttacttgttgctcctggaggtcatcatcaggggatctccttcatgttcctctgctgagaactcttaaaacataggtacattaaaaatttaatgagtttattttagctttcagctcaaattcatgaactgggcaacaccagaccagaagccattaaggcttcaccgaggtggcatgaggggaaaacttttataaggtgttcaaggaagcacaacaaagacagtatttgattggttaagtggaaagtcctcagttagaagttagttgggggtttctaattgataagcatctagttagaagttagttggtggtttctgattgattaagcttaagcttcattttactgtttacattgaattgagttttgatttgctcgtataggcatgcaaggccctggagctgtcttagcctaatagcctcccaattaatttcttttttttaagatttttttaagagacagggtctcattatgttgcccaggcaggagttttatggctacttacagcacaatcaaggcacactacagctttgaactcctgggctcaagtgattcttctgcctcagtctcctgagtagctagtactataggtgtgtgccaccaaacccagctcttaattttttaacgttataaataataatagaaaagttgagcgattttagtgcaaccaccccaatttatttttctgattaagctatgcaagcgcattgggggaaagggagtagagccagtcaaatacctagtctcaaaaaactctacctcctaccgctgcccaatggtaaaagctttcaaaccaattgaagttcatttattttaaatatttgataaggaatgagggaaacttgactgatatgtgactagcaagtgctagatgttttatataaatgtattttttttactacctccataccacattaatattgataatgatactctataaattgagtgttatatgttaggcatatttctgggtgccttatatatgtgatctcattttctactcacaactgtccagtgacttatatatcattagtccctttttacaggaaggaaatggtctcagagagattaagtaaatttcctagtataacacaaataataaatggcaaagcgaagaatcaatagtcatttatcttattcatatttctcagtaaaacaagtccggtgcagtggcacgtgcctataaatcccagcctcttagaggctgaagtggaaggatcacttgaggccaagagttaaagaccagccttggcaacactgcaagaccctgtctctaaaaaaaaaaaaaattaactacaaaattacaaaaaaaacagataacatatatttgagatattaggccaatcaggataacttttagaactgatttttttctttagcatgacatttaaaaccttctttaatctgatttttttcaaagaaaaatgtgtatacatttacacattaatagtataataaggattgattctaacctaagaatttcttataatgagtaatatataatttattataaaaaataaaaggctgttaagacatcattgagataactttaaagggaaataaaatttatggagctatgatttaaatgctcctatcgtatttgaggatgtgttcttagtcaaatgaaagtgtattgtataactatttttatgatgaatagtattcaactgaaatttcatacaaaggtaaatttatataagttgatttagatgtttctttcataaagattttcacataggataaagaaataacttttcccaaagattcttgaaataaatctgcaatttttgccctcttgtaatgcagatctgacaggagctcaagatggaagtgtcagaatgtttgaatggggccattctcaacaaataacctgttttcgatctggtggcaattcaagagttacaagaatgagatttaactatcagggaaataaggtattatataaaaatgtaaatggtaaaaaatttattgtgttggaggtttataaattccactagtttgggtttctgaaaagaacagctccgtgggtagtagtaaagtattgatctatatagatgcttttaaattcttctcaaagaacacttaacttcacttgttcttcctagaagtatgttatataggtgtccattaaaactcagttaagtgattcttaatgaccaaacgattataagttcaccttatattacacactttttattattaaatgctcctactctctttatccctcggaacctactcagtgtgtgatccagcagcaagtaacatctagagcttattataaatgcatattattgttccttctccagatgtgctgaatcaccatctgcattttaacccgatattgttgtgatttttacaaatattaaagttttttaagaggtactgctccagaacaacatcagcaaactacatcctagccacctgctttataaataaagttttgttggaccacagttacccccattcattatttttctttggctacttcctactacagcagcatagttcaggaggacaaagaccttatagctggcaaaataaaatatttattatgtggccacctaagaaaaagtttgccagacctgctctagagcatcctttactgtcttcacttctcataatcctttgttcaaactgcccccctccccacttttatgttagacagcaatcttttattgaacagtactgctccttgtgaagcagggctagttcagaggcagtgcacccacagccagcccaaactgcctctttttgctcctaatatgttattagccctttacaaaataattaaagagtaaatcagtcttctttttgtcttcagggccatgctgcaccaaaaattactctcacagactctaactgatggttcaccttgccttttctttcccctcagcctccctcacacattaaattctcctcacacattccttttatcattgtgtgctgcaaccttttttgtctaccatgtttatcacatggctctattttcatttcacaaaagtagttttatgtagttgtgaaacaaaattttgagagcttgtttcttaatactaattagcaacattcttagctccttagtgggaaattaagggaacttagtacagatgcctgtataattctattgtacttttagttgtattctctatcaatgtgctttttgtgcatttcaacttgggttgtcagttttatattgctcctaactaatctctatacctgaacccttatctctctaatgcatcttgccaacagtattatataacaaaaaacatagctacatgattacaatataggtgagatcacattattatttttttcaagaacccttcaaggctcctcatgtcaacttctttaacaagtatttaagaccttctataatgtgactatttttcagctttaacactcactacagccttctgcataggctattttaaggcacaaaaaactgcttgtctttgcctgcacaagtatctttgaccggcagtcaacttactattcattcaccttagccttgacgaagtctaatagcacagcccctaagcatgctatctcttctagtagggaagcctcttaaggtaaatggaagagataactcacactgtatcacagtaattctgatgaattggatattcaattatgaatagaaatacagtgccaaaagccagtgaatatttcagaaaaactaagtgtctggaaaggggtattaagcagaataaataataaataacctatgaggactaattcctcagagattcaagaatatattacatttatacaacaagaacatgctagcattaaacaaggacagtaggaaaacagaaaagagttattggaaattaaaaatacgattcccaaaaatgtggtcagtgggggaactacttattagaaaagctgaacagcagaatggaaatagttgaaaatcaggtttgttgctgggaagcacaaattaagaaactatcccataatgatgataatttaggaaatatttcagaagaaaaaaatggaggaaaaacaatattcaaaggaataatagatacttccccaaagcaaagaatagaatattggaagagaaagggcctaccaagtattgagaagcaacacgtacctgcacacatcctgtttgtgtaacttttggtttttagagttaaagagagaatcctataaggttctaaaaaggagtgagaatgaaaaaggttatttacaacccacatcccaccctgccactaaatgtcgttggcctgtcacaaatagataggagaacaatatccacagaattctgatggacaaggaatgggaactgagtcgatgtgcatccaaactatcattcaaatttgctagcaaaataaacatatttttaggtatacagagacttaacacattccatgtgtataccctttctgaagaacatacctagatctactccagaaaatgtaagataaactagaaaaaggaatagacctgggaaaatattattaacaaatataaaaacagtaggttaatattcataatattagtcatatcagttaaattttttaaaagacaaatagtagagaaatagataaaacatcttaacagtttaccaagaaactttgcctggccagtagccttctaccttcactaataattgaagaagtgcaaataaattgagacttattcttgtctgcataaaattaacaagtattttagattttaaaaataccccatgttaactaaagtgtaagaaaaatggctgtatcaatttatattaccacataggatttaattttggcatagtctattaattttaagtgatgctctttaacaaaactttcccatttctagatgtctatcctacataattatgcaaaggtatatgtatatataggaatgttcaaagcagccctttttatattacagaaaattgaaaacggtatggggaaagttttaaattgtaataccactgtacagtgtaatactacacacagcacaagaatgatctaaatttatgtgtaattacctgggaaagatagctataataaataaaaaatgtaattgtgtagtggtattattatgatcccaattttttaaatgctatattgtgaatttttgaatactcatagaaacaaatctgaaaggaagcacatcaaattgttaatagatgttagatctagaggcagaggagggtgggagtacaaagcagacatttattttatatactttataataagctgcgttatttttataatcaaagggaaaaaatttagctgtcttactcatccttcaagatctgtatcaagaatacctcccttagtggattattttgacatcttaccagtcagacttgccctgagctcccatagcggaattattttactttgataatccttatatcattttactttgtactcttgttcatgtgttttccttattgtttgtttctgaaaatccttattttatctttctggaaatgaacagttttctttcttatatatgataaagttctgtcacatagcataatctgttaatccagtatcctgtttttgtaatacttacagagaatatatagactatgctagaggctactgtaataaaatgggtgtctgatgtttgttctctttatgttcaccctgggatttttaaagtagtagctgaatgtttttctgaaatagatccatgtataggtgaagtgaaaaatcacatgacatacagtcaaatgtttacgagtcaaaatatgggtgtcacactgagggtaaggataaatatatgcttttatatttatattaaatacttttaaatattttctttctctaagtttggaatagttgatgctgatggatatttaagtttgtatcaaacaaactggaaatgttgtccagttactggaagcatgcctaagccatacctggtaagccaagaatttctacctttaaataaaatttgaattttcattttaaataaaccaagaatacgtatttgagacaagaaatatagaactaataaataaaatatagtcctgtgttctcagtcactttgctgtaagattctgtccttgtgttatgtgaaaattactctgtgaagcataaaattccttagtctctgataatttgggaagttgacatgtatagaagcaacatgatacccccagatacctatacatcttgtggattactagagcccttttctaacctcactaaactggttattatattatgcctaaatagaatgattaccagaccaatgcgtctggttatttttctgcaattatctcttatgaacaaacaaagtgaaaaggacatcctatagctggtactgttattttcttgttcatctcttttaatttaggattatgcaggcttttatgaactttctgtggcttcatagaatactgaatttatatttcatatcttcagtgaagctctttataggactaagcaattcctatcagaaaaaaagttaagaatataggttaagattctggtaatttgcccaaggttaattgctagaatacagtactgatctaagtaaaagcaagcaagcatgggaggattgattagggtaccttgaaagaatattaactgtttctcatatttttattaagcttaaagatttagatgtataagtttgttctctaagggactgttttttttaacttttaaaaaaatgaattggtttaaattatgaataactggcttttggagattaagaggattttgtctgttttaaggacacatcatctagcccagctccagtagtgttccaggggaaatggggagttggctcaaaggaataatctttggtgtggtgattttgggatacttaaaaaaaatcattttttattaaagagaaatatgtaaaacataattttgaagcttttataaatgaagaaacctcataattaagtgtactgtttggtagaatattgaaaaatgctatatgttttctaattttgatgactattagtaatttttttcatgtacttgaatttttaaaagcttaaatatttttgaaaaatatatgtcaattatttaacaaaagtctggtatcatctaaaattctagtttctatcttctgaaacagaaattttcactatgctaggagaaggtctttaagtttaacctcatgttttcctttgaacttttggttgaacaaaagcaaagagattcataacgggtcatgatatatgcagcctacttaaatagttcaggaaaagtgtgtgtatgcgtgggtgtctacaaatatgaaagagaagtagaggcaaaacaaatgtgccaaaatgttaaaaagttgctgcatctgggtaaaaggtatatgaaagttctctgtattacttttacaatttttctaaagttcaaaggaaaaaaacgatacagaggatttaagaaagccagaaactacatgatcacttttcgaagaatacatttacctggttatgacatttttagtgagaggagtaacacgtattgtttgtaaccattccagacttggcagtgtcataacaaaacagccaatgattttgtcttcgttagttcctcctctctgatagctacagctggtctttcaactgacaataggtaagagatgatagctaaaattgaagtatgagaaagtatagctgaacttttttttattgtttctgtccttgtgtttgactaaagtttacttatggctttagatacagtatttttattctaaaaactattatttattggccatgttattccagccccacccccaaaagctgtggttgtaagaaagtgtcatctcctgccccagtatctgtctgcctcttttgatttctgttatataactgagttctgagatcaaggcccactgagtttgcttagcttatatatttatctgtaaggccacactttgcactagaaacaggattgtaagactatagattcttcagctcgtcttccgtagatatttcttacgtatgttggtccccccacacagtagaaacaagttttctttgtgcttaagaaaattcagcatctctcctgttaatgtatgtcagtccaactgttagagattcagtgaatacaaaaagaagtttccatattcagacttcatatattattatttgtaaacgcatgttaatctaaagttattcaaatttttaagctataatagtagctttaaattttctgtaaaaattgtgggtcgggcacagtggctcatgcttgtaatcccagcactttgggaggccgaggtgggcggatcacttgaggccaggagtttgagtccagcctgggcaacatggtgaaaccctatctctactaaaaatacaaaaaattagccaggcgtggtggcaggtgcctgtaatcccagctactctgggggctgaggcaggagaatcgcttgaacctgggaggcagaggttgcagtgagccaagatcacaccattgcactccagcctaggcaacaagagtgtaaaactccatctcaaaaaaaaaaaaaaacaaaaaattgtagccagagcatgttggctcatgcctgtaatcccagtgccttggcaggctgaggcaggaggatcatttcagcccaggaatttgagaccagcctgggcaacatagggagactccatctctacaaaaaaaaatttaaaaaattagccagacatggtggcacacatctgtagtcccagctactcgggacattgaggtgggaagattgcttgagcccagaaggtcgaggctgcagtgagccaagattccaccactgcattcttttttttatataaaaattagtttcatataaatttgttggttacttgtatttgttgcttttataaatttaagaaccttctgtgacagcaaggtttaaaggtcacacagttatatatgacatattttttattgttagcttttgtgtcactcagaagtaatctttttttttttttccagaaacgtatgtttgtgggatactcttgtagcacctgccaatagtttagtccatggtaagttttcaaagcattttataaattttgaaagtcaggaaattcataagctaaatattatttataagtggatttgttactgatgacacatatatttattaacccatgagatttcttttgcccaggatggcaggatttgaaagcaaaaagatgcaatatacgtaattaactcttcactataccttgatgggggacagtgagacatcgataatataaaaatcatttgtctttactttgaatctgatagccacaggttatcgttgtaaacatgatgtaaactcaatattatgtcccctcttaccactcctattcaacattgcactggaattcctagctaatgcagtaacacaataataggaaataaaatgtatataaatggaagggaagaaataaaactgtctttattcacagaaaacataattttctataaaatatcccaaagaatctacaaaataaattcacaagtatagcaaggtcccaggatacaaggtcaatatacagttgacccttgaacaacataaggattgggatgctgacccctgcacagatgaaaatcataattttttattccccccagaatttaactactaatagcctagtgtttactggataccttattattaatatagtcaattaacacatattttgtatatgtgttttataggaagctagaaaaaagaaaatgttatgaaaatcatgagtacatacagtagtgtactgtatttattgatattgtaaagtttatgtcatctgtttacaagatgaattttctgtctgaggccgggcgcagtggctcatgcctgtaatcccagcactttgggaggccaaggcgggtggatcacgaggtcaggagatctagacaatcctggctaacacggtgaaaccccatctctacttaaaataccaaaaaaaaattagccaggcgttgtggtggatgcctgtagtcctagctacttgggaggctgaggcaggagaatggtgtgaacccgggaggcggagcttgcagtgagctgagatggagccactgctctccagcctgggcgacagagcaagactccgtctcaaaaaaaaaaaaaaaaaaaagatgaattatctgtctgaaatggcaggcaactacagctgcagacctcaatttgtggtgcatatcaagcaattcaacttttttcttgtaatgtcttgactttggtctgctttttgggagcacttccagcattactagtggcatgttgtatggttcccatggtgttattcaaggtttacactgttgcactaaatacaatgaaaaattcacaagtgccacaggagatcacttttcactgcaatatacagtttactggagagaagacctgctcacatggagatgatgagcatcacacagcattttaagtatatactcgcaacacttgagctaactgcaatagcaacaggaggtggctactaaattataacagtagtacagtatgtactataattaattttatgtacttatgatttcatactgtatttttgtttacatttctcgactgtcgatggcaccacttacaatctgtatttgtgtgcgtatgtttcaataaatttaactttttgtaatttgtgtatattttatggtagtaaatgataaaatagactagtatctacatatgttttatgcattcatggcatactttttcttaattttttggatatttcttggctatgtgggttgtctgcaagttttttcaaattatctcaaatctttaaaaaatgttccaatatatctattgaataaaccacatctaagtggacccacacatttcaaaccagtgttgttgaagggtcagctgtactaaattcagttgctttttgatgcatcaacaatgaacaattgcaatttgaaatttaaagaatattaccatttacaatagcacccaaaacaatgaaatactgagacataaatctaacaaaatatgtacagggtgtgtatgcacaaaactataaaaatgatttaaatcaaagaagatctaaataaatgagtgatactccacattcacagattagaagacacaatattcttaagatgtcagttcgtcttgattttatagattcaacacaatcctaatcaaaattccagcatgctactttgcagatatcaacaaactgattctgaagtttatatgggaaagcaaaggaatagccaaccaaatactagagaaaaacacacttgtgggactcacattatactatctgatttcaacacttataagctacagtaatcaagacattgtggtattagcttaagaatatacatatagatcatagaacagaatggggagcccactaatagactcacatatatagtagacttatgtttaatatgtcacagaggcaattcagtggagaaacgatagtcttttcaacaaataatgccagaacaatttaatgtcaacatataaaaaattgaacccagatacagacctcacctttcataaaaattaactcaaaatggaccataaacctgcatgtaatatgcaaaataatagaacttctggaatgaactaattggatagaagtcagaatagtgattgcttttgttggggaggagaattgaccatgaaggggcatgaaggaacgttctgggatgatgaaaatattctgtaccttgatcttagtgatggttacacagatgtattcatttgtcagtgctcatcaaggtatatacttaaaaagtgtgcattttcctctgggaagttatatctcaaagtgctggtcaaagttccttctctgtaattaattttatttcaagtcttacaataataactaagtgtttagtttatgccatggactatacatgatctgcatatattaaatcctcaggcaaccctattaggtaggtgataatctcttttacaaatgatgaaactgagacttaggtaagtaattcagcagaagtacacatttaatcccacacagaaaccaggattgaaacccaggcaatctaactccagaatcctcactgttcattatgcaatattctccttgagctatatgcagatttttttccctaaaatttgttaggctggactcttttttaaagaaaaatagtatcatatttttatatttctcatactgctgtgtcttcaaattcatgaatcttttattttacaaggcttaatctgctgttaatcccatccagttccttttttatcttgagccttgctgtttttaatctgttaaattttgatttaggcctttcatgcctctaattaacttaaaattataatggacttttaatttccttacctactaattctgtcatctctattatttctgggttagtttcaattgatggatttttcttctccttatgggttatattttctgctttatcacattcctgttaatttattattagatggcaagcattgtgaattttacttcattaagtgcctattatttttgtattctgtaaatgttcttgagctttgctcagggacaacttacttggaaacagttgaatctgggggaccttggttaaacaggaccaaagcagcatttggtctagggctgattttcctccgctactgagtcaaatgcttctgagtactccaccgaggctggtacggaaccagttcaaccagggttcctctcctggtgccatggtcaggaaactctaagtagtaagctagggcagttttatgactcacccagtttgtttcccatctctcagagatcattcttcattaccttatatccagtgtctgaaatcattggtttttatatttcatttgattttttaattgtttcaggcaggattgcaaatctggtctattatttcactttagccaaaagccagaagtctatttcttttattgttaagtgtttttgttttttttttaatttactttcagcatttacctgccatgacagtggagccacagttttagcatatgctccaaaacatcagctactaatatcaggtggcagaaaaggttttacatatgtatttgacctttgtcaacgacaacagaggcagcttttccagagccatgattctcctgttaaagccgttgctgttgatccaactgaagagtactttgttacaggatctgccgaaggcaatataaaggtaaacacagttgatgccacaacatctacaaaatgaaatcttcagaaaccttagctctttaatcgtattgatgacatcaatctatttaaataatagttatattaattcctttgtagtcagcagtgctaattgctatttaatctttcaatgaatggaatatttaacttgaaaattttctatttttcagttgtttgaaaatatgtttaattcatactaaaacaccaaattttccatgaatataaacataattcagatattagaatttgtcttgactccatgttcagagttacataatttactgaatttaatttccaggggctgagaaatgtattgatattttcttttatcccacattgctcgccagtttttcatatatattattatctagtccctcagtgcctaattcaagaattctggataaaccttgcctttagcagtccttttcagagtccattgtgttgaaaacttaagacaggttttttcaaatgttaagcagcttgttaaaaatgttaaacagcttattaaatatgcaaattgctgggtctcactccagaaatactcagttgataagtaagtccaagactcagggatctgcattttaataacacacctagtaattttaatggagggtcttttggccctgtttggtaattggtaaatcagtttagactaatccctatgttattttaatggtcagcaaccctagactaggggggtttagtttcatcgaatttattaatttaagcacttacacttatttagtagaatcagatgggttttttaaaaccagcaaattgttttcataattctcaaccaggaaaagactagaattatggaatttttaaaagcctttttcttaaaatcaaatatatatataccaacagaattattttccttcagtttgaaactactttcttatttggactgactctctagtttagaatatgccatagttaagtcggttctttttttttttttttttgagacggagtcttactctgtcgccaggctggagcacagtggcacgatctcggctcactgcaacctccacctcccgggttcaagcgatttccctgcttcagcttccagagtagctgggactacaggcgtgcgccactacaccctgctaattttttgtgttttagtagagatggggtttcgccatgttggccaggatggtctcgatctcctgaccttgtgatccgcctgcctgcctctgcctcccaaagtgctgggattacagttgtgagccaccgcacctggcctagattggttctttagtttgtactttgatcctgtggtttattgtttaatcaaggttaaaaaaaaaaaagagttgaaaatatacaatgtattcagaagccctaatttaacaaattcatatgcagggtagtatgaattaatgaatttcttagagtaaagaaacgtttagaaaaatgatctccaataaaaccaggaaataagtaggtttcgctaaacctaaaatacatgtcctgaaagcatttacgttcttcccataagtaaagatgcgtataatttgctttacaggcacatttattttgataagggctggaaatacaaaatcttagtaaattaagtatcctgaaattgtaataattgactttgtcttatagttaaaatatagctttgcctggtcagagggcctctaggtgtcaagtacttccctctttctagctgttctgatccctggtgagcattcaataatgtaaagaagagattaccttactgtacacctatacggcaaaagctctgctgagagataggaaacgttgattttaatccctacagtattgtaagtttctgtagcattgtacacttaacctccttgttacctacattgtttctcttactctcttactagatggatttttaagtattttgtgttaaagcaattggtagattacaacactctatacagaatcaaggtgttatgatcctaggcctacacagatttttctctatttttgttttggaaattccttactgcacaggaatgcaggcctaaaatttttatttggtttcttttcttttccttttttttttttttttttttgagatggagtttcactcttgttgcccaggctggagcgcaatggtgtgatcttgggtcactacaaactccacctcccgggtcgaagcagttctcctgccccagcctcctgagtagctgggattacaggcatgtgccacctcgccgggctagttttgtatttttagtagagatggggtttctccttgttggtcaggctggtcttgaactccttaccttaggtggtctgcctgccttgacctcccaaagtgctgggattacaggcatgagccaccgcacctggcctcatttgatttcttaaggtcatcatcaaccctaattttccgtttgttcttaatatctttcagatttggagtctctctacctttggtcttctccatacttttgtcagtgaacatgctcggcagtccatttttagaaatattggaactggagtgatgcaaattgagacagggcctgcaaatcacattttctcctgtggagctgatggaacaatgaaaatgagaatactgccagatcagtttagccctttaaatgaagtgttgaaaaatgatgtgaaatttatgctataacatttttacaataagatgtacaatttattacctatatggaagtggccaacagatataatatacagtgatcattctctatgccacaaattagctaatgctttcttgtttttatatttattttatggagctttgcccttgatgcactgatgccttaaaaattaacaaggtcattcagaagtagattacattgcctaaagtagaatgtgtaagtaatgctgtaataatacatatcatagtatattataatcagtatgtcatagtgttaaaggtgttttgttttcttattgatacttttccacaggcatctctgcatgaatttcttccacagtaaaaatacgttttttgtaaaggcaattgtacataatactcatcacttaattcaccacactctcacttcctttattagccttatacatctcaaactcttctcttaattaatgataggtatttgagtaagaatgaaaaaaataatgaacatcttcattaaaattgtcattgagacgtcagtgataaatgagctagatggctcaatatgtaaggttttcagtagtttaccctccggaacccaagttgtatgtatgtatacgtgtgtgtgtgtgtgtgtgtgtgtatcttacacatcttatttgaacttagttgtatatattagcgaaaactggtttttcatgtgtttttgtgccataacaactattgccaccagaataactttttttttgcaactgtgcttttcatttttaaaaaatttttgaattcccatcctaattttcaaataagtttcaaggagactatcaggattattattttaaagattagatttagtcaaataagtcttagcaggcaataaagtttctgtggtggcatatatcatgtaagacacttaaagtaagtttgtgaatttgtcaactttcgagcatcaaacaaatattttacttaaattttattttatcttatttttaggtgcttttaatctcaaaattctgaaaagcgaatagcagtgttttcagaaacaaatgtgaaagcagtcaaattaagtagatactatttagaaatgtaaaatactctccagatctaccattaatagaaaataaactaaaccttatattttatttttgccaaaatattttattataaaatatgaccaaaatatttaaaatgcacaatgcttttaacttaaatgtgctaaccctgtttctgtctgttttgtgctgtaccttttctgattcagaattatagaaaacttgataaatacttgattttaaccaatgagactacaggcagatgggactaagtgtttatgggacaattatgtactatttaacttaaatatattttgtttaataggaaatatataataatagcattttatgtaataaaatatgggcaacgattatcttggaaattaaagagtcaaagcaaagaaatgaagggctggtaaaatgaattttgtaatatcctcaggatacttttatcttaaaagtatgttgttaaagattttgtaaattgtatttcaacaattttaaatgtgttgagcaagttgcagtgcaaacactgtcattatgtagagagtttatatgcacataataacctgtacctataaatcgtgcaataaccatatgcgactattttgccatggagaaatctgacagcattgcaaacaatagtattgtttgatgtagttaaccttaagttatttttcagtaatttcttcacaaatcaagattcaaacagctttaaacacttccaatgagataaaatatttactattatgcttattagaacaaaaggtgtttaaggatgaactaaatattttaattgagcatttatatggataatcatacattatgtaagcccatatgtatttacatccagagtcataatattttaaataaacaatcatgcagaaacttt

SEQ ID NO: 36485 - DNA, 328260 bp, Homo sapiens
gcggcccggtgcgggtgtcggggagaccgggctctctgcccggcgcggcgcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatggggtaagtttgtaatttttaaagaaactgttaatctttagctggtcattatgatttaattggtatagagagttatgagtaaactctactccgttcaaagaaaaaatacaataaaaaaacagacactagttattcaagattttccgctagtttttggtaaatattttcccaggagtagaattgtgctgctcaattgttgccttgatttaaggcctagctaatgtggaacttggctatgaagaacttatgtttttaggtcaacagtaagagattttaaatcaattctgtgatgggcaaaagtggattattggttacagttgcctaatacatggcactataatagtccttcatttgaaaggtatttattggtggaaacattcagactatggaaattattctcaaaataggaggagatattaaaatatctgtgtttgccttaggtcaacagaaagctgaaggtggtgatcagtgggttttatttcatctctacatagtacaaggaaaggaaactgctaaacatggactttccaaaaattatgtttgtaagattaaatgacatagtttaaaaatcttgtgatagtagttagagaatgtttgggggcagcttccacttgagagttagattttactcgaaagttaatttaaatctaaactggttaggtttttggcttcattcttctaaatatagatgtgatttagaagacctactgtagtggaatagatcaatgatgtgagcaaacgctccatgaccttcaagcttgaaggcttggctcaagttcttcagcgtctgctgttacatacagggcacattctaaggtccagaagttcactgttgcaataagcacgcatcgtcacccagatctgtctgtagtagtggtacgttggcttttgaaggattttggccaaatatgattttgtacctttggaatactaatcattttagtttgttcttatgctaagttcttatgctaaaatatctgttcccaagtaaaactttattttcctgaagtaaaagtcaagtgctgattgtgtctttttttttttttttttttggatttgaaatttattcaaagttagtttctcaggtaaaccactgatacaagaatgtctacacgtaataactttaattattcaatttgccagtataagaaggtttctagcaatgtgatgtcataaggtttaaaaaaatatgtaaatgtgaatagaataacttttcaaaacagactgccagactcatcctgggaatgtaagaaatctaaaccatctttcaagtaacttctcacttaagagtgagacaattttggctttggtactggttttgtgagtatacgtcttttatttgttgaataaagtattttgtaaagcatatgtagttttacatcccatgtttcacaaattgagaaattctgtagtgttaatttttttttttaagacttaaagggttttggtacttttagagttggaacttgagttcttaagttatggttccttaatgacactctagtctgtgatttttgtcatttagtattctttcctatctgcgaagctatgggagaactctatgtaccagtagtaaatataattttaaatgatttatgataaagagaaaactgtatcctccattgccttctgattattagagtttaggtaagtagttttatgttatgagatatttcgctgtattatcagaataatttatatatattttccattaaatatgttttcttggatgttgtttcttatatatgtataagaacacctcatttatgtatatttttatataagccaaatatcaaataagtatttggctgagtattatttttattagtatggaagtctggataaagagtaaaaagaaagttaagaatggaaaaggctgtcaggagttgcgtagtgagtagtggtatttgctgtctttaagttatttgagaatttaggttaagagtgccagtctatttaagaattgaaatagatcagatgttcttcatatgaattgataactgcattttggggaaatgtcctattttattttaattacttaacaatatgtgaaaatcagttaagactaagaatatttccaaattgtgaattgacctcagttcagtgttctaaacattattttttgggactctggtggaaatttacagggattgttgttggggttaaatttggtaatttagatttgccttaaatggtgtaattttaagtttaatttttaataattgaaaaaatattgtcttttatttaaatctttaaaagactatttgcaacaggaacgcagtattaataacacaagttgttacatatttgtgttcgttatttatattaatgaaagtgtcagctagatgctacttatctttatgctgatgatagattactcttaaagtacagtcagccaagattcttaccggctgtattcagcttcatttctatcaatttcattttattcctagttttagtccattttatttttatattggtacagttaatgttttgttcatagcagtatcaaaacaataagaaaactgacaattcaaagtcagatatgttgtttttctttgacagcctttcttgcttttggtgctgatggcttgagggaggaaataagtggaaagagaaagagaggattaagccaatgatcactagagcaagggaataaaagtgccttaagactatagatcacatttaaatttaataagatgtattatttttcatttatagtaaatagtatttgaaagactatgttttttgtctgcttagttttaagttgttgaaatgattatggtttgtatgtttgtgtatacagtaatagtcgatgtcagcataactctagaataaattacagtggagttgtagaagtaaaaataacttccacattgtaaactaatttgctagtaatgactgaattagtatatcattcgttaaatcggccaccccctactttgaaatgggaaattggaattttggggaattatttaccaatttacttaataaatgtaagataatattaatacaaaataaatatgcaaggctgtctgtacatggataactattttgatgctttttgaattttggactttgtaacatacagaaattatcactaaataactaattttatagcttattcagattttgtatatacatagaaaatagtctgtttaataaatttgtacctagagcatatcagcaggtactatgctttaagcttttctttttattagtatagttttaaagctgttcactttttttttatgacacgagtgttaattaagtgaggtgttgatggatatgtatcttttctaggacacttttgttcttcacatatgctgttcctcattgttagcttttcctgagtagaatttattaattaatcagtccgaattatcaaaatgttcacttaatacagatgattacatttattttatttaagttctcaactagaataatcagcaatattggttgggtacttgtttcctttatactagccacctaatattctattctaggaatgataatgagtaattacaattattttatctagtacaatgctggcacatggtagaagtgtgttcaatagatgtaatggctattattataacatttctgtttgtctctctctttttaagagaaattacacttagaggtagttgccagatgatactggttactggcattcatgatggaatagcataggagtgatgctgttgataaaattacatctaggaaaaattccctataaagtagagtgaacttaggtataatgaactagtgctgttaacccctaaagtctttgaaatacttgatgttcattagtaatttttttgtttttaggaacatcacccttttatattatgtattgatttattttagagacagggttgtattataattgtttttaggaacattactctttttattttatgtattgctttattttagagacagggttttgttagtctgttctcgcattgctataaagaactacctaagactgagtaatttatagagaaaagaggtttgattggctcacagttccgcaggctacaaggaggcatgcaggggaggcctcaggaaacttgcaatcatggtaaaaggcaaaggagaagccgaccccgtcctgcatggctggagtgggaggaagagagagaagggggagatgctacacgcttttaaacaaccagatcttgtgagaactcactcactatcacaacacaaaggggaagtctgcccccatgatccagtcacctcccgccaggtccctcctccaacactgggattacagtttgacatgagatttgggtgacggcacaaatccaaaccatgtcaagggtcttactgtgttacctaggctggtcttgaactcctgggctcaagagatcctcccacctcagcctcttaaagagctgggattacaggcatgcaccaccacacccagcttttttaaaaaaggaatgtattgcttcatgagtgaaaacaggatgtcaggattaacactttaggaattttagacatatatttattttatatggaaatgtaaggcataccttagtatagcagtatataaaaacaaatagtgcagtatgttggaaattttatgaaatgtcccataattcctaggacttgaatactattacacagtaagctcaggctattttaggataaaataatttagctcaaataaatattttattgtaccactcttttatggcagtcaaaaatttattctctgacctttttctcatttggtacatttattgacagtatgttacgtatgtagctcattgtttttctcctgctggttgtgataggttttaaaaccaattactaagtctaaccagcatttaaaaaaaattaaagactagaatagaaaatataaagtacatcaaatatagaaggaataagtattgttgtgcaaaacattgtgttttcctgtagtccttattcccatatttcttactataggttgagataaaaatagtttgaaatacttcagtgtaggtgcagctatgctatgttgactgttaaacagtgaaaatatagacagttcattttttcaaaaaggacacacgatagattagggacttactcaagaacctagtgaagggaaagagtgtaaggtatgggcaagatacagacttggaaatagatgggaagaggagacatgggggagggagaaaaagagaatgagtagggagagggagacagagaatgagaatgaatactgtgttcctgagttgctacttcagtctgacttgttgaatgatagggtattttttttttttatgattgggtatttttaatttaaaagaacttaatgggcaggggagttaatttcactcttgtatttctttcaatggtttattgtctcttcctttgtttttttccgtttctgagtttgggctaatgggcattgactttgattgattgtcagaggtatatacgtttttgagtttgagtgataaccatatgacctataaacaaaggtagtagtttcttggttttagcttctcatcacttcagctgaactctagggtagatgtaggtgaggatttgctagttctatcagattttttctcatcatttgttgctcaggaaactgccagttttaggtatcgaggaccaagaattgcttagctccttttgccctgtcttgatgagtcaagaagtctttgcataataattgttatgagagaccatcatggctcactacagcctcaacctcctgggctcaggatcctcctgtctcagcttaccaagtagctggagctacaagcatgtgccaccatgcccagctaattaaaaaatttttgtgtgtgtggagatggggggtctcattatgttgtcctgactggtctcaaactcctgccctcaagtgatccgcctgccttgggcttccaaagtgttggaattgcaagtgtgatcatctgcacttcgtgtgatttttgtttttgaattacccacactgtaagtatggattatcccagacacaagttttttgttgtatataaaaactccttggccgggtgcggtggtttacgcctgtaatcccagcactttgggaggccgaggtgggcggatcacgaggtcaggagattgagaccatcctggctaacatggtgaaaccgcgtctctactaaaaattcaaaaaaaaaaattagccgggcgcggtgacgggtgcctgtagtcccagctactcaggaggctgaggtgggagaatggcgtgaacccaggagtcagagcttgcagtgagccgagatcgcgccactgcactccagtctgggcgacagagcaagactctgtctcaaaaaaaaaaacaaaaaacaaaaaaaaaaactcctttccaaatctgggggacttccttttcttctccattaatggtgagtagaactccaggattattctttctagctagcttctacacacttccttcctatgactgccatctctttttctaatcagtacgtagggaatggctaatcttctattggctagtgtttctttatctatcactgtatgagagcagcactttagctttcatgttaacggggcacaaagacctggctccccctttccaatcccactgtttgcctttactcttcctcatggaactgtttgcttctcttttgggattagggcctcttcactctaacctccctccctagtttcaaagtgtgttctggaaatccatgggatatttaatagatgcttgagcaaggggaaaggtttatatgaataaatcagtttgggaaaagattttagacaacatttaatgttaaaaatacagcagattatcctagaatttatgaagtttatctgactatggaataggctttttttcagagcgtctggaggatggctggcaaccagtgtttcacagaatacgctttgggaaatgttcttccagtataaggtcatggttttccttgtaacttcctgagtagcagggttagaaagaaattttgagagaaatttgggatatcgtgtggattggagagagaatccaaatctgaataggttatattttacttagtggctgtgaacttcattttctgtgtgaaagtcatgtgcactgaaagataaatttaatcatggtgaaataacatgagtgatgctgttggtaaaattacatctaagaaaagcaccctaaaaagtagagtgaaatttgacatcataatgaaccactgctgtcaacccctaaagtccttgaaattactgagagatctcttaattatgaccttttcctgctctaattaagcttacttttctttatgtgtaggcatttacattaaatacagaaattgtcactttattttttacagctttcattactgtagatgttgcaaaactattgtctatctgaagagattacattcattactttgtgatttttaagaggaaaatatcatggactcatagttttaaaatcctgttacagtgttaagtattgttttttgcagtgtaacacattttggctaggccattggtttcagacttttggactagtgtgggaactttactactatttattacatccatgaagcgctgtgtttctagtgccagcaactatttatatatactgttaaggaaactagaaaatatatacttttattaaggagaaaacataattggtgctattttggcattgtgtgaacaattaaagctgtggttactattaacttttgttcagagtttttgggaggccagataataatcatagaggacaatctagtttcattgtttaaagacagacagcatataggggaataaaattagttttcttgcttatttttttttttttttttttggtagagatagggtctcactatgttgtccacgctggtcttgaactcctagcctcaagcaattctctgaccttggcctccccaaagtgctgggattacagatgtgagcagccgcacctggccttttttcttttttctgatttagatttatttttctctttaactcttcctcaccagtgccattcttcccactcctgatctaattatactgcaaagtactacttatatggatgaaaacaatcttttgaaaagattgtgaattatttcagtcatgtgcaatcatgtgttaactttcagttttatttcagattgcttaaacgtcactgtaggcttaatcaaagacaaaaacaccttctgtttaatttggtctattcatagtgataacacttaatccagtttccttagagtttccatggtgaatatctacaagtagaacacctaacctgaaatgtttctgttctaaaccaatatactggaaaagagcaaggggttttggattaagactgactgctttgattattaactgggtgatttagttatttaacctccctatgtctctttatgaaaaatggacataagactaatagtttatttttctaaaaagttaaaagttggtttaggattcttccttttctggtgatttatggttgtattttgtcagcttgcttcccattctgtttttttttttttttttttgagatacagtctcactgtgttgcccaggctggagtgcagtggcgtgatcttagctcactgcagcctctacctcccgaggtcaggcaattcttctgcctcagcctcccaaggagctgggactacaggtgcacgctgccatgcctggctaatttttttcttgtattttagtagacacaaggtttcaccatgttgcccaggttcatcttgaactcctgaactcaggcaatccaccgggctaggtctcccaaagtgctgggattttaggcatgagccaccatgcccgtcctcccattttgctttttaaaattttgataaaggaataattaaaatgccatttattggtaaataataactgaaatgcatagctatactaatataaggatgtaaataactattttactattaacatacatttgtatcttactgatagtattttattatattgggattgaagatgccaatatttctgtgtgactatgcaaaaaaatcttacaggataagctttttgcattggaacattttgttgttatataattattcttcagtaagtatcaagttaatgctcattcatccaccaacaacaacaaatatgagatgactaattacattttatttttatatttatatatctccaatctgcacatcagtggtagagttctggacctcaacgcagagggttaaaatcatcatgaaaaattattgatgtgttgttcatttaggactttttatgtattgaagattatgcagcacccgtaaatgtatttgtgacctgacagtacgacacaaacgtgtggtgtggtatgtagaaacttaatgtacactagtgtttcctaaattatatttctagagatataaatgaatattctgaaaattaagagttcagtggctgtgtaagattggaaaatagtgctttttgtatgcctctttggatattacaaagcacattatcatagaaaaagtttcaaaaagtttgctgtagaaaccatttaaactttgttttacctagaatttgcctgagtaatttaacattggaactccttatgaagaacagctgacagagtttgggaaatgctggtatatacttaaccgtaggtagtgtgagagcctttaaactggttgtgtgacagaaagtggttaataaagtcttctaacacataaattgtcacaatttatatcaatttccaaacaaaggcaaaggtttgaaggtttgcctttatcctttccatattttttagcgtatctgtttatgtcatctaagcaatattaagttggtgtggagttttgcatggggtgtatatatctttacaaagaaaggacagtgagacttgatacatgacttcgaggagtttatatgtgcacttcttggtttgcaaagatgcacctgctaagctagtgattttgtttttttccagtaaagctttattatgttctaatccagttacctctctaaccattggtacagaatttgggatcgatattgtcatggctgtgaaatagaacaatgctaattagattttatgaaagttttgtaaaagcagtatagttatcttgctacagcaagaatcccatccttaagtatcatcgtttacttagagtggctaatgcaatgccccaagttgactcagatactattaaaagcactcaagcatctacttagaagtggtatgccctgagatttaaaaaatacttgtttgaaaagattaggaaaagcccccgcaatgaaacagtgactaaagcccctttttgagattgtattgctagctacctgtgatctggccctgagctaaaagcataactaacaaacatttaacaacagactaagttcgggtatgtagtgaagctgacatatgatatcataaagcttttccatactctctacttatagagattctcctagagtttatggttaaaactacaataatattttcaggtctactgtagtatctgtttctgcctttttgttgcatgcgttcgtaatgtgttacccatttctgactaatacatgctaagttgacagtttcttctaagagtcctttgctgtgttatgttgcttgaggctgtgattaagtgtgatcatcatatttgtctcttttgcctatgtacctctggtaatcccagttaagtgtagtagctcatgagttctggttttattcaacctctgtgtgcatctggctcagttgacttctctgtattaaacatgtacaaatgggttacgttcctggatcttactgatcttattaatcatgtttgtttttccattaaatactaagcaataacaacttccttattacatgtacctctaacttgaaaatactgtgaattctacacatccaagacctttgtagaaggaagcaaaaaaaaaaaaaaaaaaccacttagaacatgatcctttgatcatgtcaacatcctgcttaatatacttcagtgactactgaaagctttcagaatgacatttgaactcctctttagcatgccatacagaatttttaatatgatcctgtttacttctctttttcttcactttatttatttatttagttttttgagatggagtctcgctctgtcacccaggctggagtgcaatggcacgatcttggctcactgcagcctccgccttctgggttcaagtgattctcccgcctcagcctcccgagtagctgggattataggcatccaccaccatgcctggccaatttttgtatttttagtagagatggggtttcactatgttggccaggctggtctcaaactcctgacctcgggttatccacccaccttggcctcccaaagtgctgagattacaggcgtgagccaccactcccggcagatgctatgatattttaatggctgaaaaagtggtgtcaaatttgatgatggtgatgaagaaaataattttcataatccttgaagtatatgaacttcgttgaaagagaataaagtcagcttaataagaatgacatctaaaggtatgagaggacctagtaatctttgaaagaccaaccttaagagacttctctgacagcaagaaaaatgaaagagtaaacaacaagaaatgaagacgaggtttcttgagacaacaaaccacaatgcagacattatacaaatgtgagttacttttatcctatccattttgggattaatgtaaagaataagagtaatctatacagagtaatggatttaagataaaaaaatgtttgcctcagcttcccaaagtgctgggattacaggcatgagccaccatgcctggctttttcttcacttaaaaaaattttgaaataatctcgagtttacagaaacattgcaagtatagtataatttttttcctctggaaccatttgagagtaagtagcctacctaatgctctgtcatccccatatattttctgcattcttctacctaaccacaatacaactattaaaatgaagaaattaacattggtgtatattgtcatctaatctttagggctgaattgtttaggaaggagaagggaatggccacttattatgtatgtatgtgtgtgtgtgcaattttatatttattttccactgtcatcttaaaaattatttaaagttctttaagaaatttacctatagtaaaattcacttattttggtgtgtatattgtgagttttaacaaatgtaaagtcatgtgaccactaccatagtcaaggtacagagcagttccatcatccctaaaattctcttgtgctattcttttgtcccacactcatcttttactccagctataaatgaatttgactcttttactaattaaaccataactttgattattcatgacttttcacatattggttaaattgtttggaaactcctctttcactgcaccccataggagacatttggtaatgtaggttgaatgaattatgccgttatacttgttatatgcagggctagaagcagtagctctaatcttgaaacattgtatgaaactcatatttttaatgccagggacttgtttcttctttgatttaccctattttatttcaaagtaattttttccttttaaaattatttaataattagaaatagtgataataaaaattcaaaagtggtttttgtgtttttctttttttgttttttttttgagatagaatcttgctttgttgcccaggctggagtgcagtggtgtgatctgggctcactgcaacctctacctcctgggtttaagcaattcttctgcctcagcctcctgagtagctgggactgcagacatgtgctactatgcctggctgatttttgtatttttttgtagagggggtatcgccatgttgaccaggctggcctggaactcctggcctcaagtgatgcgcccacctcggcttcccaaagtgccaggattaccggcgtgattacaggcgccaccacatgtggtcaaaagtgatttcttatatgagtagtcatttattatcccctagcagttggcaatttgtaaacaagtacttcatggtggtgaggtaaggagaagagggtgctgctatttaaaagaatgaggtaaaatgcagataatctcaaatttttcaaggtaaaagttcttagattaactctgcatttaactttatttgcacaatgtccatcataaactttagagtctggtgatgatggattgagcatacaaatataacttcatttccttctgcaattcactaacactataataaaataatttttttaaagagtcataaacctttaaggatgataagagtggtagaagagactatagaaacaaaattttggaagctgaaaagcaggtagatgagtggtaatgacttaggaggtctgagaaagtcagattccaaattagcagtggtgaaagctgaggacctgttcagtttacttggcagaatcttcagaagttttagaaattgctatctttaggaacctctggaagttgaggtatgggtagggctaaagtacagaggattgattgaggctggtttagaagcagtagaaactctagagcaattcccctgttgagtgccattgggttactttatccctctcctcaaacaaatgttggatgttcttagtacaacagaggttttctggattgggcaacataggcatagtttatggtggacatttcatattgaaaataaggagattaagtaaatttgtatttacttctgctcccagaatgctggcaactgggattaggacaggagattagaagattagaagagtcttgtctggagaatctgactctccccaagaagaaagaacttagagatgcagatatcagaggcttctcagtaaagggctcaggcagtcacactacagtgagatttgttatcagggggtttcacccaaggatttggagcttcacatcatgttttagttctcgtaattaaatatgaatggaaaatagaattgccagacatctgaggatcctcaaagcctctatagggtacagtcccaaacaaagaaagcaacccacatgaaacatacttttcagggaaagcataacttcgaaaaaaaaaaaaaacccaaaaaaaccaaatcacataaaactatcagtattttccagagatgagagaaaatcctgcaatcatgaagtcaggatgccataaaaaggagcaaaagagaatgaaaaaagttctttgaaattattatgatagctaaaatggaaacctcagtacaagattggaaagtagaaaagtggagcaaaaagccacagagagatagaaaagaggagatagaggagaaaattagaggaccaattgaggaggcctgaataataatctgatgaatgataggaattctaaaagagcactttgaaagaacagagggggaaaaaaatcatcaatacaagaaaatgttgtagaaccaaaggacacgagttcctagatagaaggggcctaccaagtacctaggtcagtggatgaaaatagattcgcatcaaggttcagaatcaatatattttgcaattcctaaaactctggggacaaacaagagaccccaaaaggttccaaagagtgtgaatacaaaggataagaatcagaaactctttggccttttcagcagcaactctagaagctagaagacagtgttcatattttgaaggaaaacagtttctaaactgaaattctatatccagacaaattcttaagtatgagggcgggataaggacatttttaggcatgaaggtgttaaaaattctgtaacctgtgggctacaaatggtttacttaggataaggagcttcccaggatgtgggacttctactaaaaccagcacagtcttaggcaaactggaatgagttgattgccttagctgcaactaggtaaaggagtgaatgaagatgaggaagtaacaggatataggaagcaggagatacaatgcaggagagagtagaaaggatttcctaagactgtaatgaagggagaatacaaaatgacaactttgcaccaagcatagaggtgaaccataacagacaggatgcagttcagaaggtttcaggacagacttaagtatctgatatggatgaacatcttgagaggagattagaaaatctggggagggtttaaggttgcttaggaaatgaagcaaatgagaaaacaataagaaaaatagaaattaggaaaggaaaagtaataacttatatggttatagtaatggaaacacttaatatttatctaactaaaattatgctgtaaccatattgggaggatggtatggaaagggaattttttttttggtggaagtgatagtaggtacggggcgtaatgtttttcctaaatcttaagtgatgattgaatgtgtatttatgaataactgataaaaatgaaaattttaaaaacagctgtagtttttacagaattaaaaagtctaaatccggctgggcacagtggctcatgcctgtaatcccagcattttgggaggccgaggtgggcagatcacgaggtcaagagattgagaccatcctagccaacatagtgaaaccctgtctgtactaaaaatacaaaaattagctgggcatggtggcacatgcctgtagtcccagctaccctggaggctgaggcaggagaatcgcttgaacccaggaggcagaggttgcagtaagccgagatcgcgccaccgcactctagcttggcgacagagtgagacttcgtctcaaaaaaaaaaaaaaaatgtctacatcctttactcctacttcactgatcttattttcaaacttgtgtttttctttttgaggtatttctaagtcctgtaatcgaggagctcaaaactggatagagggaatgggaaatttgtgttagaatttatgagtatattctttgagcagatcagtctttttcttcttcagttatttctctgttcttatgatggcaatttatagtctttgtcttaggagtttagttgattcctaaaaaacctatgtaggttaaattcgttagtgatacacagatacttctgtgaacacacagcaaaagaacactaacagagcagtgaagacaaatcacacaaatgatgtaaatgacgcaaaggatggatatgattattatttcttaaaactaaggagctgccaggtgctatgaggaggcatcagaatacgtgtcaactatacaactgcaaaggtagctttggtttagcagcgcttacccgctcttctgatgttcaagttgatacttgtaaatgcaaagaaatgccgtgtgtgcgtgtgtgtaaattctcatagcttttggagtacaagaggtttttggttacatggatgaattgtatagtggtgaagtccaagattttagtacactcgtcacctgagtactgtacattttacccaatatatagttttttatcccttaccccctttcttccttctcccttctgagtctccacctccattatactactctgtctgcctttgtgtacccatagcttagctcccacttataagtgagaacatacggtatttggttttccattcctgagttacttcacttagaataatggcctccagctccatccaagttgttgcaaaagacattattttgttctttttatggctgagtagtattccatggtatgtgtgtatatatataccatatattctttatccctacattggttgatgggcacttaggttggttccatatctttacaattgtgaattgtgttgcaataaacatatgtgtgcaggtgtgtttttgatgtaatgacttattttcctttgagtagatacccagcagtgggattgctggatcaaatggtagatatacttttagttctttaaaaaatctccatacagttttccatagaggttgtactaacttacgttcccagtagcagtctataagtgttcgcttttcaccacatccacagcaacatctgttgtttttgactttttaataatgagaggtgccttatattaaatgaaattcctcttgtaatgaatttcaacttctcctagagaaaatcccttgaaaatctaaagaactgaccagctcttccctacatgtctgttttagggcaaggttaagagaagtttgtttcaggggattgctgaactgtaggactctgagaaaactggtccgctttctaactactcctgagtcaggttttcagaggacgagaatgacgtctttatttactttaacattatgactctttacattcagatgcatattgaaaaacacaccccaaaagaaattattattgaattatgtaatactttgcttccttgtatgagaaatcattctgtttagtttgttgactacttctgttgctcaaggtcgtttttattttccagactgtgggtcatttattttgttcatgattgcatacctaaaaatttatcttgcattttatctaaagggaaaaacatcaaaatagtagcaaagccataaaaaatttacataataaatctgtaatcattttagtttctaaatttaatgtctttgctgagaatcaatagaatttaaagcagatattaatcagtgtatctagataacattatatatttacagcttaaaatagggttaggatgaaatatttatgacagtttagtatattttgttttcaattaggtgtattactaaaaaacatgtaaaccattccatttaaaaaaagaagtaaaaggagatgatgtaatataactagtatttggaaatgacaaaggaattttccctccagctgtagaagtatttcctttgcaacagtgtttctcatttatgtttcagttctcagatatacaaagatgattgctgtgagagggcattagttttttaacagacaattaaattcagtttttgaaaaccctaattgtttagtgttcgtcaaccctaagaatttttacataaagctgcttaaatattagttaaaaagtcaagtttcattttctttccaaaattctctgcacatggctcaaactgtatttgagtctgaatttcttttgaaaatccagtaagctttatgaagaaatgccaagaaaatgtttagttcaaatttactcttctttcatagaatgactttcactttaactgtttcacttgatttctatttatgctactctacagctgtccatttgtgaaagttaccagcctctagaatgtaaagagctatatatgattctattctagcatattgaggtgaagttatagatgagcagtgtgttttgttcagcttagttttgattaattttccttttttatggatattgaattatctttataattcagtgaaaaggcagtgtttgagatatttcatgtgctttcttctctgtaaagttctcagtttttgtcactgaaacctataagccactgagcggctgctgtctgtatctgcttatgccagatagtccttggctttcatttgccagaatgcagcaagctttttgttatatagcttcaaatggcttttttccttaaaagaagcatgtttttgctggagaagtatgaatctatattaacagttgattataaaggacaaaactctgggacagccaaatggaagtgatgcgtagggcaaggtttagggtaagggagtagagggggaggatttccatgccctccttaattttcttctgagtttttaggttatagcaccaacatactaatgacactagcttgtttatatacatgtttagccaaattatgaaaagtaaaagaaactatttacctgaggatattattacaaaaaaaatgcctcaagttgagtaagggcaattataatagtggttgaatttctggtactattttgtcataatttcacttgttattttttatgtgtttgtgtatatttcttggatgtgctttaactgttgcttgtcttcagtaccttggcaatatatatgaatttggaattgtggcacgactctggggagggaggtattctggaaaatgccatatgtgtgaaatttttacctactacactgagaaagagagattttttttgagacagataaaaaaaaacattgtatatagtcacactgctttttctcagtctgctttcttttggtgtatgtatatatttatgtatgtatatattatgtatatatatgtatatatatgtatatatgtgtgtgtgtgtgtatatgtatatatacacacacacacacataaaacaaaatttgccattttagcccctttaaagtgtattatttggtggtgtcaattacatttcaaaatgtataacatcaccactatttcaaaaaccttttcatcacctcaagcagaagctctgtatccattaaccaacaactctacattctctcctttccccagtttgtggtaacttctgatctactttctgtctctctgaatttctacatattgtagatattttgtataagtggaatcatttaatattattttgtgtctggcatatttcatttagcatgctattcgtaaggttcattcatgtggcattatgtgtcagaacttcattcctgtttatggctgaataatattccattgtatggctataccacattctgtttatctgttcatttgttgatggatacttgcgttgtttccaccttttggttattatgaataatgctgcagtgaacattggcatacaagtatctgtttgagtccctatttttaactcttttgcatatatgcttaggagtgatatttctgggtcatatagtaattctatgtttaactttttgaggaactgccaaactgtttttcaaagcagtggtaccgtcatacattcccaccagcaatgtatgaaggttgagttttgctacatgcttgctaacatttggtactttctgttttttgattagtcattttagtaggtatgaagtggtaggtggttcattgtggctttgatctacttccttaataattactgataacgagcagcttttcatgtgcttattggcaatttgtatatcttctttggagaaatgtctgattaaccctttgcccactttaaaagatagactatttttagaaaagttttaggttcacagtgaaattgagcagaaggtatagaaatttcttagatttccagcctccccatatgcatagtctcgcctattctttgtctatttaaaaattgcatttatcttttgttgttagagttcttcatacattctggatattctttgtcatgtatattatttacacatattttctcccattctgtaggttgctttttcactttcttgataatgtgcattaatgatatacaagtttttcattttgatgaaatccaatttgtccctttttttttttcttgtgcttttggtgtgatatttaagaacccattgccaaatccaatgtcatattggtttaccctttgcttttttccaaaagtttttttttttttttttttgatgtggggagagtctctctctgtttcccaggctggagtgcagtggcacaatgtcggctctctgcatcctccgcctcctgagttcaagcgattttcctgcttcagcctcccaagtagctgggattacaggcatgtgacaccatgcccagctaatttttgtatttttagtagatgcggggtttcaccattatggccaggctggtctcgaactcctgacctcaagtgatctgcccacctcggcctcccaaagtgctgggattacaagtgtgagccactatgcccggcctatttttttcccaaaagttttgtgtttcacttcttatatttgttatgaatccattttgagttaatttttatatatgatttgaagtaggtatccaacttcattcttttccatgtggaaattccaattgttccagatttgccatatagaaaagagattattctttctgtattgaatggactcagcatcgttgtggaagatcaactggccttagatgtttggatttttttctagactctcagttctattccattgatctatatgtttatccttctgccagtaccatacagcctggattgctatagttttgtagtaagttttgaaattgaaaagggtaagtcctctaaactgtttttccaggttattttggcttttctgggctccttgcagttccatattgtgatgattggcttttccatttctgcagaaaaggctgttggaattttgttagggctcttctttattaacaaaacccgattgactgtgttttctagctttatttccagttaggtgtggtcacgtcagtagttctggctgattgatgtacaaagtgatgtgtgatgcttaccagaagcttcattaaaaggaaggctttccccactttattcccgtctgctgcacagaacacatgtgatgttttcagagcttggactgtgatgatgagggcatgagggccatactccaaggatggcccagcagtgagctggaagcatcctggattcctgacagctttgtgaaactgccataccagcattggaccttcaaatgtcttttacttgaaaggaaaatatattttcattttgtttaaattggggttgagttttttgttagagctaaacttaatttatacacttttcctactacattaacttggttatctcttcattgtgtgtactgtgtgagggagtgagataatatattaccagaattgctggaactatacttaatttaaattttttttaatttcatgctgggcatggtgtttcatgcctgtaatcccagcactttgagaggctgaggtgggtggatcacttgaacctaggagtttgagaccagccgggcaacatggtgaaaccccatctctacaaaaatacaaaaattagccagatgtggtggtgtgcgtctatagtcccagttgctctggaggctaaggtgggaggatcgcttgagcctgggcagtgtaggttgtaataagctgagatcacaccactgtaccctagcctgggtgagaacctgtatcaaaaagaaaaaattatatttcatatatatgtattgtgaatttgactttaaaattatttttccttagtatgtaatactaaaacgttctttaacttaaatgtagcctcaacatttttttaaaaagcagaaaaaaattttcactgctgtaacatagcagatttgtcatttttgtgctaacccgttgaatattttttatatacatacttagttttctacataggaacatttctggtatttttataccttgcttttttttttcacttaatgtgataaagtgatctagtgcaagttaattaacctctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccaattaacctctttttgcttcagtttctttctctctgaaaatgggaatagttattacacatgcttcgtggggttgttttgagcattaaataaaatattggagtaaaatgctagaccagtgcccaacatgtagtgaattcctggccctcaatgaatgttagttatcattaccattattaatatcgtgtgatcttaagctcttcttctatattattgtaaaatcttgataattacgctcttcaaagtctgcttattatttcattaaataaatacacagttatttattagatactaaatttttttttttttgagatgaagtctagctcagtcgcccaggctggagtgcagtggcgcgatctcagctcactgcaagctctgcctcccgggttcatgccattctcccgcctcagcctcccgagtagctgggactacaggtgcctgccaccacgcccagctaatttttttgtatttttagtagagacggggtttcactgtgttagccaggatggtcttgatcttctgaccttgtgatccacccgcctcagcctcccaaagtgctgggattacaggtgtgagccaccgtgcctggcctaaaatttttttaaacatttaatttacttccatttatttggtgttacaaataatgctattataaactgatctatgattaaatgtcattttattacaagctagagacacttttaaaagcagcatttatcccttattttataaggtagtgaagaaaatgtgaaatagattttgtttttctaaggcggagttttgttcttgttgcccaggctggagtgcaatggcgccatctcggctcactgcaacctccacctcccaggttcaggcgattcttctgcctcaggccaacctcccgagtagccaccatgcccggctgattttgtatttttagtagagatggggtttctccatattggttaggctggtctcaaactcccgacctcaggtgatccgtccacctaggcctccccaaagtgctgggattacaggcgtgagccactgcacccagcaatagatctttttttttttttttaatgactttaccatagtagctttgtatatgaatctgatggcaattgggatgtagatatcttttgcaataaataataatagtcacagattgtataaccagttctcataacacattataagttctgtaagcttgaggatttagtttggtttaattctctttttgtggtaatttttagaaactgtaaacatttaagtgttaaaaggtgattaagaatatgccatagtcactattttctggcatttatcactgtttttaattatatatatttgcaattatttgattattattgatcttccttactagagcagggactgtgtctgttttgcttaccagctcttccccaatacctaacataagtgcttggtgtattgtaggcactcaataaatatttatttgattaatgaaagaattggtgagtgaacaacggagttaagcaaataaatagggaataaaatgttttgatacagttaaatctcaacattgagtcagtagctatgatgaagaaataacatctaaaactccaactttagatacaattttgcagagatttggggggaatatagtaaaatataacaaggagggcaatttagagatgaagtatttaactctagggttttggttttgtttgaatgatagtggaaacatccaggtagaatgttcaggagagagaaatatgggccaaaggtcaaagggtagtcattcaaataatgacagtaattaagttcaataaattattgaatgtctaccttgtgctagctattgtatagttgtggaaggtaggtgagtaagacatattcctcataataataattcaattaaaatacctcttaccctgataattctcttcacaagtaaagttttaacaaagttagaattttgattttagaatttagtggaaagcaatgattatgaccaaattatcttaataccttgttgaattttcactgtatcttctaagtgataaagatgattttaattcagtgaactttgtagttgagacttttgttaataaaatatttttaaaaagttttactgccattctgtgtagaaataattggagcaagatttttaaaaataatcattatgatacctatcttttatctttctgtggaaaaaatatggaaacgcttatgtctctagaggtaaatatttagtgaaatgtggttttcatttgaaattaaaattaatcatttttgatttcatattttttctttaacactatgatactttaaaaattattggctgggcttggtggctcacgcctgtaatcccagcactttgggaggccaagacaggcggatcactaggtcaggagtttgagaccagcccggccaatatggtgacaccccatctctactaagaatacaaaaataagccgggcatggtggcgtgtgcctgtagtcccagctactcgggaggctgaggcagaagaatcacttgaacctgggaggcagaagttgaaatgagccgagatcgcaccactgcactccagcctgggcaacagagcgagactccgtctgaaaaaaaaaaaaattatctgttatagacctcagggctatttgttatttttaaattgtctttaaaatgaacttgaattttgtgaacattgtactttatttattgaatttatgattctgtagaagaaacaggtcaatttctggtggtacatgtcttaacttcagtattggaataaaaaaagtttaaatgatagtacagtaataagaggtagctgattacacaatacaaatgttgagggttaatagtgtgcttttggttggaacagaaaacctgatgcaaactggtttgaagaatatggaaagttttactagttaacctatcaagagcaaaagtggggtagacttcttggtttagtggctctatagtattatcaaatatccaaagtctttcagtctcactgttgttgtagtatagatttgggtgttttttttgtttgtttttgtttttaatttttgagacagagtctcactctgtcacccaggctggaatgcagtggtgtgactttggctcactacaacctccgcctcctggattcaagcgattctcctgcctcagcctcctgagtagctgggatgacaggcgcgtgccaccatgcctgggtaatttttgtatttttagtagagacggggtttcaccatgttagacaggctggttttgaactcctgacctcaagtgatccgcctgcttcggcctcccaaactgctgggattacaggcatgagccaccgcgcccagcctagacttcttttttaacactgttttccctcagggttatcagatggcaccggagcaacatgattttttgttcaggtggggaggagggaggaaggctacctgtagccctcttatttcatggaagcacctagaaagtcttccctccattctcaatgaccaaaattaggtctcctctctattcctgaaccaatataattggtattggtgccaataagattattgaggtatatgggctgtgtatgggaagtgcagtgatcttaacaaagttaggattctgtttaggaagacggaatggattctgtctagacaacaaacagtctcccctatagttggcattgtggcctacagtttatttgtatcattttcgaaaggaatttttagtgctatagtaaagctttatgctatactttgtgtttccccttcccaccccaccacctgtaactaacaccttccctaataatgtgtttttgatttagggattctgggccagtgttactgtgtgtaagagaggaaaggatgcattatagatatgtataattaaattttaattttaaaattataaatagtcattaaaatgatacctttctcagccatgccatcctttgttggcatatccctcctctgaatgcctataaaatttgtttatagtgctcatttggaaaccaatatgaatcttggattatttattgtctttttatgtatgtcataccaggatcatttcttgtatatctaggacaaataaattctattatatctgtgttactggtatctgcagaaggtgtcattaagagaagatttaaagtcaattcaataaattttttaaatgtacagtaaagtattatgtctataatggagtgtagcagcaatgaagatgaacaacatgtggttccttccctaaaggaattaaacagaattaaatgtaataaagggggcagtagagagagattactttggtgtggggagtagaaaggctcaatcatggaagtgacattttgagcttactcttaaggaattaatgttttgtgaaacagagaaaagggggcattttagatggaaaggaagctcaaaggcatgtgcttggagcatagtacttgggtgcagttgaggcatagtgggaaataaagttgaaatggtggattggggccatttcagaaggcttactacttaatttgaatttgactctatggacagtgggaagccattgaatatatatatttgtttttatttttagaggtagagtcttgctgtcactcacccaagctagagtgtagtgttgcagtcatagctcactgcagctttaaacttctgggctcaagtgagcctcccagtagctgggactataggtgcacaccaccatgcctagcttttttttttttttttgtagagacagggtctcaccatgttgcccaggctggtctggaactcctagccctagtagtcttcccactttggcatcccatgtatttctttttaaagcaagaagacttggaaattattttccgccgaaacataagtacccttaagatttgttgttttttgccatgatacagtgtttgtggagtacacacattaattcatttattttaacagatatttattgcatacctcctatgtgacagacataaaaatctggagatacaacagtgaacgagacaggcagggtttctgctctcatggagcttacattataatttggggggaggtcaggaaatagacatgtaaataagattatttcagataatggtaagagctataaagaaaataagaggatgctgtgacagagtgttttgggtggtaatttagatgagttggttagtgaagacctctgaggatttgatgtttgaactgatgttaaatgagaaggtgccagccatgtgactatcttgggtaagagcaccctaggtagagggaacagtaagtgctgggtccttaagatggaaaaaggaacagaaggaagaccagtgtggctggattagagtgagtgaaggggagagtggtagggtatgaggtttctcctggaaaggagtttatattttcctctaagggttaaagccagtgcagagttttgagcagaagggtgatatctagatttatgctttaaaagggtaactgtggttgtcatgtgaataaaatcatgccagttaggacctttgtagcagtacacgtgagagagagagtagtgccttgaagttgggctgtagtaggggagatggagatttgtgatatcattttatttaatttttttattttgaattattattattattatttttgaaacaagagttttgctctttttgcccaggctggagtacaatgacatgatctctccccactgcagcctccacctctggggttcaagtgattctcctgcctcagcctcccaaatagctgggattacaggcacctgccaccacacctggccaattttgtatttttagtagagacggggtttcaccacgttggccaggctggtctcgaactcctgacctcaggtgatctgcccgcctcagccttccaaagtgttgggattgcaggcatgagccaccacacctggccttaaaaattttttttttgagaccgagtcttggtctgtcacccaggctggagtgaaatggtgcagtcttggctcactgcaacccccgcctcccgggttcaagcaattctcctgcctcagcctccccaatagctgggaccacaggtgtgcaccacgcccggctaatttttgtatttttagtagagatggggttttgccatgttggctaggctggtcttgaactcccggccttaaggaatccacttgccttggcctcccaaagttctaggtttacaggcatgagccactgcacctggccgatatcattttaattttaagatttttcatttttttattttttgaggcaggatctccctctgttgcccaggctggagtatagtggcacgatcacagctcactgcagcttagacctcctgggctcaagtgatcctcccacctctgcctcccattcacttctgattgcttttattatttcatgaagttgataaaatgtaatcagctgaggatattgggaaataatgggtgattagacatttagtgagagaagagaagatttgtgtatgtttgggatcccacagaccatccccatgttaggtgctttactaggaggactgatgggacaagcatgtaatgatactcatagattaatgtttattacagtgaaaagctacaaagcaaaatcaacaaagggaaaaggctaatggagcaaagccggaggaaaccaagcacatacttccaaggatcctctcccattggaatcatacaggatgtgtttaatcccctcagtaatgaattttaatgtatagtgtgaagtattgtctgccagagaaactcattgccctacagttttgaatagctagaaggacgatgttgaacattaccaacacaaataaatgataaacgtttgagatgatggatattgtaattaccctgatctgatcaccatacgtcttatgtattgaaacatcactgtgtactccatgaatatgtataattatttgtcaattaaaaaccctgggcactgagtttatttttttattggtggctagtcacgtaggaaccctctgcctagcctctgcctagcacatactgaaattcaacaaggttgaagattcaacaaggtattaagtaatttggtcataatcatattgctttccattgaattctaaaatcaaaattctaactttgttaaaactttacttgtgaagagaattatcagggtaagaggtattttaattgaattattaatattaattgaattattatcattccttctggacttccagaaggatagtagattttcagcataaattatattatttgcagaaatagttcaggtacagtgagccattcttaccagttaggattgtgagaacactcccaaaatctaagttcccagatgccagccatagaccaaccttgcaaataggccttgctaagaaatagcagtctcaggtctgtgatgtaactcttttccgcacaatacgaaacagtacttttggagcattggagagagaccatcctaggagagagtattgagattgtcaggaatgtgtgttcatgtaaaatgtgtgatgatgacttttatcagcaagcattgatgtagtttggaagtttttccccaccaaatctcatgttgaaatgtgacccccaatgttgaaggtggggtctagtgggagatatttgggttatggagacagattttcatgaatggcttggtgtccttcctgtggttaatgtgtgagttctcactgtgtttgttctcccaatatctgattgttaaaaagagcctgatacctccccactccccattgctcccgctcttgccacgtgacatgccagcttcttttctccatctaaaaccgcaattacttttgcatcaacctaatactatgaatgaaagcttcttgaagccctcaccataaacagatgctggtgccatgcttttttgtacagcttgcagaactgtgagccaaaataaatctctttgtaaattacccagccattcagatattcctttatagcagttcaaaatggactaatacactaatacagaaaattggtaccgggagtggaatgttgctataaagataactgaaaatgtggaagtggctttggaactggataacgtacggaggttggaagagtttggagggctaagaagatgataggaagacagggcaagtttggaacttactaaagactgattaagtggctctgataaaaatgctgatagaagaatggacaacaaagcccaagctgacgaggaatttactgggaactctggagcaaagttcacccttgttacaccttagcaaagaacttgactgcattgtgtccatgttctaggactttgtgaaaggctgatcttaagagtgatgacctagactaactggcagaagaaatttctaagcaccaaagcattcgagaatgatatgactgcttctaacagcctgtgatcaaatatgggagcaaatgaatgacttaaagttggagcttataataaaaagggaaacagcataaaattttggaaaaatctcagtctggtgcagtagtaaagaaggaagaagtgttttcaggagaggaatccaagggggctgtggagcaaccacttgctagagagagtagcatgatgaaaaggtaggtaagtgccgatattaagacagtgggaaaaaggccctgaaggcatttcagaaatcttccaggctgtccttcccattataggctcagaggcttaggaggacagaatggtttcaaggggccaggcctagggcttcaactgccttgtgccgactcaggatgctgttcttctctctgactccagctggattaataaaagcatgattgtgattttttttttctttacctatatccaagtactcaggagtaggcagagttacagttttaactagggtttgctgacataatttgaattgttcagaaatgaggtggctcctttttttacactagcgtgagacagagaaacaggtggagattttgtggattttattctcattcgataatcccatggtaaaccctaaatgatcctctttctagtgacaggaccatctaggactcacagaggatacaatttgtatggaataacctgtcaagataagcagagtatcagatactgacagtccttcattgtgacctcttatgggacgccattacctggcttggttttggcctagtaatttcctggctagatggatggaatttgggtctgttatttcaggggcatatggatagaaccaataatgtaaatttttgtttgcttttcataggcaatttgtggttattaaataattacgtaagatgtaaagtcctcagaagaagtggtgcttaacttgatatatgcatccaaataacttagtggctttttcaaaaaatatatgattgctactcacttctagagattatgactcagttaactcaggatggaagtcagtgtatgtgagtttttaaaatgcttccctgttaattccaatgtgttcttctgattaagaatcatagttccagaccatttaatgttagcttagtccttttataagttttggactctccattaatgaaactgtgtagatagtttgtattgctacctgttttgcacaagaaacaagaattttgtcaggtggggtgtgtgtctggctgggtagactggagaacgttggaccatgtttctctatccagaggtatgtaccagagaatgctttgatccagaacaaaggggattatttttttttttttgtgagatggggtctcactctgtcacccagtgacagattgcagtggcacaaccttgggtaactgcagccttctcctcctggaatcaagcgatcttcccacctcagcctcctgagtagctgtgatgacagacgtgtaccatcatgcccggctaattttttctattttgggtagagacagggttttgccatgttgcccaggctggtctcgaagtcctgagctcaagtgatccacccaccttggcctcccaacatgctgggattacagatgtaattaatcctggcctagaacaaagtggatttctaacagttaggggaacttgggtttccagcaagagaaaaatgcaatcaaatgttgctctgaagtttgggcttagggaccaacttagtatttctttaggaatcatagattaagaaaatgtgtacattctctccagtgctattagtattaaggttaggccctctcctggggatggtggtgggtagaatacttgataatcacctgctgggcctcagatttaaagcttacggacttacatgtggttcactggaaaaccaaccagtatttataacataatctttgagataatgtattccaaattccaaagtagttatttgtaactaaatttctagattatgactagttcataagttgtgaattgctttaagttcagcttttcatttcaaggagaataaaatataaaaaattaaatcattactttttaggaaatgcaaattcttatatttttagttataaaatatcaaaatatcctatttaatactcatcaaaccataccatcatgacatttgatgtgtcaagacaaagcattaatagaagatagtttatggtttattcattagttatttaaaacaatctagtaaagcacttaattaaaaagtatatatattttttgagatatagtctgtgttgcccagactggagtgcagtggtgtgatcttgtctcactgcagcccactccacctcttgggttcaagcagttcttgtgccccagcctcccgagtgctgggattacagtcatgcgccaccatgcccagctaatttgggcaaaatcccggccaacatggcaaaatcccatctcaaactcctggcctcaagtgaactgcctgccctggcctcccaaagtgctgagattacaggcgtgagccaccatgcctggcctaataaagcattaacaaaaaatttagatgcaagggtacatatgcttatttattacatggatattacatgcataatggtggggggttgggcttccgtactcatcacccaaatactgggcattgtatccattggtaatttttccaccctccgtacttctgtcctctttcctttggagtctcgagtttttttcctccatttttatctccatatgtaccctttgtttagctcccacttataaagcattttgaaaataaatataattatagcataaacattttcattacaaatagaatcttcctacctggttttcatttgctttttctatttttaggtggagagagtagtaaatgattatgataaaattttataaactattagtaaatattatcatagtattttcataggatatgaagagtaagcctgccatttttttggtgggtcaatacttttcactcatttatatttctctcgtttatgtgtatatagaaagcttatataaaactttctgtagcatttaatagcaacagatttataaatgtttgcttacaaaaatatgtacaaaaagtacaaatgagactatatgtacttttccaggaacatactgttgtatcaatatgtgtattttaagtcatggtccttagagtagtgatgttctgccactaaaatagaataatagaaatctttaatttttaggaaagattaagtcaatgggtagaattttctcaatttaaagtttttcatcccatgaattataaaaagttatttaaaaaattgtgttaaaatatatataacataaaatttactattttaaatcttttttaagtgtatagttcagtgacatcaagtacatacacattgttgtgcaaccatcctgatcatccatctcagaacattttgtgttttgctaaactgaaactgtactcattaaaaatgactttactcccactttccataccttgccctctggctactgtcattctacttcttgtctatgaatttgactactcttaagtacctcatgagtagaatcataacagtatttgtccttttttgactagcttatttcactggttctgcacttgaataaatgtaagaaccactagcaaagagtaaggtagagctgtgcttctttgctgtttgtgttttacctgctcctaagcaaacagtattactgttttaaatacttgaaaaattatttatctgcatttaaaaaataacatattaatcaagatcttagataactgccggtaataccagagagcctgttgctgctgcagtgtgtgctagaggaattctgctgtctttttgacttagctgctatcacagtcctcacatcccacatgtgtaacagtaaacactggaagttattttattttctatgcagacattttagagtattatataaacaaccgcttaattaattttggtttaaactcctaggaagtgatgaaatcacattttaacaggactgaataggaaccataaaataatttttaggtaatctctgttctcaccctaagaatattaattctgccattctaggtaatgtttactctaattcacttaaaatttttcttttcccttttttttttttttttttgagacggagttttgcttttgttgcccaggctggagtgcaatggcgcaatctcgactcaccacaacctctgcctcccgggttcaagtgattctcctgcctcagctcccaagtagctgggattacaggcatgtgtcaccacgcccggctaattttgtatttttagtagagacggggtttctccatgttggtcaggctggtcgcgaactcccgacctcaagtgatccacccgcctcagcctcccaaagtgctgggattacaggcgtgagccaacatgcctggcttctcttccttttaattattagaactcttttttcctgattgactgctctggttttacccagagccaggtaggttttccccttcccattttgttattaagggacatgtgcagaggttcaggactcctgagtctttgggcagtgctgatctcactcctctgctcagcctcatgctttgtcttaaaacttaattgtctgagttggagcacttgcaaaagctctaactcaggctagtggttgggagggttctcagagacttaattgctgcctggtgctcagggcctccaggtcccactacctctggctcagtacaggcatggggaaccagccacaggagactgaccagctggagactggcaagcgtgggggctctgagctgcttccaggggccctgggacaactgcttttgagggcctcatgtctactggaccatgggatccaagagaagagcccttgcctgaaatcacaggacctggaatggggctggcagttgtacaggttggagaactgggcctggtaatccctttaggagctgtgctctgaggagctttggagtttccctggcatgtctggggtgagagtgggggaaaaaagtgactctgagggttagggcaatgacctactcacaccccacctggttttgtgtaaaaccagagcagccaatcacgagaaagcgttctaatgattgattaaaaggactgcctttttctttctttaaaccacagcaataaagggttttgctaggctaactttctcagtttggcttggcctagattttcacatggctcagtattctccacattcacatgggccatggtgtttgtggaagtgaaggattggaatttgggagaatgtggtgaggagagagacagctgacttggtgcagtatctgggctatggaacaggcactgcataactgctgatggagtcttggctaccagtagcagccggtctatcccagagaggcagaggccctgagaggcagttctgaccccctgagctgttgtgctgggatccctggcttggcatgcttaccttagaagagaagcaggctaagaaactgatctctgtctcagctaaaacaatccttcttgcatactgcagacgatccctattaggaaacagaacttccagaatgcagtccatttgtaagtttttatcattcatttataccggagagtcaattaagatcagattttttttgttaaaatataaattggcaattttagtttttaaaagatctactaaagctcaggagataatttagtgtaatagtcttcaaactgtggtatctgtatccttggtgcgtgaagactttccaagggatatgcggatgcatatagttttaagggaatcaattttcaggtctttagctttcctaattagtcttctaaaatccatctgtttgagaacagtctgaactctgtggattttctttccactcccatttcacaatgaaccatctcccatttttataaaataaaggcatatttctcacccatctcatatgttcccatggtactgtcttgtgttgtgaagatctcttaggtgtaaaacaaaagggactgtttgagaatgtgttgctcttgaaagagggcaaaagaaaaagagcttctataaaaagtattgaagcaggtattttatttcactagcttacaaaccagtggcaaaattcttatccgtcttctttcagagaactctgaagcaaaatggttgataccaggctatgtaataacacattcatttgaattaaaaattaaagtcagacttattctaatagaaaataagtctttttttatacaaggttttaattccatttagtacagtactttgtatctttttttcttttttttgagatggagtcttgctctgtggcccaggctggattacagtggcacaatctcggttcactgcaacctccacctcccaggttcaagttattctcctgcctcagccttccaggtagctgggattacaggcacacaccaccacatccggctaattttttgtatttttattagagatggggtttcaccatgttggccaggctgatcttgaactcctaacctcaagtgatctgcccaccttggcttcccaaagtgctgggattacaagtgtgagccaccgttcccggccttagtacagtatgttaaattttgtgtgtgtgtgaatcaaattattttcaagtctgcaaaaaactgtatctccacaaagaggcttaaattgctgacaaatttctggggtgataaggcagcatatttaattaaataaaagtaatgtctccaaatataaagccttcagttaaatatatcttttggaattacaaagaattaaaccacttaatttataatataaattatattactttaatatgtgaagtaagaaaatgatagttaaatatctcaactttaattttctggtatggtcagacctttacagatatttccatgctattttaactttaggatataaaacagtagcagtctactaagttttctattattaaaattagtatagaaattatcaaaatactgaaaaaactgttttatgaaagcagtacctccatcactgtaacttatttcctttcttttagaatacatcttcaaaagagaccagaatttatttaaagatagtagtttgaattttaaatttccagtcaatttttcattatctcaaaattgagctaatgaagagttgatggagttaggagaacacaggtttccaactaatgccatcaaggcagcaggatcctcacatccatgaagaccaaaagaaagatgtaatggaagagagaactacggatctgtcttccatcctaatttaaccttcaggaaataccttctgcacaaaacacttcattaaataaaaaaaattacaagacagtaagcttaaaaaaaaaaaaggctaggaccacaacttgcccagttaagtctgaatggtgatgttattggttttaagcctgaagaaaagaatgtaacttctgcttctctaaaatcacatcttcatattgggctaatttaaatttaaatcacttaatgccttaacagtgctaaaaattccaagaatgtcagacatactgatattcaaaataaagtacaaaaataagtcaaatataaatatgtttgcctgtcatgctcctctttaatttaccctgatgagctaaagttgattataattataataatatatgttatttcaagtactactattctttttaagaactcatgacctaggaccccaaaacgcaattagggatatacaatttggagtatggtttacttctcagtaaagtttaatactaattgaagtactaaattgaacaaggtcaatattttgtagtactaatcccaataacttgatcccatgcaagaaacaaaagggaattttaaaggctgttttggaatcccagaacattggggttctaccttaacttcctagtattcccttcaagtctcagttgagtgttagagaacaagtcttacttttgtcattttgacagtgaggactggctttgccaattagattatgttgtggacattttccataaattttcataaattccaggttttgatagaattctatttaaagcacatacgcaatctgaaataggttagaaattacaccatctgcatccatttaaacctataattaaacatttgagttataatttaaaagtgttcaaggcagtacattgcttttcaaaagctttgtagagacagtgtaacaacaacagaaaaatttcacaaccactgctgtagtgtagtggagaaagcctgggctctaaagtcagtcttagtggcctagtttgaatcttttctctggcaatattggcttagaagttaagttaaaaactactaagggtggctgggtgcggtggctcacgcctgtaatcccagcacttaggaaggccgaggtggctggatcacgaggtcaggagattgagaccatcctggctaatatggtgaaaccccgtctctactaaaaatacaaaaaattagccgggcgtcgtggcgggtgcctgtagtcctagctactcgggaggctgaggcaggagaatgatgtgaaccatggaggtggagcttgcagtgagccgagattgcgccactgcactccagcctgggcgacagagtgagactgtctgaaaagaaacaaacaaacaaaagttttatccagtatatctattcctagttttctaagagattttaaatttttagtaaaaactgttacagaattttatcaattgtttgcatgcattgagaggatcttaatgatttttcagtttttaaattccattatgtggtgattaacattgaagtttgaatattaaatcagttttaaattcctggattaaactcatcttgattgtgatggataacgtatttctggatttgatttactaatgctttgattaggatattttttggattatgtttgccagagagattagtctgtagtcttgtaatactgtccttgtaagttttaagtattaacattatgctgtcctcataaaaaaggatgagatgtagtccctcaaataatggtgccatttctacatttaatattgagacgtttggaaaaatttagtgataaatccatctcattctggagttttcttgaaagattttaaattatggattcaatttctttattagagataggattgtttaagttctctgttggtcatttggcaagttgagtttttctaggaatttgcccacttttaattttaaagtttattggcgtacattttttcacaatgattgtttttctgtttactctcttaatgtccataattgtacacattttttctttttctttttttttttttttttagtatttattgatcattcttgggtgtttctcggagagggggatttggcagggtcataggacaatagtggagggaaggttagcagataaacatgtgaacaagggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccacccttaatccgtttaaccctgagtggacacagcacatgtttcagagagcacagggttgggggtaaggttatagattaacagcatcccaaggcagaagaatttttcttagtatagaacaaaatggagtctcctatgtccacttctttctacacagacacagcaacaatctgatctctctttcctttccccacatttcccccctttctattagacaaaaccgccatcgtcatcatggcccgctctcaaggagctgttgggcacacctcccagacggggcggcggctgggcagaggcgccccgcacctcccggacggggtgactgccgggagggggctgccccccacctcccgaacggggcggctggccgagcgggggctgccccccgacctccctcccggacggggcagctgccaggcggagacgctcctcacttcccagacggggcggctgctgggcggaggggctcctcacttctcagacggggcggccgggcagagacgctcctcacctcccagacacgctcctcacctcccagacgggttggcagtcgggcagagacgctcctcagatcccagacggggtcgcggccgggcagaggcgctcctcacatcccagacggggcggcggggcagaggcgctccccacatctcagacgatgggcggcagggcagagacgctcctcacttcctagacgtgatggcggccgggaagaggcgctcctcacttcccagactgggcggccgggcagaggggctcctcacatcccagacgatgggcagccaggcagagacgctcctcacttcccagagggggtggcggctgggcagaggctgccatctcggcactttgggaggccaaggcaggtggctgggaggtggaggttgtagcgagccgagatcaggccactgcactccagcctgggcaacattgagcactgagtgagcgagactccgtctgcaatcccggcacctcgggaggcccaggcgggcagatcactcgcggttaggagctggagaccagcccggcgaacatggcgaaaccccttctccaccaaaaaatacaaaaaccagtcaggcgtggcggcgcgtgcctgcaatcccaggcactcggcaggctgaggcaggagaatcaggcagggaggttgcagtgagccgagatggcggcagtacagtccagcctccgcttggcatcagagggagaccatggaaagtgggagaccgtggggagggggagagggggagggggagggggaacattttttcatttctaatattgtttatttgtgtcatctgtctttttttccagcactccttttagaggtttatcaatcttgtgaatttttggtaatgttgattttctctatttaatagttgttttaattttattaacatctactctcatctgtattgtctttcttttacttttctcttttccatcttttaaagttctatgattagcttgttaatttttagcattattgttttctaatgtaagtattaagactttagatttctaaataccaccttagttgcatctcatatgttttgatatgttgtctttttattattattccattctaaatgccctctgctttctaatttttatttttgacctgtgaattgtttagagttatgtcttaatttccaatgcttttttaaaagagccattagtttaaaatattttttatttgtatcatactccagtatttaagatttaaaaatgttctgtatggttttcaaaatagtatttcttcttgtagttgtattgcatttgtgtctactagattcaggttgttacttagattgttcaaacttttgtatgcttcacttatcaattactgagacaggtgttaaaattacctagcttaatggcaagtttgccaatttttctgtgtaactcttgtcagtttttgcccattttatacattgaggctaggtcagttaggtatataaagtgtagaatttctgtgttttcctgatgaattgcacctttttctaatgacagtcattatctgtagtgaagctttttgccttaaagtttcccctttctcttcatattaatataaataatatacctttatttggatattatttacctggtttatctttgtccatacttttattttcattctttctgtattcttgtgtttggatagtttttggaaacagcatataactggatttttctcctgtggtgtgaaatctttgtattttaatggagcagggaggccatttagatttattataaatacagatttatttggatatatttctaccatttaaaaagctttttctatatttatttttccgtatgttctcactgtcttttagattaattcagtatatttgccagatttaattttcccctctagttgtttggaagacataacacttcatttctcttcggtttgagactgcccagttgaaatttccacatttaagttatgaaagtaatcactttcttttatgctcttcctaaggatcctctcctgtgacttctagtctctgtttcttttaatttagaaaaagataatctgattggaatagtttgggtcaggtgcctacttttggatcatagctattataaggtgtggaaggtggagaatttttgtggagatgtggccactggggggttcctttccttcactccttgcatctctactaccctattcatgaactgtatattgttaacttttatcagccattttaggagatatatactacggaattgctgcaaacccaaatatatgtaattccatagtctttctgtaagactatttctctcaaatttacagggtgggggaaatactcttccttttttttttttttttttttttttttggtgtatacgaatatttgaaaactatcaaaccaggaaacacctccccccaccaccacctcccaatcccaaacctgtcatctctcattggctaagctgttccaagagctttgggttatttgtgttttttttttttttttccttgtttcttccattcttttcctttggtgcttatctgagaattcctacggaactttgaggaagtgtcatcagtatttcacagttagaacgaactattgtcctaacatttcatggaggttcaggaccatggacagatcacatgtgctacctgtctcagtcccacccacatattttagcaggttaaaatattcttctgaagtctccactggcatcattcttttccttataagttgaactcctccctatttttatcagtcatcttacagccaggtcttgcctctttaaagttgttttgttgttgttgttggtttttttttttttgagacagagtttcgctcttgtcgcccaggctggagtgcagtggtgccatctcggctcaccgcagcctcagcctcctgagtgtctgggattacaggcatgcgccaccacgcccggctaattttgtatttttttagtagagatggggtttctccatgttgtcaggctggtctcgaattcccaatcctcaggtgatctgcccgccttggaggcgtgagccaccatgcccggccttttttttgagacagagtctcattctgtcacccaggctggagtgcagtggtgcaatctcgactcactgcaacctctgcctcccgggttcaagcagttctcctgcctcaacctcccgagtagctgagattacaggcatgcgccaccatgcctggctaatttttgtatttttggtagagatggggtttcaccatgtttgccaggctggtctcaaactcctgatctcaccttaggtgatccacccaccttggcctcccaaagtgctgggattacaggcgtgagccaccgtgcccaacccctctttgaagtttttatctcacttatgtataaaatacttatcttgccaatacgtttgagttagtaaatagtttagtctctgcaaagaaatggagaattagataggttaagtaacttatttaatgatggagccaggttttgcagtcaactttttctgactctgaaaccatatctctcaattacttgatatacttcattaaaaaaataattattctgttcattatactcttggtttatgactttaaaaatatgttttaaaatcaacttataatttatttttgaaattacagggccaggagcagtagctcacatctgtaatactagctattagggaggctgaggcagagggtcacttgagaccaggagtttgacaccagcctgggcaacatagtgagatcccaaatctaaaatcaaaaacaccttacacatttgcccaattttctattatagtgttcttttttttcttactatattgtaagagctccttgaattttagggatagcaaccctctgaccatcatagattacatatatttcccccatttgtattttttctttttaacttagagtatttttaaaaataaaacttcagtacataataaaactatcttttatttagttaaatcttttcctttagggtttttcttttggcattctgtttagaaaacttcttccccatccaaagaacataaaaatatccaattctgatatatctgtggtatatgtaggttacttttagattgtctatattggaactgataattttagaacacactttaagagcagtagggtaaggaccttaatatttctttttaaatgttttcttggcttttctcctacatttattcttataggtgaccttaaaattatctttacattctctttctttttccaaaatctaatttggaagaacttttaaaaagataaacaaagtggccaaactttgcttttcacttttgtcatattttaaacatatgaaagagttaaacattaatttataatagtgttcttaccagctggatagaaatacatttacttagtacctatatttattttttctttctttgtaatttatcttctaggaagctattttgtaaaatttatggtgaaccagttgttgatttatacattattagtggtgtgataactgaggatgctcgaaagaaggcatgtaatgagattgttgctatgggaagattgagtaggtaactacccagaatgtttcccatttctagtacaatatctggtattgaataggtgctcagtaaagagttaaatacatgaagagttaaatgaatactgaagactttttttgggtgaatttactaagctcgtaatttcagccttattgatcagaatcagagatacaagtatattcagtagtcttatttataggaggcaaagtagatgaactagaatgccagttaggaatttccaataaagaatatatctatcagccatcagagtcatttgtatcgttctccccactgcttttttttttcctacaggaaaaattttatcagatgtttacttgaagaatgaaactggaataaggatagctactttagtgaatttaagttctgatagcatgataggaatgatgtgccaagtggattaatatttttgcccagtgtttaacatatccctctactgtgcacaaaagactgctacctaaatttctcactcacagattttctctactgataatatctgcctcctggccacgtactttctttagctgtgtcattagctcaccattagatcttgctctgatttagtcataattatttaaaagaaaatacacaagttgtacatgaatatatgtttatttaaaaaacagtataattaacatttattgagccattttatgcaccagatatcacattaagtattatatattcttatttaattaaaaacccatttttaacccattgagggactcaaacaggtacttacatgccagtgttcatagcactggcatgtaatagccactcacaatagccaaaaaatgtaaacaccccaagtcttcattaacttgtagttggataaaatgactgtagcataagcatacagtggagtattatttagccataagaagagtgaatttctgacacatgctgtgcaacatcactgaaccttgaaaacatgcctagtgacataagccagacatacatgattctggttatactcagtatatagaataggcaaattccgtagagacagaatgtagattagtggttaccaggcatgggatgtggtggtgggtcggggaggggatggggaattattgcttaatgtttacagagttctgtgtggggtgatgaaattgtagaaatagtgatcctaatgtttgtacaacattatgaatgtaactaaagctactgatgtacacttaacaatagttaaaatggcatattttatgttatgtattttttccacaaaataaaattcaaacaactcatgacctaggttctactattatcaccattttacaagtgaggtttagaagaaataagtaactagtatgagttcatgtagttaagtgacaggcatctagacttgaactcaggtttgtctgaccccagatgccatatttttaatcaggtggttctctgctttcagaaataaaagtggaggtgccgtctttcctattccttatttccattcttttgcacagaaattacttctgattctttgcttaattgtttgacatgtatccttttagaccctcttcctatgcatttacttaagtatttatgtgcataaatgtgtacaactttttcattaatttacatacacagcataattaacattgtttatgtgactgcttttttcatttaacagtatgcattagagatgtttctattaattcatgtgggtctacttcattttatttgctgcatatgtttcattgtatggatatatgtgggtatagtgttttgtggcatggatatcccgtaatttatataccatttcggtatttcctaggtagtttccagtttttcattctaacatacagtatttcagggcttatacatatactcagaagtggagtttttgggcaaaaggaatgtacatttaaaatatttagttactgcaatataatatttcttccacttcaaaggataccagtttaaacttctaacattgggatatgagagtccttgtttcctaggaacagagtattatcagtcttttttgcctatcccatggtcagtaattgatacttgttacattagtataaaaatctctgatttacttccagatgttagacattttccatatggttttcttttgttttgaattgccagtgcctatttttctaatattaatatttctcttagtgatttgtaaaatctgtatgttctatgtgttaattttttgttacgtaaatatttgttacaaatatatttttccaatgttgttttatttttcttaaactttgttcgtgttatcttttaccttacaggagacttaagttttcatatagataaatcttctttttattattaatacttctggctataaggctctgtgttgctaaaacagctttttccatttcaatgttatgtgaatatgctccattatattttcctagtattactgtagattttaaaaaattgtttctctaattatggcattattttttgagtcgtgtgagctatggattaaagtttttttccaaatagttcatctttctcccactcatttaaaatacctatatctgagcccatttctgcttcattgttctattggttcaggggtcagcagactgacacacaagacaaatctggcctactgccttgtttttgtaaatacagatttattggaacatagccccacctatttgtttacatactgtttttgttttgattatgcaagggctgagttgaatagttggcacagagactaaagagctcacaaagcctgcaatatttactgtggcctttacagaaaaggtttgccaacccctgaattagtctcttttctaataccagacttttttttaaataaaaatatgaatatgggctgagcccagtggctcgtgcctgtaatcccagcactttgggaggccaaggtagatggattgcttgagcccaggagtttgagaccagcctgggcaacatggcaaaccctgtctctacaaaaaatacaaaaattagccaggcgtagtagcatgtgcctgtagtcgcagctacttgggaggctgaggtggaaggattgtttcagcccaggaggttgaggctgcagtgaaccgggatcacgccagtacactccagcctgaatgacagagcaagaccctgtctttaaaaaaaaaaagtgtgtgtgtgtatatatatatatgtatatatatatatacacacacactatatatatacacatactatatatatacacacactatacacacactatatatacacatatatatatacactatatatatacagaaaaaagtatacatatatacatacacatacaaaatacacatataaatgtgtattaatgggtatgtctgtctcctccccatatcacaatattttattttatttatatacaccctggtgggggcgtgtgtcttttcctaccagatatcaaaactaataaattatagtaaaaatagagtctggtattggaaaagaaaccgactaaaacagaattggcaaactttttctgtaaaggctacaataaatactttggctttgtgagctgcaccgtctgtgtgccagctattcaactcagcccttatgtcgtgaaagcaaacgaaaacaatacataaacaaatggatggggctttattccaataaaaacacctgtgttttaaacatttttcatgattattctgcatttccttttgcacctgaacttcagaaatagttaacttcaatcagataccacattaggctttcttttaaggtgaacttaaaaaaatgttacttttcagagattacattttatctacaattttgccattttaaaatacttgattaagtaatggtactagctccagtgcctgggacatggtaggtgtacaataaatacgtgctactagtatgaattgtccaagattctttctcccatgtcttttgtctggtgatatggtttagctctgtgtccccacccgaatctcatttcgaattgttaccccctcgtattgagggagggacctggtgggaggtgattggatcatggggccaatttcccccatgctgttttgtgatagtgagggagttctcacaagatttgatggttttaaaagtggcattgcccttgcttgctctcctgctgccttgtgaagaaggtgcttgcttcccttttcaccttctgccatgattgtaagttttctgaagcctccccagccatgtggaactgtaagtcaattaaacctcttttgtttataaattacccagtctcaggtagtatctttatagaagtgtgaaaacagactaatacactggaaaatcgcctgtctgatgggtatagatattcattagcaggcatctatcaccttttatctgataacatctatgtgagttacatacatgacatgatatagattgggttgtacattttttaaatgcttaagggccagcaaacattcctaaaacattaaaatatagtaatactattccttcccctctcacaggtcttctagtagatgatcttatctaagctttaagagatcactggattcctaaagtgattttattttgtagaattatgtattctgttatgtattttagtaacagattagaactaaattggatatagtagggatttcattcataaattatcattcaacactaaatgcaaattcttggctgaaggagcttatagaaacaaaatctattttgttataaaaatgcataaattaagcattttcttagtaggaccaaactttttgtgatatgttagagtgactaacttttctttcctaatcttataatatccttctatagacatttaaagctttacttctttatgccttccccaacaactttaaaccaatgttttcctgctctttctgatctcatgctaaagactgtatgctagatgatctggttgtaaatcccagttccttcatttatttgagtatttaagggccaacaaaattgtcagaaattagtttaaaaacgtaaataaatggactatttaggtcacataacttaaattattttgtttcctcatttaaaatgaagctagtaatgctacctatcttcatagtttgttgtgtgtcttggacaagttggtatgcaaaacataaaatgtcaagcttgttaaatggagttaatctgaagattatgagtcctattctgatagcctaattgagaaaaagtgccacaaacgtgtagtttcaatttacagatgcagagataagttataaactagtgataaacttggcaaaatttccaggtaagattatctttcactggatagaattatattttgacttcatgcttaatattttttaagagcatttgcttggccataacaatacaactaacagtgatcgaaaacacaagaacatttattactaaataagtcttgaggcaggcaatcccagggttggctctctggctcagcagtgtcagtgttagattgccaggtctctgaagctcttctgtttttcctttcatggttgcaagacagctcctaaaagagcgtatcatcatagtaatatatagagtagagagagagcattcgagaaagggctttctccttgttcttcttactcattaaggaaagaccctagaagctctcaggccctttctattactggtcaaaataatataaagcaagtttcacacagatgcctgaccaaacaatggaaaaggggaaagggcttataccaattatactggcatataccaattataattcatcatctggggtaaaacaaattgccactacccagaaatagggtctgtcaatgaggaagaagggaagattagttgttaggtaactaggcagtctgccacatacgatattcatttgtttaagtaacttacaaagtaacaaggtttaaaatagtgaacaaagcggacttaatccccggaattcttgagtttttttctttctctgtttaagagatgccatttttgttgggatattattatgcattttcttgtctcctgaatgcttataagtgttagagttcaaacgaggaccttctttggaccatcagtttttaaaaatacattccttagaagaaaaacattcacttaaaaatgttttatttttacaattatgtattagtatttctagtttcagagagaaggagaaactagggtctagaggataatatacccaagttcaaatagatgggaggttctaattgtaatatcagttaataatttttgaatcttttttttttttttttaagacggagtctcgctctgtcgtcaccaggctggagtgcagtggcgtgatcttgggtcactgcaacctccacctcccggattcaagcgatactcctgcctcagcctcctgaggagctaggattacaggtgcatgccacaattccgcccgccttggcctccctcccaaagtgctgggattacaggcatgagctactgtgcccggcctaatttttgaaacttttttttatgccccacgtactgtacttaactacttttcataaattgttttattaaatcctcatgaccctgtgagggttatgaggtataggtacctgtacaggtagggaaacgaagccttttgtgtctaaataacttctcaaggtctcacagctactaagcggcaatcaaactaacacctcagggttgttagatgccaaagtgtgcacttttagcacgctttggtgtttgtgctgctggtcttcctaccactgtggaagtggttgctggaatcttagtacacagcatgttaaagtttctgttaaaatttggtactgttagttttaccttggatacaatgcaatgcaggatttttttcctgctgcgtccatgaagccaaatcctcagtgtgatgacagaaattgcagaaagaatgtaagaaaaaggtagcagcactgcccaaatgaggttatacaagaagaggaagagataatccatgaatataccgagtggggtattgagctggtatctgaggtttcagaagaggaattgaaaaattcttcaggtccagttccagacttacctgaaggaattacagtggcatacacaattccaaaaaagcaagaagattctgtcactgaggtaacagtggaagattctttaaagcttggaagacctcatggccaagattaagaatatgtacataatggactggcatatattttatttctcatgttaaagcctcttaccttgaaattaaaaaatttttaaaactggtaaaacttagggcaacattaattaatgtatactcttaactgaattgttatactttttgaaaatcccgtgacttgcttgtttctctccactccaactaaatcattaactctcctaaaatgtatgtttcattctagtaagaaaacctcaaaggatattgtaggatataaatcttatttgaaaatatagccattgaaatgttttggccttttggagttggggaatgacaaatctgatcctggaatctttttcttttcagtaatcccttgtgtctgttgcctgagggacatggacaataaagcagtacatgatcctcagatacagggagaaggacaaggcatatagcttatttattagagccagcaagcatctgctcattatgtttggaattgctttctataagaaaattttgccctctactactaacttgaccaaaaatgaatttaaaattgcctgtgaaataacatcctctcaaatgtttgctgatgaaattcaagttgaaatgtattcattgcaaaagtctataaacctgtggattatatattcaaaataagacaaaggcaaataaaaagcagctgtcttcatgaatagacaaaagttgctttcaggaagtataaattatattctgcactgaccaaagaatagaagttattgcatctgtggaacatatatctggagttactatactaaagagcagggcatgaatttagactaaaatccatccagattacactcattctttaggccactgctggatacttcatttacatttgattcttggctgggcacggtggctcatgcctgtagtcccagcactttgggaggctgaggtgggtggatcacctgaggtcaggagttcgagaccagcctggccaacatggtgaaaccccgtctctactaaaaatacaaaaattagccgggcatggtggtgggctcctgtaatcccagctacttgggagcctgaggcagaagaatcacctgaacctgggaggcggagactgcagtgagccaagatcatgccattacactgcagcctgggtgcagagcgagactccgtttcaaaaaaaaaaaaaaaaaattgattctcaaggtaatgagatatcagcaaggtttgtcttgtatagtgggcataaaagaaaagttctaaattgcctctgcaatgacttgtagtcagtggaagagtatcattttccctgatcatgaccactatgctgtaaattgatataaattaactttctctggagttacacacaaataacgaagatttaagagaaccttggctgaaataaatttccagttgtttggaggctaataaataccatgcaggtgtaaccattaaaaaaattattatataaactactatattatgtaaactacaatattttagcttttctgtgtgagaaagtgatttttgtttgtttgtttgtttgagacagagtcttgctctgtcacccaggctggagtgcagtggcacgatcttggctttctgcagcctcagctcccgggttccagtgattctcttgcctcagcctcccaagtagctgggattacaggcgtgtgccaccatgcctggctaatttttgtatttttagtagagacgagatttcaccatgttagccaggctggtcttgaactactgacctcaagtgatctgcccacctctacctcacagggtgctaggattacaggcatgagccactgcacccagccaaaaatgatttcataaaaattgttaaaaatctgtagctgctttgttaccttcattaactctttgtgattaaagttgcaagtttattgcagtaatgggaatgtgttagattaatgtttaggtgagttatattttaaaatctgtgtagtatatttatagttcacccagtaattagaacaccgtatcttaattccttattgttcctctagtgtgtcacaggaggtagagtttattgatgctgggattgcggatgtgaaaataacattctcagggtatcttatgacttaaaaggccgattttttaaccagtgatattttctgtgattgtctataatttggtttaaatttatacttaataagggccagaatacatggctatattcttagtatcctttagaacattatttcttagtcaaagtttatgaggcatctagcaacattttacatgatatataaaattggaggtaaatgtgctttttcttgggaggaattcatagccttaaactattcttggaggagtgtatgattctctctctgtactttcccctgtttttcaattattgcttcagagtattttttttttaagtttgagtactttaaacagcatagagaagtaaatcagtgacttaaaaattcattattttgtcctatatgcacatgttaatatatcattacatttcagtggcagtatttttcatttcttgttttacttggttaattttcaaatctctgttctttcattatttgtatttcttctatctcttgaatcattgttacccacttcatggtatttttcagattgtattattctcttgagttcttgagggtactaatcttcccatttgttttgattgccaactttccccattttggtgttctatttcctcatttagtttaattttttttcaattgtgagctcacttttgactgaggtagatttttctgggatgagttcctttccctctgaatgcttttgcttctgtgggataggaactagatttaatattaatttcttggcagaggatttctttaccacatgggcagtatggattcagactccaaaccctcatgttttcctcttatgctgccccccaccaacaccctaggttgcttcactggacaagaatcagaatttttattattccctgacatggggaaagggtcctggttttaatgagaggtaatcattccagtcctctacctctgttaagccaccagcaataccttcattcgttgtggatcgaatgatccctaacaggcacctgttagggcctgtgtccaggacttttgcttttgcagcatctattcctgtgtttaaagttttgattatttttctttatttctaattcttggggatttctcttcctttcttctccttcattagtttgattgtatatttaaaatctctcatggttgtttgttttatttagcatttctatgtgtatttgtgtatgtgtgggtctgtgttactgcttactgtgttgtcaagcccatatatgcacaaggactattttgaaactttgtttaataataactcaggctaggtgcagtggctcaggcctgtaaccccagcattttgggaggccaaggcaggcagatcacctgaagtcaggagttcaagaccagcctggccaacatggtgaaaccccgtctctactaaaaatacaaaaattagctgggcatggtggcacgcacctgtaattacagctacttaagaggctgaggcatgagaattgcttgaatcctggaggtggaggttgcagtgaggtgagatcacaccactgcactccagcctgggcaacagagcgagactctgtctcaaaaaaaaagaaaaactcaattattctgttaaaaaattttaatatgaaagatactggtgcttaaaggtgaataatactgtttttaaccttcatgtgtctgtgattgtaaaaagtctcaaatataccacctgtaactttgttctttgtatattttaactcattaatgtatagtcacagtattacagaatttagacacagagcctggcataattgataacagttttaacatggctttattaactactcttttctcattcttccctattctcttctagtctcccttttgcatggattattctcttttcctgccctactgttggttccagattcttatgttattccattgcagataagggagaagaagaatggtagaatggaaacccactggagaaattcgagacgaaagagaagaaggaaaataatgggtgaagggaaggttaaaatttcttgctccagcactctctgttctcttccaggccttatcttactccttcagactctgtcttcatttctcatcttttcttctcacttatgcctctgcctttccactctctctttctattggacactttctttctgacaccatggtagctatcactagtggcttgcaatctatgttcctaccacctggccagtagttgtagggaggaaggaggttggatgggagaattgaaggagactctgttgttggatcttgggctacacagagtagggagaaagatgtaccttgcaaggtataccaggcattttgtattggaactttgagttctttttcttctagaattattcatttatctgttcattaaacagtaaacaatgaaccccaggcagtgttttaggaactcacatagaaacatactttgttcttttcagtttcagagatcttttttatttaacttagaattatttcacttttgaatctcttaatttcagcatctgtatttatttcaaaccttttgggaataaagaggcaacttgttatgttggaaaggcttttggagcctgatagatctgagttttaatcctgtctttgccacttactaggtatttaatattcaggaatttatattatctttctaaaccttttttttttttttctgtaaaatgggaagttcttagtatggtacttggcttagatggctcccaataaaataatgcctgctaagattattattatcacacagaaagtttgtccttagtaccaaatcaattttttttgtttttgtttttgttttgccaagaagtacttttaaaactagagtacattaagacaatgattaaaggattctgttttgtttatttttatatcacattcttgaagtttggacaagttgtcataatttacataaaactattacttctaagctattacttctaagttggtgtgtccttctctgagctagcagtgtcatagtagtactgtgacttactagtcaagtttaggccagcaagtcacatactatgtttaggccttataatattaatgagggttaataatatgtaccttatggattttatgataactaaattacgtattagtttggaagctaaccgtgtctagttgtgagctaaaaaccaagtatttagtgtaagattcaggcttgttcgggaaatacaaggcggggatgcaatcaaatgtcaggaatcgccagaacaccgggaataaggaagctatcggaacacttccttttctcattgtctttgcctttctctatgcatctgctttgtttttctctttcattatgtggaactgattttctcttttgcttttagagtcatagtaggatgtttgcctcaacacttgctgagtttgtatgttaattcttgtaatcatctgcagagactgactctgagttaggtttgaaattacttgtcccccagcttaggtcagatttccatattggttcagttaacactggccagttaaatggggcctcacaatatgcacttggcccacccctgagaactgagggggagattttcagaaaaagggagggaggcggcgtggcagatacctcagaaagtgtgtgccacaagtgaagtcatttaagtatacagcactgaagaaagtcaaggtattgttatcattagatgatgtagtactttgtgaaatatcactaatagcatctattcagaatagcatgtcatttatctaccagcgcaacagatctgattagtcccttatatgcccttgatttttgtcaagggcagtagcgtagtgattattatatctttttcaattgttgtaatgaatataaagtcttttgcaatttgtcttttatattcaaaattattttaatcatagagtgtgcttgaaatgaactttttggtggatataatttttaagaacatatctttgtataaaagcacttttgttaaatattgctaatgaacttttttcaggaataagttgaacgtataatcagttttttttcaaatgcagcatagaaataagaaatattcaagtaattgatacatgattcttttggttctatcattgaatttctgaactctcagctataacttgttaaggcatcttttaaattatcccagacattatgaatggagtgctcagtaatgatttgtataacccttagctttgttttgattcattttctttatactacttagggtatcatcatatgacaagataactgtatacccctgtatagacacttaatattgttaatatttattgttctgtgttcatatttaccccaaattagaatagtcaataggtataatttacctgaagtgtcagctctgcagcacactttttctgaatttctgatttagtctgggtgggggagctaggtttcggtttaaggatgcctttgttttgtgattttgtgatatagtagaaatcaaaactgcttttaagtatagaagactggtgttacaattatttggggggatagtcaggctcccattttcagttcttttttttttttttttttcccggacagggtttcaccctgttgcccaggctggagtgtagtggcgccctctaagcttactgcagccttcatctcctgggctaaagtggccctcccacttcagtctcctgagtagctgggactgcaggcacaagccaccgtgtctggccgatttttatatttgtatttttgtagagacagagttttgccacgttgcccacgctggtcttgaactcttagactcaagcaatccgtctgctttggcctcccaaagtattgggatacaggcgtgaaccaccacacccggccccatttttagttctagtaggtctgtatgtatctcccaccttgtcaaacttgtgtgtaattttttttaaaaaaggtttcacccaccttgtcaaacttgcgtgtgatttttaaaaaagttttcttccttttttttttgagacagagtctcactcaatcgcccaggctggagtgcagtggcataatcttggctcactgcaacctccgcctcctgggttctagtgattctcctgcctcagcctcccaagtagctgggattacaggcgcccatttactaccatgcccatttaatttttgtatttttggtagagacagggtttcaccatgttgaccaggctggtcttgaactcctgacctcaggtgattcacccgccttggcttcctacagtgctgggattacaggccactgtgcccagcatcttcctattttgttttaaaacagctttactgacatgattgacataccaaacaattcacctgtttgaagtatacaattcagtggttttgatatcttactaatttttaaaaattgtggtaaaatacatataacaaaatttgccattttgaccacttttacatgtacaattcagtggcattaaattatatttataatattatgtaacaaccatcacatagctgtctctaaaactttttcattatccaaagagaaattctgtaaccattaagccataagttttcattctcctgtcccccagcccttagtaacctttaatctactttctgtctctatgaatttgcctattctagatatttcatttaagtgacataatatatttgccttttaatgcctgtcttactttacttagcatgttttcaagatttatccacattatagcacgtatcagaccttaacttcattttaaagctgcttaacatactggtgtgtgtgtgtgtgtgtgtgtgtgtgtgtgtgtgtgtgtgtctgtatatatatatcacattttgtttatctgttcatctcttgatggacatttggataatttccaccttttggctactgcgaataatgctgtcatgaacatcattgtacagatatctgtttgaatctcttcttttgattctcttgggtacataggaatggaattgctgggatatgttggtaaatctatgtttagctttttgaggaactacccaactgttttacaaagcagcagtaacattttatatcccctctagcaatgaatgagggttccagtttctccacatcctcttcatcacttgttattttctgttttatttaattaatttaaaaaattcagctattgtagaggttgtgaagtggtatctcattgtggttttggttttcatttccttaatgattagtgatgttgagtatcttttcatatgtgttttggccatttttatatatcttcatatatatattattttacttttaagttctgggatacatgtgcagaacatgcaggtttgttacataggtatacatgtgccatggtggtttgctacacctatcaacctgtcatctgtgttttaagccccgcgtgcattagttatttatctaatgctttccctcctcttggcccccaccccaacaggccccagtgtgtgatgtgcccctccctgtgtccatgtatgttctcattgttcatctcccacttatgagtgagaacatgtggtatttggttttctgttcctgtgttagtttgttgagaatgatggtttccagcttcatccatgtccctgcaaaggacatgaactcattcttttttcatttttatttatcttctttggagaaatgtttattaaaacttttgcccatttttgaattggggttttttgttgttgacttgtaggagttctttgtatattctggtattaattccttagtagatacatgatttgcaaatacttttcccattctatgggttgtcttttctctctctccatatgaattttaggatgagtttttctatttctgtaatgccattgtaattttgatagggattgctttgaatctgtggattgctttgggtaacattgtcatattaacaatattaagtcttcttccaatctagaatactggatgtcttttcatttatttaagtcttctttaatttttatcagcaatattctgtagtttccaatgtacaagtctttcacctcattggttaaatttatctttaagtactttattcttttggatgctgttgcaaatggaattttattattattaattcttttattactgctttttaagagacaggatcttgctgttttgcccaggcaggagtgcagtggtatgatcatgactcattgcagcctcgaatacctgggctcaagttatcctcctgccttagcctcctgtgtagctaaggactacaggcatatgccaccacgttcagctaatttttttctctttctcttctctgttgtgtcaattccagatagaaatcctctctctctttcctttccttacaaaacacaaatacagaaatccctagtggacttgactaagcagtgtggaatacccgttttcgaagctagttagagctaaatgcatacttttagatcagagcaaactgtatgacctatctgtttcactcccctaatgctcaaatatgtatctttgatcttatcacactctggctccatggaaggaagagagaagacagctacacccatgtattatgatcctttaatcatatcagttcctttttgtgttagaataaagagggacctgaggagaggaaaggagacacgtttaaacttctcttagaggcagcagaatatgtaattgctctaatcattaaacatttttaatttaccagttaaaattattaataagattacatctaaattcctttaatgaaattcaaagccttttccattttctagctcttatttctttgcatttcttctcacaattctttaccatggattatttaccattaacaccccaaattcacttcctcgcctctcttcatttgcttatattgttccctcttgcctggaatatctacattgtcaaacccaggcaaagcagcaagattctatttagtcctcaaggttcaatttatctgttatctcctttgtgtgaagcattagtatccacataattagtgttctattctcactaattctgaagcacttaaaactttatcacattattaaattttgtgtctgcatatatgcatacttgtctttcttgaatgaagactaagagtttcttgaaggaaagtatcatatcataatcaaatttttaaaaactccagtcattgccaccatgctttgtatactgtagacgtttgctaacgcattttaaaggaacaaatgaatgagcgtgaaagaaacatgagtttacttggtgggaattgctgaagagctctctggtgccatgaaatctgcttttattttttatatctttgtgttaaaatatatatttaatgctgatagaatgttaaaactggtctcatttttacatcccccttgctttgcattcttttatatgttatttggagtttaaacatacatttctcaccaaaaatgtaattcatatgtaagaaataaaagaaaatatattgttttcttagggaaattaaatctgtttattctcatatagtttgggatttttaaatattttgacaattcttaaatcataatttgaatttttgtgtaactaagaaacaccattatttatatctaatttgcatcacattttattaagaaaataattgatattgctctttcatttcagctaaaccatttacttctaaagtgaaacaaatgcgattacatagagaagactttgaaatattaaaggtgattggtcgaggagcttttggggaggtaagagattaagatttgatagaaggtctgctaattattttggaagctgttgaacacaattgtgagagaatttaacaagtattgttacttgttacttgttaaacaatatttgttaagttgtgattgatgtgattgattgtgctgttgtgattgatataatagctcagaaaataaagtgttgaatgaaatatttctactgggaattttttctaagatcatgttttcacatgtacttcatatgtcaatgtaaatatgagtgtgtttctagactcttcttttgttctgttggtctgtcttattctagtttataaggaatcttgatacctggtagtgtatatactctgacttcctttttctccccctctcccatctctcctcccctgatattttcatagtattttattttatgtatgaatgtatgtatgtatgtatgtatgtatgtatgtatgtatgtatttatttatttttgagatggagtttccctctgttgcccaggctggagcgcagtggcatgatcttggctcactacaacctccacctcccggattcaagtgattctcctgcttcagcctcccgagtagctgggattacaggcgtccgccatcaggcccagctaatttttgtatttttagtcaagttgggtttttgccgtgttggtcaggcgggtctcaaattcctgacctcaagtgatctgcccaccttgtcctcctaaaggatattttcatagtattttagaatcagtttttcaatttcgactcacttgtaaagatacacatgcacgcgcacgcgcgcgcgctctctctcgctctctctctcgctctctttctctctctccctcctctctctctcctctctcttctcttgtctcctctctctctctcttttttccaggaatttgggtaaagtttgtattgaaactggagatcagtttgcagacaattggcattttaacaatactactgagtcacctaatccatagacgtggtatattcttccatttatttagggctttataaatttatctcaataccgttttgtagtgttcattcagtatagaagacctccacatctttcagcagatttattcctggatatgtgatagtcttgatattattttaattagaattgtttgtgaaatttcatttcttaattgttttcttggtagtagttagaagtagaatttaattttattgatcttataccttgttatacttttcaaataggaattttgttgaattttattaatactttatctgcatcttttgggacactcatggtttttctcctttactttgttaatgtgttgaattatgctgttatattttcagatgttaaacaatctttgcattcctaaaataagcccaactgacttgtgatatgttaccccctttatatgtaccaacggacttcatgtgctttttgtgtgttgataggatctttgcacctgtgttcttcagataaattggcctgtaattttcctacttcgaatgttctgatcagattttggtatcttggttatactggtcttacaagaagagggaaatgttccctcctttagtattctccagaagagttagtgaagattgttattatttttttcctgatatgcttacaagatttaactggtgaagcctctgagaccagaggttgctagtgaaaaagttttaaataatgtttaatttctttaatggaaataaaatgacttgttctgtgtatgtattagttttgctaggtttatccatttcatctaatttttaaaacttgttactgtattgatcatttctctctctttttatttttcttgctaggggtttatcagtttattatcttttccatgaattaacttttggccttttgaattttgttattgtagatttgttttctggttctttaatttctgcactttataatattttctttggttttatcttgctattctttttctgatttttcaaaatagcattgatatctagcccttcttttcaaacctgtgtttaaggctatatgttttcctctaagcatttttagctatagcagacatattttggtatgtcatatatatgtatatattttttgcttaaaatacagtgtgattttaaatttttgtttttgatctatgaatttaaagttcattaaaaaaatttctaaacatttagaaaattttctagtttttcttattgagttataatgtaatttaaaagtggttagaacgcatactctatgtgattagaatcctttgaaatttgctctgcagtgttctgtaaatatcagttaggtcaagttcaaaatcttgtttaaatcttccatatccttactgtcatttcctgagggaggatttctttatttctttcagtttttgctgataacaaatgtacagttattatatcttcctggtgattaactcattcgctattatggagtgttcccatgatctctatagtgttttttgatttaaattttccttaatctgatattagtggaactactccagctcttttttattagtattttcattaaatatcttattctgtccttttcgttttagctttctataagcatatggtatgtttactgttcagtagaatataattagattttgttttttaatcagttaacatgtaatgatgttactacttgttttatatttgttttgctcattttgtgttgtttttctctcatttcttgcttcttcttcgattaatggaatattttaaatcatacctcccaattttatcttcttttatgtgttcccctggcaattaccacatgtatccttggtaaatttatattttgccaattcccatttacccaatttctaccttttttttttcattgctgtcatatattttagttccatttatatttgaaaccccaacatatatattgtacctatttatttaggtttacccacatatttgtattttctctgctcttcacattcatgtacttccctttgggatcattttccttttgacttaaaaattccctttaatagttctttttaatatttagagacaaagttttgctttgtctctctggctgcagtgcagtggtgtgatcatagctcactgcagccttgaattcctgggcccaagtgatcctcctgcctcagcatcctgggtagctaagactatagctgtgcaccagcatgcttggctaatttgtaaattttcttgtagtgacggggttttcctacgttgcctaggctggtctcaaactccaaggctcaaggagtcctcctgcctcagcctcccaaagtgctgggattacagttgtgaggcactgtgcctggccctctttagtatttcttcagtgtaagtctgctgataacaaattatctgattttatttgtctgaaaatatattttttgaggtcctaaaattaaaaaaaattgaagtatattatggtatacacacacacacatacacacacacacacacttcagtttcaaaaaatatacacacatataactcgatggatttttacatttttttagggtacaaaacaagcaatagcattttattgttatgccatttgaccatagcattctttttttattttttatttttttatttgagatggagttttgctcttgtcgcccaggctggagtgcagtggtgcaatcttggctcactgcaaccactgccacccgggttcaagtgattctcctgcctcagcttcccgagtagctgggattacaagtgcccactaccatgcctggctagtttttgtatttttagtagacatgtggtttcaccatgttggtcaggctggtctcgaactcctgacctcaggtgatgcacccatcttggcctcccaaagtgctgggattaacaggtgtgagccaccatgcctggccttattattattattttttttaatttttgtgggtacatagtaggtttatatatttatggagtacgtgagatattttggtacaggcatgcaatgcttaataattgcatcatggaaaattggatatccacgttatttcaaaatggacattcaagcatttatcctttgtgttacagaaaatccagttgtactcttagttatttcaaaatggacaactaaattattattggtcctttgtgttacaaaaaatccagttgtactcttttagttatttcagaatggacaattaaattattattgactacagtccccctcttgtgctaccaaatactaggtcttcgtcattctgttttttttgtactcattaatcatccccatctcctttttctccacatcctcaccagcatttgttattgcctgccttatggataaaagtcattttaactggggtgagatgatacctcattgtagttttgatttgcatttctctgatgatcagtgatgttgaccacttttttcatatgcctgtttgccattcgtatgtcttttttatagaaaggtctattcaaatctttagcccattttaaaaattggattatcagattgtttcctatagagttgtttgaattccttgtatattctggttattaatcccttgtcagatgagtagtttgcaaatatttcctcccattctgtgggttgtctcttcactgtggtttgattctgtctcttcactgtgggttgattgtttcctttgctgtgcagaagctttttaatttcgtgtcatcttatttgtccatttttgctttggttggctgtgttttaagaaatttttgtgcagaccagtgtcctggagattttcaccaatgttttcttttagtagttttatactttgaggtattagacttaaatctttaatccattttgatttgttttttatgtaaggtgagagatagggatcaaatttccttcttctgcatatggttatccagttttcccagcaccatttattgaagagactgtcttttccctaacattcttggcaccgttgttgaaaattagttccctgtatgtatgtggatttccttctgggttctttattctgtttcattaatctatgtgtctgtttttatgtcagtaccatgctagtttggttactgtagctctgtagtatcatttgaagtcaggtaatatgattcttccagttttgttctttttgcttgggatagctttggctattctgggtcttttgtaattccatataaattttaggattattttttctatttctgtgaaagaatgtcattaatactttgacagggattgcattgaatctgtagattgctttgggcaatatggatattttaacagtattgattcttctaacccatgtacattgaatattttttcagttttttgtgtcctcttcagtttctttcatcagtgtttcatcagtatattgatgtatgtgtgtgtgtgtgcatacctcacatgtatgtttatatacttcaattaaaaaatacacatagataacttgatgaatttttacatttttttgtaggggacaaataaataatagcattttattcttatgccatttgaccatagcatttgtgttctgtagttttcactgtagacatcttttacttctttggctgatttaaatcctaggtatttaattttatttgtggctattgtaaatgggattacttttttcatttctttttcagattgttcactgttggcatagagaaatgctactgatttttgtatgttgattttgtatcctgcaactttactgaatttgttcatcagtttgaataagtttttttgtgtgtgtgtgtggagtctttaggttttccaaaatataagaccatatcatcttcaaacaaggataatttgacttttttctttccaatttggacacctttcattctttctcttgtttaattgctctagctaatacttaaagaactatgctgtacttgaatattgatatctttctctagatttggaaagttcttattatccctttaataaactttctactcttattttctctaccttctctttaaggtcaataactcttagatttaccctttgaggttgtttcctagatcttatacatgcttcattctttttcattcttttgtcacctctgtgtattttcaaatagaccattttcaagctcactaattcttgcttctgcttgatcagttctgctattaagagactctgatacattctttaacatgtcagttgagtttttcaactctagaatttctgcttgatttttaaaaattattgtttgtttatttatttattttgagatggagtcacactctgtcacccaggttggagtgcagtggtgtgatctcggctcactgcagcctccatctcacaggttcaagcgattctcctgcttcagcctcctgagtagctgggactacaggtgcataccacgcctggctaatttttgtatttttaatagagatggggttttacagtgttggccaggctggtctcgaactcctgacgtcagatgatccgcctgccttggcctcccaaagtgttgggattacaggcatgagccactacgcctggccccgtttttaattattttaatctgtgaaatttatcttatagaatcccaaattccttctctgtgttatcttgaatttctttgagtttcctcaaagtagctattgttttttaagatggactgtcactctgtcacccaggctagagtgcagtggcacgatctcagctcactgcaacctccgcctcctaagttcaagccattctcttgcctcaaccttctgagtagctgggattacaggcgtgcaccatcatgcctggctaatttttgtatttttttaaaaatagagatagggtttcaccatgttggccaggctggtctttgacctcaagtgatctgcctgcttggcctcccaaagtgctgggattacaggcatgagccactgcacctggccaaaatagcttttttttgagacaaagtctcgctctgttgcccaggctagagtgcagtgacacgatcttggctcactgcaacctctgcctcccaggttctgtgattcttccatgtcagcctgctgagtagctgggattacaggcacccaccaccacccctggctaatttttatatttttagtagagatggggtttcaccatgttggccaggctggtctcgagctcctgacctcaagtaatccacccacctcggcctcccatggtgctgggattacaggtgtgagccaccgtgcttggcccaaaatagctattttgaattctgtgtctgaaatgtcatgtgtctctgtttctctaggattgatccccagtgccttatttagttcatttggtgaggtcaggttttttggatagtgttgatgcttttagatgttttcggtgtctggacattgaagagttaggtatttattgtagactttgcagtctgggcttgtttgtacctgtctttcttgggaaagcattccaggtatttgaagggacttgggttcaaaggccaataacacagtggtttttgcagtcttatataggtattgtcttggtggtcttggataagatccaaaagttttctctggattaccaggcaaaaactcttattcttttactttactttcttccaaacatattgggtctttctttctgtatcgagccacctggaactctggggatttggtgatacaagcacccctgtggccaccatcactgggactgtgctgggtcagacctgaagccagcacagcactgggccttgcccaaggcccttcccttcagggtggtgagtttccccaggccccgggtgtgtccagagatgctgtctggtagcctgcgattctagttaaaaaccttagcaatctacctgatgttttatttttactacgtctgtgctggcattcaaaccacaatacaaaaagttcttcccgctcttctctcccctttccacatgcagaggaggagcgtctctctgtggccagcaccatgactgttccatgagcagttctgccaggccacaccaccagtgttcacttaaagcccaagagctctttcatcagcttgtggtgagtgctgccaggcctcggactcacccttcaggcagtgggcccccctctggcccagagccggtccagaaatggtgtccaagaggctggacttggggatctgaaaagcctgccttttgttctgtcccactgtgatacctgaaagcaagacaaagttccctttacttttccctctgcttttctcagacagaaggagtctttcacagtggccaccacaactgggaatgtgctgggtctcctttgaagcaagtagtctcagacctcaaggcccacagcatactccctgggtattgctggtgcccagtggcaattcattgcccaagaactctttagtcagcaggtgatgagtcctgccaggactggatccttctcttcaaggcagccggttcccttttggcccagagtgtgtctagaaatatcattggggagctagggcctggaatgggggcctcatggctctgcctggtgctctgttctagtgtggctgagctagtatccaagatgcaagacaatgtcggggctgggcatggtggcttacgcctgtaatctcagcactttgggaggccaaggtgggcagatcacctgaggtcaggagtttgagaccagcctggccaacatggtgaaaccctgtctctactacaaatacaaaaattagctgggtgaggtggcacgtgcctgtggtcccagctactcgggaggctgagacaggagaattgcttgaacttgggaggcagaggttggcagtgagctgagatggcaccactgtactccagcccaggcgacaaagtgagactccgtctcaaaaaaaaaaaaaaaaaaaaaaagatgcaagacaaagtcctctttactctttgctcttctgttcttaagcagaaggaaggagtcagtctggttcctgtgagctgcactgcctgggttgggggatggacagctgatgcctccctaggtcatgagcaaccctagttcactggctctaagcactaggagttgcctaggaattggagtccttgttagaacccaacttgactgccattcaggtttacctaggaccccagagcacttcagcctgcagtggtgatgcttgctgggaaactcgttctgacttgctgggatgggtgactcccctttggctagagctagtcaaatgcccctccaagcatggccactggctgagcccagcagggcttcattctctgctgtgacagggcagcactgagtctctgcgctttccctccctgaagtatattctctctctctacctcatggccattgccagggaataggaaataggggtggcatccatgattcaagactgtctctcctgtcttcctcaatgcctttttttcaagatatgaagttaaaaccaggtactgtgattgcttacctgagttttggttcttgtgagagtgcttttctctttgcagatagtttttaaaatttgctgttccagcatggtgtgggagagcttgaatggtgtaggcttctattctgctaccttgcttcacccctggccatagccagatttttacatttgtatgagtttgtataaaccatcaagcagatcaagatatagtacatttctagcattctgataggctcccattgcccccccccaccatgtgaataatcacttccttgttaactattctgacttctatcaccatagattttttttgcttgtttttgagttttatgttaatggaattatgtaatatatactctggtttctggcttcttgtgctcaacagtacacttttgtaattcattcttgtttttcactggttcacagtatttttcttaatatgaatatgtcacaagttatttattaatggtgttcaagttgtttatggtttttggccattatgaataatgctgttagaaacatttttgtgcatatcttttgggagctatgagcacttatttgtgtttgatacaaatttagaattgctgggtcacagggtaggcttatttagctttagcagataatgccaaataacttcccaagtggttaatgatttatattcccgtcaacagtgtataaaggtcccagttgctttataacctcgctaacatgggtctttttttttttttactttagtttttttttggtgagtgagtggccgtattgtgttatttcatttcgcatttcttgatagcgcctacatttgaacacattttcatatcacctcacatcacttagatatcctttccatgaagtacacattttggggttgggtaagtaggagttgcatgggtgagttgtctgacttatcgtcatattctagattcaaatctgttgttggagatgtgcacacgtgtgtgtgtgtgtgtgtgtgtgtgtgtgtgtgtgtgacaaatcttttccgtggcttggcatttccctctctccaaagatcttgtattgaacagaaattcttaatgttaatggagtgcaattaattaaacttttacttataattagtgatttttgtgtttttaagaagtttttttctaacctcaaggtcatgaacatattttccaataattaaaataaattctttctttgatctttcaagacaaacctttcacatttagatgtctcatctctctggtattgactgttttgtgttttctgaggtataggtcaaagttcactttattctttgtggtttctgattattgtttgttttaaagactacctttttcacatttaattgcaaagaaacttttaagttgggcccctatgtgtgccacttattaattttttaaaaacagttttcaatgtagaagtcttttttaaaaacagttcttaaggtcaggggtacacttgcaggtttgttaaataagtaaacttgtgtcatgggcatttgttgtacagattatttcatcgccctattaagctcagtacccatcagttattttttcctgatcctctccctcctcccaccctctgtcctctgacaggtcccagtgtgtgttgttcccttctatgtgtccatgtgtactcatcatttagctcccacttacaagtgagaacatggggtatttggttttctgttcctgtgttagtttgcagagcataatggcctccggctccatccatgtccctgcaaaggacatgatctcattttttttctgtggctgcatagcattccatggtgtatatgtaccacatttaaaaatctagtctaccattctgggcatttaggttgattccatgtctttgctattgtgaatagtgctgcagtgaatgtatgtgtgcttgtgtctttataagagaacaatttatattcctttgggtatatacccaagtaatgggattgttgggtcaaatggtgtttctgtttttgttctttgaggaatatttttcaatgtagatgtcttgttcatgtttcactaaatttatgggtctgatttcttttttttatctgccccaatccaattctttttttatttaatttttttgagtctgatgttttttagtaagctagtaaaggatagttttagaattctattttttattttcttgctgtggtagaaatacaattggctttaaaaatattaatcttttatttaaggaacttgattatattaacttcttctagtttgtacataaattttttgaattctctatatgttcatcttgatcttcaattaatgatagcatttgttcttcccaatatttattccttttatttctttttcctctattattgtaatagagaagatctttaataaaatgttgaatttaagtgctgaaagtgggcatcatccttgtctggtttgtgaatcaggagaaagtgttcagcattttactaatgattaagaagtttgctactactacttttcaaaaaaatgattactctttttccttcttgccctagtctgtagatagcttttatcattaataggagctaacttttatcaaaagctccatctatatctgttttgatatgattttactatgatatttggctaatattgatattataattttcaaatataccaatattacagtactatagaaattcagttggccttttaatatatagttgggtttgatttgctgatattttgtttataatttttttgtttatgtgcatgagacagattggcctttgtctattttataatcttacattttggaacgatattatttaagctcataagacaatttggaaagtgttttttctcaattctctgaaagcatttgtgtaagattggtgttatttctttttaataatgccaagaagacctcactggtgaagccatatgaacaaggagcacaaaatctttttgttgtttgtttagatcttctgaggaaaattttacatacattgaaataccctaattgtatatatacagttccttgaggttttggaaaatggatcacccttatcaagatacagaatatttctgtcaccctgggaagttttcttcctcgttggttccccacagcttccatcaaatggcaaccgctgttctgagttttaactgtagattaattttgactgtttgaaaatttcatataaatggaattatacagtatgtactcttttgtgtccacctttcactcaggataatgtccaagactcatccttgcaattgcatgtattaatcgtttttattactgagcagtataccattttatcaatgttccacagtttattcattttcctattgatgaacatttgtttccaattttttggctattagaaataaagctgatatgaatattctcctacaggtttttatggaaatatgtttttgttttctttgggtaaataaccagaagtggaactgctatgctaggcagtagttgcatgtttaaatttaaaagaaactggcatactacttccagttggattgtaccatttttatattcctacttatgccctgttcttgcctaatattttttgttgttaatattaattttagccattctagtgggtatgtagtggtattctgtggtcttaattttcattgttgtttgcatttgtgttatatatcagcataatcatggggtttttgtgtgcctattaaccatttttatatcttcctttgtgaggtatatgttcaaattttttgctcagtctttagaaattgaaatgtttgtatttttattgttgagctgtaggagttctttgtcagatgttttagcaatattttctcagactgtgtggtttgttcattttttaaaaaaattatcgtttagagcagaagttttcaattttgaaggtataattttatcaattgttttctattacagttagtattttctgtgttctaagaaatccttgtttatactcagatcacaaagatatctatgttttttttttctaaaagccttctatttttagctactatatttagattggtgatccatctcaaattcatgtctgatgtgatatcggcattgagattcatttttttttttgtatttgtagccagttgtttcagcaccatttgttgaaaaggctgttttccctttattaagtcattttagcaccttagtaaaaagaccatgtgctctattgctgtcctctctattctctttatctcattgtctgcctttatgctaataccacagtcttgattcctatagctttatactaatgttgagattgtgtaatgaactctgagtgtatggagtcctactttgttctttttcaagattgttttaattattcgaagacttttgcattttagaatcaatatatcaatttttataaaagcctactgatgtaattgagtatgcactgagtacatagataaattttgggaggaccaatatcttaataatgttgagtctgttagtctctgaagcagatatttctctttgttttttgaaggtctaacttaattttctcaaggatgttttatagttttaatgtataggtcttcttcatattttcttaaatttattcctaagtatttaagttttttgactctgataaatgatatctttaaaatttttacattcaaacactatgctgctaatatgtagataatatagttgatttttgtatcagactttatttcctacctactaaagtcatttattttttagtagttttgttgttattttggtccctggtttcttagtttttctgtgtaagcagtcctgctgtctgataataggattttcagaatagggacgcatcctttttactttgtagactttctatttctttgtcttgacttactgcactagctcggacctctaatacagtgttgaaatggtgtcacaagggtggacatccttaccttattcctgaactgagggaggaagaattcagtgttttactgttaagtatggtgaaattattgttaggcaatattttggtaggtgccttttatctgattgaagatattgtcttctgttactataatagtttgctgagcatttaaaaaatatagttattgataggtgctgaattctgtcatatgctttttctgtatctattgaaatcattatatggattttttctttcagttagttgacatagtggattactttgattaattttttaatagactttatattttagagcagttttaagttcacagcaaaattgagcagaaaatacagagttcccgtatacctcctgttcccacacttacccaatcttcatctcccaaaacactgaaccagaatggtacatttgttacaatccaggaaactacattgacatattattattacccaaagtctgtagtttaccttagggttcactcctgatgttgtacgttcagtgggttttgacaaatgtatgttatgtatctgccattgtagtatcaaacagagtagtttccactgccctagaaatcttctgtgctctgtctgtttattcatttctccctcaccactgacccctggccaccactggtctttttttataatctccatacttttgccttttccagaatagttagaatgatacagtatgtagcctgttcagattggcttttctcagtaatatgaatttatggttcctctacatctttaaatggcttgatagctcttttctttttagtgctgaataatattacattgtctagatacactgtgtgcattgaacattccatgtacacttgaaaagaatgttttttctacatttattgtttgttgtgttttatacatcagttagctctagacggttgatgcagtcattaagctcttccataatttcctaatttttgtttagttctgtcagtgctgagaagagggttttaaagttttcaaatataattgtgggtatgtctgtatttccctgtagtttcctctctttttattttatgcattttgaaacttaattggtgcatacatgttccaattgttcatctttcttatacactgagcctttaatcatgcaatgtttcccttcaaggtagtactcgttgtcatagtctgatttgcctcagtatagccagctttcttatgatattaacctttttcatatagttaggttttatattttttacatattctgataatctgtattttaagtggactgtttagactgtgggtcaacaaactttttctgtaaagtgacagtaaatattttagatttcacagttcatatgttctctgtggcaactactcttctctgtcattgtggtgtgaaaactagccatagacagtttgcaaatgaatgatggatgtggttgtattcaaataaaattttatttttaaaaacaggtaatggaccagatttgaccttcaggccatggtttgctgaaacctggtttagatgtcgtgtttgtttgtttgtttgtttttttaatgagacagggtctcgccagtgtagtggtgccatcatagctcactgtagcctcaaactcctgggctcaagctatcttcccactcagcctcataagtagctgggactacaggtgtgccccaccatgtccggctaattaaaaattaaaaaaaaaaatagagatgggggtctcactttgttgcccaggctggtcttgaactcctggcctcaagtgatcctcctgcctatgcctcccaaagtgttgggattacagacatgagccactgtattccgctagaaataaaactttttttttttttttttttttgagacagagttttgctcttctttcccaggctagagtgcaatggcacgatctcagcccactgcaacctccacccctgggttcaagcaattctcctgtcttagcctcccgagtagttgggattacaggcatgcaccaccacgcctggctaattttgtattcttagtagagacagggtttctccatgttggtcaggctggtctctaactccgacctcaggtgatccgcccgcctcggcctcccaaagtgctgggattacaggcatgagcccccgcgcctggccaataaaacttttaataaatggtcctgagacaactggataaccatttggaaaagtccatttgtggaacaagttaaaactcttacatattccaggacaaaccacagatggatcaaaattcaagtgtaaaaaataagagaaacacaacccaaatatctgacattaggcaaccggttgaataaactattggtatagtgatagaatagaataccgtgtagctgcagtcaagaaagttcactgtacctatgtagcgcgatctccagaatgtattgtaaagtgaataaaataagatgcagaatagtatttaagtgtgtcttttttttgttaaacagaggtaggtagaaatattgtttacacttgtatttttatacagtaacaataataggtagtcgagggaatggggtagacaggagtgggagtgacacttataagtgggagcctttttatttttgttctgattttttaaagcatgtaaatgtattactcattttaagataccatgtaataacttttccagattgagctgaattcatgcaagttccatgaatcatttaaggaagaagtaattctaaacttaaacttccccagataatagaagaagaaggaccattgcccaagtcattttatgagactagaatgaccttgattctaaaacctgacatgaagcaacataggaaagaatacatatgagacgctttttttttttttttttttttgtggagaccgggtctcattctgtcatcgaggctggagtgcagtggcacaattacagctcactgtagcctcgacctcttgagctcagttgatcctcatacctcagcttcctgagtagctggtaccacaggcatgtgtcaccacaactggctaacttttgtattttttgtagaggtggagttttgccatgttgcccaggctcgtctcacacctcggtctcccaaagtgctgggattacaggcatgagccactgtgcccggccttatatgatatgcctctgtcacaaaagtcgggatcatggttaactccattggaaaggtgggggttgtgatcgggtagggctgtaggggcagggttctgtgttattgcatgttctatttcttgatctgagttttagttatatattgttcactttatcattgtataaacataatttgttttgtagttgtatgtaggtatgttatgatcaattataaatggtataagataatttaaaaaggtttaataattatggaacatatgtcttacaaattatttttaaaatatatacactaacacttgatagatggaacttgtatgaggaaatacaaaaactttgaatagtttaagattagcacttttaatattcctatatcataaattgataagcagataaaaaatcaagacatagaggtatttgttttttttgaagggagaaacttttaatggcacagttattccaattccacgttaagatgattggtaaagtagtgatttttaaaaacagcaaaagctggtttctcccaaattagtttccccaagggattagaggtcagtctgtcattcagtcaaatctatatccagtagggaccacccagttttgttttaggctagtctgttgggatatatagtctgcaactagcagagttgcagctctaacaagtgttagaaatgttcattcacagaatcacctgaggtacatagaaaataaagcttctattaaaagaattatgctacagaaaagaacagagaggatatatatacaacacaggaagactcagctgattcagggaccccaggagaaagtggctttcttcatttaaaaagctacttaccatctctcctgttaacttattccaaatctagaaagaaagtacttgccaagagatactgattatatatgggaatttaaatcctccttgttaggaattccactagcaattcttttggaaaacctgaaatcaaaccatttaggttctcacagagttttactctctggagatgctctggttgggaggttggttggagtaggagttggagcagcaagcattgcgtagaatgctagtctgtgtgaaagtccttattaggaaattaaaagggttcactttgccttgtcagcggtgaaaatcagccctcaaggaggctgagaggtagccaggtttggagttatttcctttgttagggaactctatctaacccccaaaacataattcaaatagtatacacaaaagtttggtttagtccagttcttcaggccctgaagcacattagccattgtctaaactcttgaattatatctgaactaaaagaataaaaggacttctcacccatccccacttgctatattcaacttgccatatttaaaaaaatactcaactcgccatatttaagaaaaaacttttgcaggactggctggacagactacatactaaaactttttctagtactgatcagtgtgtgagatttctaaccaggatttctgatttgattccatagtggcctttttctgagagaattcgaagaaggcattgtcaccctagtcagttttctaggaattgacagtcagccagtagggggtggcagtcttcattctcccagaccaggctgcagatggtgtaggttctcctcatttctttggtgtcatgttggacccttcagactttgattgctggaaatcagcatacacagagaaggctccatctgctggaccattcttgtaaatatcagccatgatctctacacttgaaggtttactgtaaaacagaggtgtccaatcttttggcttccttgggccacattggaaaaagaattgtcttgggccacagataaaatacactaacactaacgatagctaatgagctaaaaaaaaaaaaaaatcacaaaatctcatactgttttaagaaagtttacgtatttgtgttgggtcatattcaaagccgttctgggccacatgcggcctgtgggccacgggttgggcaagcctgctgtgataaccattgctgtagtgcttgtcatctttgtaggaaggcgtgtagtgaggcttacaaattttgaacttgggaatgtctgtctgcctccgtcacatgggagctgagagccatattgaaatggtgctcacgtggtggatagaatagggtcttcaggctacgtgggagtcatagaggctacctgagagagaacaggcttttcttggttcagaaattctaggtttgagaaggaaagcctacatacagccatctccacactgcacaatagatgagcagttttcagcagacatctccacattggtgttcttattggtctaaatgtacacctggtcagaaatggttttcatggccccagatgttcaggaagagctacatgaactctgttgatgatgtctttttaattgttagacattttggccactgttcctggatcagcattttttgggcagacccattttcttaacaaactgtactctctgaggcagcttggatctatccaggaaagtttccactagttaatttgcatagctcatgttggcattatggagactcaacagtttatctgcagggtgtgaaattggggtattagtcagcaccgtaaggcagaaaaggtggccagacccactctttgggctctggatcctggatttactgaaaccgcagataccctgagcctgaagatgccatgtccagtcctaatacctggttcctggaacccacctccaccactgttgccacttgaacaacataaaaaaatattttaaggacatgttatcttgctgaacctaaaagataaatagagaattctacatgctgcagagactacacattcttttctagcttatttatgtatttatttatttaaaattgagacagagtctcgtcctgtcacccaggcaggagtgcagcagtgtgatctcggctaactgcaacttccacctcctaggttcaagtgattctcctgcctcagcctcctgagtagctgggattacaggggtccgccaccacgcctggctaatttttgtatttttagtagagatggggtttcaccatgttgaccaggctgatctcaaactcctgacctcaggtgatctgcccacctcagcctccaaaattctgtgattacaggcgtgagccaccgtgcctggcccaaaatggctctttgaaagggttaataggatatttaaaaattgttggggtcttgggaggaaaatcacatgattatttcaataaaggaaaaacataactttgataggtatatgttacaagaactcagaaaataggaataaaggggaatatccttaacttgataaaggatttatgccaataacctaaagcaaaccttttatggagaaactttagatgcattctgtctaagatcaggaacaggacaaagatggttaacactattacagctttatatgttactggaggtcctagatagtccattaagaaaagaaatagaggccgggcgtggtggctcatgcctgtaatcctagcactttgggaggccaaggtgggcggatcacaaggtcaggagattgagaccatcctggccaacgtggtgaaattctgtaacatctctactaaaataaaaataaaaataaaaaaatagcggttctaagatggccgaataggaacagctccagtctgcagctcccagcgtgagtgacgcagaagacaggtgatttctgcatttccaactgagcacatggcacaccaggacatcatatcccgcacctggctcggagggtcccacgcccatggagcctcgctcactgctagcacagcagtctgagatcgaactgcaaggtggcagagaggctcggggaggcgtgtccgccattgctgaggcttgagtagctttgaagggagtagtgcttctcccagcaaggagtttgagatctgagaatggacagactgcctcctcaagtgggtccctgacacacgagtagcctaactgggagacacctcccagtaggggccgactgacacctcatacagccgggtttccctctgagacgaagcttccagaagaaggatcagacagcaatattagccgttctgcaatatttgctgttctgcagcctctgctggtgatacctaggcaaatggtctggagtggacctccagcaaactccaacagacctgcggctgagggtcctgactgttagaaggaagactaacaaacagaaaggacatccacaccaaaaccccatctgtacatcaccatcatcaaagaccaaaggtagataaaaccacaaagatggggagaaaccagagcagaagagctgaaaattctaaaaatcagagcacctcttctcctccaaaggaacgcagctccttgccagcaacggaacaaagctggacggacaaagctgcaggcatcacgctgcctgacttcaaactatacacaaggctacagtaaccaaaacagcatggtactggtaccaaaacagagatacagactaatggaacagaatagagcccctagaaataataccacacatctacaatctgatctttgacaaaccggacaaaaacaagaaatggggaaaggattccctatttaataaatggtgctgggaaaaccggctagccatatgtaaaaagctgaaactggatcccttccttacatcttatacaaaaattaattcaagatggattaaagacttaaattttagacctaaaaccataaaaaccctagaagaaaacctaggcaataccattgaggccatggcatgggcaaggacttcatgactaaaacacgaaaagcaatggcaacaaaagccaaaattgacaaatgggatctaattaaactaaagagcttctgtatggcaaaagaaactatcatcagagtgaaaggcagcctacagaatgggagaaaatttttgcaatctactcatctgacaaagggctaatatccagaatctacaaagaactcaaacaaatttacaagaaaaaatcaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgggataccatctcacaccagttagaatggcaatcattaaaaaaatcaggaaacaacaggtgctggagaggatgtggagaaataggaacgcttttacactgttggtgggactgtaaactagttcaatcattgtggaagacagtgtggcaattcctcaggtatctagaactagaaataccatttgacccagccatcccattactgggcatatactcaaaggattataaatcatgctgctataaagacacatgcacacatatgtttattgtggcactattcacaatagcaaagacttggagccaacccaaatgtccatgaatgatagattggattaagaaaatgtggcacgtatacaccatggaatactatgcagccataaaaaggatgagttcatgtcctttgtagggacgtggatgaagctggaaaccattattctgagcaaattattgcaaggacagaaaacaacaccgcatattctcactcataggtgggaattaaacaacgagaacgcttggacacagggtggggaacatcacgcactggggcctgtcgtggggtggggggagggaggagggatagcattaggagatatacctaatgtaaatgacgagttaacgggtgcagcacatcaacatggcacatgtatacatatgtaacaaacctgcacgttgtgcacatgtaccatagaacttaaagcataataaaaaaaattattagctaggcttggtggtgcgtgcctgtagtcccagctactcaggaggctgaggcaggggaatcgcttgaacccgggtgtcggagattgcactgagccgagaccacgccactgcactccagcctggtaacagagcaagactctgtctcaaaaaaaaaaaaaaaaaaagaaagaaagaaaaaagaaatagaaatcagttagcaggattggacaggaagagataaatctttaagtattaatagaccacctacacataaaaatgtatagatgcaatagataaaaattttgttaataagataactgagtattttcagttaagggatcatcttacaaaaatcagtagaattcctctgtattcaaaataattaactagaagagatgatgatacaagatgtcattcacaatagcaaaaacaatcatgtctctaggatctgggaattaacctaacaatgcataagatctacatggaataaattttaaactctgttacagtattattcaaaagacttgaaaaccagatacaccctattcaaagatagtacaacatatttgtaacgatatcagttctccctaatctataaattctatgaaatgtcaatcaaaatccagtggaatattttgagaaatttgaactattaaataatttatgtggagcttctgattctgattatgacacttttgcttatattacaccagctgttctgctgaaaacaactagaaaaccttgactaaagtataaatttatctgtttgaaggtataagaactatgaaatcagagaggtaaactcccaacattcagccctacctttctctttcaggcagttgccattacctaggcagtagcagaacagctagaaatctcataggcaggaaaaacataacttggagttcaggtttcagtaaagagtagggctctgttaagtatcctaggtattcagtttcgatccttgaaggcctatcacctttaggtgtaaagacaaatggaaacgagtctgccattgtaagacagaaactcagttgcaatcaaatcagttcttaagactccatgacaggataaatatgaaaattacacccagacacataatcagtaaaacttctgaaaaccaaagataaaaaatttgttaatacctagcagaaaaaggacatgtaatttccagaaagcagtaagacagttcacttctaacagaaatgatagaagttgaagataatggaaaaatggcattttaaaactactgaaagaagaaaagccatcaatctaagactttatgcccggcagcagtatctttaaatgaaggcaaaaaccagaagatattgctaaaagaagacctaggcaaacgaaaagacattgcatattcatggatttgaagacaatatttttaagatggcagtattacccaaattgatctacagatacagtgcaatccctataaaaattcaaggtacctttctggtagaaatggacaagctgattttaaaatttatgtagaaatttgagagttccagaatagccaaaacaattttgaaaaagagcaaagttggaggactcacacttcctgatttcaaaacttactacaaagcaatggtaatcaaggttgtgtggtactggcataaggctcatatataaatcaagagaaaagaattgaaagtccataaataaatttttacatttatggactattggtttttgacaagggtgctgaaaccaaggaggtaaaacagttttttttccaacagtgtggggcaactggatatccacatgtgaaagaatgaagttggactctacttcataccatattcaaaaattaactcaatatagatcatagacataaatgtaacagataaaactatgaaactcttagaaggaaacataggtgtaaatttttgtgaccttggcttaggcaatggttcttaaatatgacacgaaatctcaggcatcaaagaaaaaacaaaaaataagatttcatcagagtttaaaacttttgtgcctccaaaaaacaccatcagggaaggaaaaagacaactcacagggtgggagaaaatatttgcaaatcatgtatctgatgagggcccagtgtctgtgttaaaagaactctgcaactcagcaataaaagcacaacctaatttaaaaattgatgagtgatttggatagctgtttctccaaagaagttatacatatggacaatatgtacatgaaaagatgctcaacatcactggtcattagagaaatgcaagtcaaaactacagtgagataccccttctcacccactgagatggctgtaataggcaagacagtaacaagtattgatgaagatatagggaaattggaaagcttatgcattgctggtagaatgtaaaatagtgtaaccactttgtaaagaaattagagagttcctcaaaatgttaaacatagaattaccatatgatccagcaattctactccgacatgtgtacaaacgcaagagaattgaaaatgtaggtacacacaaaaacttgtatatgaatgttcatagcacccttaatcataatagctaggaagtggaaacacttcaaatgtccatcaactgatgaatgcataaacaaaatgtggtatatctgtatgatggaatattatctagccacacaggaatgaagaagtactgatacatgctacaatatgaatgagccttgaaaacatggtgagtgaaagaagtcagaacaaaaagccacatattgtatgattccatttatatgaaatatctgtaggtttgttacataggtaaacgtgctatgatggtttgctgctcctgtcaacccatcacctaggtgattaagctccacatgcattagctgtttatcctgctggtctccctctcccggcctgcccccacctccccaccccataggcctcactgtgtgttgttcccctccctgagtccatgtgttctcatttttcagctcccacttataagtgagaacatgcagtgtttggttttctgttcctgttagccaatagaacaagtagacaagaatcagtaatggataaaggatatgaacaacctcaacataattgacatagaacattatactgaatcactgatgactacttgtttcttgttcagtacacatggaacatttatcatttactagtgtatagacatgcagttgatttttttttaatatggaccttgtatcctgtaactattgtaaatccacttagttttaggacacagtttttgtatatggtcccgtgttagatttccgccttctatcttgtctaacctttatttcctgtctttaccagttttatggtcaccagagggaaaattcaaagtctccaaagtttggcagaaagcatcagagtgaaggccagctatgatgcctggatatccattagtattcttagatgcacttaattttgatgccatgccagtttctttcatctcactcagaaatgtatttaaatggttattttaacagtttctcacatttatgatatataggaaagtaattcaatgtatctgatcttccatactgacagaagttgaagtttttgttttttcatatgaatgttagtctcaacttgtctgcttaaaaaagtgttattttcattgggataatttgaaatttacagatgaaaggagaattgaagtccagtcctctttggattacaatgtgatttataagttcagagaagagagatggccagttttataaactttttacttgtttcttacgttccttactagatttttttagtagctgttgacgggatattttctactatgtttttttctttctttttcttgaaaaatatgaaaggcatttgtttatatatcctacttcattaatattaattacctttgttaccagctaccttaacaaattaccttgtttctagtagtttcctttttgtttattttatacttttttagttatgcaattgtgtcttctaccaaaaataataaaattgggagtctgtacattgagtttccctattagctctcttgactccttgagtttttattttcagctttaactctctatgtaattgctcttacctgtgcattaattttattctgcagtgtagtttctccattttcttttctctccatctaaccctattctgttcatccttagatttcaggaattctttaaaatatctaatcagctgatgttactcttactactttccagtttattatggtttatttttgacaacttatattgtctgtcatctcatgagcttgaaggtgggagggaagtaaatgagtctagtttgccatctcaaaacagactctatttagactatttaaatactaacttaaaaagaaaacatcaacaaaagtcaatgttcctggctcttattcttcagtaactgaatatttcttggctggtcttcgcagctgaggttctttatactgcttcagtgtttctgtcctttgagaacttcaaatctttcctgtttctgcctctacatgtcattgatgaaagtcttcattccttgtaccatagatcctggaagttttgatactttccatctatggactatgatataattgcatcctgtttgagctgtaaggaggtgaggttcaaacctcttctctttgcttctgggttttaactagtatactagagctagatcaggttcaaaattaccggattttctgttaaaagagatcaagacttaaacctggagccaaactggagatttccaattattttctcctaaatgcaaagttgggttctgacttggaatctcggagtagactccaagtatatgtatccagctagctgacttaaggtttccagccagccttacaaaccaattggctagtggaacagagaacagtattgaaatatgggcatccaggccaattgcaagaggacagatcttgagtcctaatccatttgagtttattacaaggacagaagtgaagtgaaagggaattactcatttttgtttttcaacatttgcctcttgaatcaagagagagggtggagcctctcttgcttgtgaggcagggtgtttccacatactcgtaacttgaactctaggaagaaaaaggtagcaggataaattttacagaaaagggaagtagagcagcatgctttgcccaagcactcatctcctttgatacagttccttcagatactttgaaatgactaatgcattatatttaaggccactagtactagtcattgtgttttcaaggaaatcagaggtattccctgcttcactaaatgtatttgtcatgaccaattgcttctttaaaattatcccatatttggaaatcagtgaaagaattgcggcagaaagaaatcagtgaaggaactgaatacaagaataaagtcaggagatgaatgagtttatgaaaatgggaataaagatataaaatacttttattgttctaatggggagatgagaacacctatacaacttcttcctggtatttatacttaacaactattaaattccttatttatgtgtttaatgtttgtgttcaccaataaagtgcaatctctgtgaggccagggagtgaatttctcttatttgttttattccctacttagaacagtgcttttaaatgtaattttttaaatcaagggctaaaaacaggaaaatggagttctttttttctttcatgcttccctcttttgactaatgaaaataatacttattaatcatctactgtaatccagtaatttacatgcccttgagtagggttgcagtttaatcagcaagggggagaggtacacaggattgatacccacttctgtaatttgagggatatttttccaattttatttctattcacaggtaacaaaattgatgtagttttataaacattaatataatgaacttttcttaccaaatatttagtctttttcccatgtattgaaatatttctttgtaaatctgatttcttatggccccaaagaagtccattatgtggatatttgataatttacttaaccatttccttattgttaagctagaatgtgtgctccatgaatataaagattttttttccctctgttagctcattgcagtttcccagtacctacaacagtgtctagtgcgtagtaggtgctcaatatgtatttgtagcatgagtgaaagaatgtgctctattttttccatattataaatgccttataaaacgtttttgtacctaatgctttcactacacttcaaatgattttctaagaataaatttctagaagaggacttgccagttgaaaagacatagaaaaggttgtatgatttcaaattagttttctaatccacaataatgttacctgtggctatttttctttacactttaattttataaattttctataacatattaggattaaaagagttattttttttcttttaagtacatttctatttattcagagagcagtgagcagtcttctaactggaatataaggtttttgttggtggtggtgaaagatgaggcttgaaaggtcacagctgggtgtggtggctacacctctaatcccagcactttgggaggccgaagtgggcgcatcacctgaggtcaggagttcgagaccagcctagccaacatgatgaaaccccatctctactaaacatacaaaattagccggggtggtggcacgcacctgtaatcccagctacttgggaggctgaggcaggagaattgcttgaacctgagaggcagaggttgcagtgagctgagactgcaccattgcactccagcctgggcaacaagagcgaaactccatctcaaaaaaaaaaaaaaaggaagaaacatcacttgggcaaagcagtgaatggcttggtatgctatgctaaggacctttattctgcaggaattggagtcctataaactattaataagcagaatacaaaaacttcataaaataaataaaaacaaaatacaaaaaagcagagtacagatgccacctgtcttttgaaagtgttatgtcccagtgaacccactgtaaattaaaaataagtcttgaagatgcatttaatatacctaaccatcatagcctacctaccgtagcctagcctaccttaaacgtgctcagaacacttatgttattagcctacagtggggcacaatcatctagcaatactgtacagtgtagagtgtcggttgtttgccctcatgactgcgtgagagctgtggctcgctgcaactgaccagcatcctgaaagagtctcatatggctttctattgaattcatgttgtttttgcaccatctgtaaagttgaaaaattgaaaaatcatcagttgaactattgtaagttggacatcatctgtagtggtatagttagaactcttctagaaaggtaatagtgatagtgctgagcaaggattggttagagaaggggacaaagggaggtgctagatttctcactctctagtctccatatctcaccagtcactgactcagtatttcttcagtttcttcctctttttcttagttagatcctctcacctcaattactgctataactttccaatgtctttccctgccttaaaaccattctccacagagctgctagagtgatctagctaaaactatctgcgcagaatggttcccctgttatctgtatttttaaggttctagtttattaacatgacatacagcttctctgctctttggacccttcagcaccatttcttgctactccctgttgtgctctttatgttcctaggaaaggaagctgcttattgtcctgtgtatcttctcccccacaaatatttcctgcctgtgtgccttgcttatgctgtccctacttcccaaactatcccatcctcagtcacatccatttcagtccccttttttctggagttcactgtgtaagactcaggtgtcagccacttcatttaaaaaaacttttaacatacgtattcacatactatacactttcctcctctactcccactttggggtcaaggatctctcttctttactttttataggaccctgatttttatctctcctttccctgtagtactgttatggtactgtctgtgtactactgtttaggtgtgttttgcacaatggactgtgagaatttggggggcaggaacttgtgggggccaagggtccagcccttgttattggtccaacctttggctctctgaaagtttgctgaaaaatgaacatgcacaaggcagattaataggagaaaaggcatacaaatttatttaacatgtatccgcgggaacctgtatgatgaccccaaaatacaggggaaattgcccattcttatacttaggttcaataaagtatagacagctgtgtagaaatgtgattggagaagaaaaagggtatgatctaatgctaacagactgagtggggaaacccagcaaggcctgtgtgtctaaagtcttcttggcctctctgtgcagcattccttccttccaggtatggggcaggaccctctctggaacgggggtgtgatgacctacaatgaaacaggtaaaatctgatagtttttttgttgttgttgtttctttgtttgagacagagtctcgctgtgtcccccaggctggagtgcagtggcgtggtcttggctcactgcaacctcagcctcccgggttcaagccttcctcatgcctcagccacacgagtagctgggactacaggtgcctgcctaatttttttgtattttcagtagagatggggtttcatcaagttggccaggctggtctcaaactcctaactttaagtgatccgccttccttggcctcccaaagtgctgggattacaggcatgagccaccgtgcccagctatttttttaaagacaaggtctcattctgtcacccaggctggagtgcagtggtgcaatcacagctcactgcagtcttgaccaagctcccatctcagcctcccaagtagctgggatcacaggcatgcaccactatccctgactaattaatttttttttttttttttttttttttttggtagagatagggtcttcctatgttgctctggctggtctcaaactcctgggctcaagtaatcttccctctgcagcctcccaaagtgctgagattataagcatgagccaccatggctggcaataatttctttgtagccagtttttataccaaaaggctgagggaaaactagagtaatatttttaggttttatggctggctttgaggaaagggagttctagtttctgtgacctagagaagagggattctagtttctatggcttaccttgggggagaatgggactgagagacagagcaggagaaggtcaaagaaaaacttctgtgtctaatgcagctgagtccttcattttggagtattgttttctgagcccaacaaactttttattcagctttgtgttctcagcagttagcataatgtatagcatatagtaatgtggtaaaaaaaaaaaaaagcctattatttttctgttgaaataatgaggtcttgaactaggccaggggtagtgggaagggagggtgggtgggagaaacattcaaaaaagtcaactttggatgttagtgataagttaaaggtatgtaatttatagatgatgagatttgcaacttgagtgagtttggtatacagattgttgacttcttaaatttaagacatttgctgaacatgctagagagatgaccagtaggcaactacaaataagggtatagatagtaagagatagggatttaggagttgccagcatattggtattaactgaggctttggaatagataatataagtcaggaaggagaggagatgtaaaaaaggtggagtagagatccttggggaacaatatttaacaggttacagcaaaagaaagattagagaagtatattaattgtcagcagtgtccagtaatgaagaaagggtaaagcagatgagaattgagaacaatttatttggaaattagacagttgttattgaactttgagagaatagtttcagtctagtagagtgaaatagaaattagattgaaataggtgtttgaaagaggttgagaagcaaacaaatgatgagcaagtggaaaaagcaagcatgtactactctttcaaaatgtgctttttggagaaatgtgttgtggaaagggatgtggtatcagttccttgaggaaaaggtaaaatgggggtgacgtttttgttcatatttttgttcttggatggggaatggtcttggaaaagtttttcaattgatatccaggagaaagggggattgaaagcaggaaagaaatttttaatggaataaggacaggaagggaaggaaggagagggtttgggatcaagatgtcaaatgatactgttagccctgaaaagtggtagggttcaaaaggaaaagaggtatgaagcgcaaaaacatttagagttggcatgagggaatgtaaaaggtctgttatctataaagtaggcaaccaggtcattaattgctggtgaagagtagataggacaggaatgggatagtttgtggtggcagggtggcacaggacattttggaagattagtaaagttctgttgagagtgatagaattaatgttaggactgcaggtagatttgagggttcagctgagattgagctatggaaataaaaagcaataataaaaagacaaagtatatatatattcttatatatattattccttacataatatatatttccttatatataaccttattttatatatatccatatatgtatgtgtgtgtgtgtgtgtatatatatatatatatatatatatatataacatgactttttttcattaaagagactgaagaaaaaaagggatttgaaaaattacttgtagttgctcattaggatatgtaaggcagttacttaaggacagccaaatttgctctactgtcctgatacttggaagaattaaagaatggggtacagggctggggagttggtggcagcagagagcagtccagcagtctgtcaagtcctgcctggtcacaggtcagtgccatttaaacctccaggatcaagtcagagcacttgacgcatgactgataatatttgagatttagtgtgaggtgtctttttaaatttttttttggtgtgttcttgctgtatgtgtgtactgattaaaatatgtaaaataaaagcaacaggttgctggtaattaactctgttatttcaagacagaattgattttgtatagaaaggtagtattggctggattatgagctttactgcttattcattcctgatgaaaatatctctgctgggcttacataccctgtagtgtttatgaactagtaggtttagaaatgaagagaccctagagagataatcatttcctccaagatgttttgtcttctaccaggaatttgtcaatagatatataggcccagtgggtaggctcacctctgcatgaatatttgataggagcatttctatcagttatgctctttcttaaaaaaaaacatgaaaataaacgcatcatttatgtaactcttataagaaatgcataaatcatgggaaacagtgagcaagatataattgaaattcagcagctcagtgagttacgaaccttctctctacaactcaattgtgttagttactgcttaacttaacgctgggttttcctttttgctttcaggaaaacctttaacttacgccctgggtgttgcctgtcaacagtttcctggtggctcaccgcttctgcctgctccagccttgctccggcagcttcaaggcttctgggcttcagagcttgttgtgaaagcttgctgctttggcctgctacccctgcttcaggtgtcaaaagcttttaattagcttgcttcctctaattactataactaggcccttacgtgtctgcataatccagttctagggtctgaaaggagaattacctttagccattcattcttctttaaaagatcttttactttggccctcctggcattcatgggagagtaagaagttatattgcatgattcacctttgatggtgctagtcttcagtctgtaggggcaaactggtgtgggcatactgtattttatagccagtgtttgttctgattggttgatgcccatgctgtcccaattttaaagtattttgactattgctactgaatatataaattgtgtctccatagaaaggatatctctagctggtttaataaactctttgtagtgtttttagtttgcttattaaagataatatttagttccctcccccatttttaataaatattttgaacacaaattggtcgctcacagaacagtttttaaaaatgcagatacagtgatttctatacattttgtaatgatcaccattaacatgtgtcaataggtatcagaattataggtatgatgaatgggaagagctcttcagtacttatataactattcagtacttggagtagtaaagtatactagctctcttatcagacagccaggtacatattctggttctattacttattaattttgtcactatgagtaagttaattaacttctccaaacattagtttactaatttaagtggggattgtagaatctgctttagattggtgtaaggattaaatgaggggtaatatatgtaatatgcttagcccagtgctaggcacagaataagctttttataaataagagttattttttgttattattattaatcataaatgatagtagatgatatgtaggggaaattaaaaggtgaaaaagacaataagtaatgagcagcaacagacaaaagatattaaaggccaagttgtgaagtcaggacttcgatgcctgttaagagagcagagtgagctggaataagctgatagatgtttaataaatcacaaaatacacagttgtatctcttttgtcataataccttatttttgagttttagtgtcagtttagttgtatacttgcagctgagaatattgatgctgtaaactttgcatgtatatacacccacatagattaccagtcattcatcattaattcagctaatgtttattgagtagctatagattcccaattactaggtgtgtactagtgaacaaataggaaaaaaaaatccctgccctcattagcttatattgtagtgaatgaagcaaacaatgaacaaagtacttaaatagaatacatagttcatgaaataatgacaactaatggtaaagggaagcaaagaaatgggttagaaaatgtcaaggggtaaagtgacatttcattgaaggagtgagagagaaagttgtgtggcttcgtggggctagaatattccaggcctagggatcaacaagtgcaaaggctagttgggattgagtgtggtgatcattatagctggagcatagtgaaccagggggagagtagcacgaggtcagggaaggtggagggccagaacatgttggccctataaggcatagtaaggattttgacttttacttggagacagatgggaaaccattggaagctgtggagcagaggagtgtcatgatctgagctacatttcaagaggatcaactgtggcttcagtgttgaggatgggttgtgggatgagagggcagaagtagtagagaggtcaggtaggacaatccaggcaagattttcttttttttcttttctttttttttttgagacagagtctcactcacttcagcccgggctgaagtgcagtggcgtgatcttggctcaccacacctccgtctcccgggttcaagcaattctcctgcctcagcctccctagtagctgggactacaggcgcccgccaccacacccagccaatttttgtatttttagtagagatggggtttcattatgttggccagactggtctcgaactcctgacctcaggtgatccacccacctcggcttcccaaagtgctgggattacagacatgagccatgtaatagtagcttggaatgggttggaacagaggagatatggtgaatgaattcttgctatatgcaggaagactagatttatagaactccgtggcaactgtttctgtattctacaacctgtaacttaagaatgaacataaaatactgttacagcattctgtaactgcaatttgtaactagtttgtagcttcaaatgataatacattgtgtttaagaactgatttgtatacatttgtcacttagtgattatttctgtagtgtttacagaaataattcttgaattattattacaggttttctaacatcatgtttttactatgaagtctttcaagacattgctagtgtttttaaaaatatatctttgttctgtgttaaactatagtcttgcagttcatactaaatgtacttttaattttgatcaagctaaacaagaaaggacattttaacagactacactgttatatgttaagctgtggttcttgaaaatacaggacctgaggttagagttctaagagaatcctcctcttcttgatttttagctactgaaatgaatatcagtatgacttgcagtgttaaaggagaaaagcaagatcagtttgattttattgtattactttgtaagcctcatattcttttctcatcatttatcaattcaataattcaagaatatttcctgaactgacttttatttcaccacactcaccttattccagaaaagattttaggtagctcatgaaactgttataagataggtttgaaaatgttttccaccctgcagcagcatggcattcctgataaccacatacatgtgtagtctcattttagccatgatcagttataccacaataccttgataattagcggtcatttcatgaccaggatgtgatgtgtggtatcccatactacctcattccatgcttcaaattttatgtgttttatatagaaaatgtagaaaagcaagtagaaattgcatcacttagaaatacctgatcttttgataaagcatagaaatttatggtacatattttatgtgtgtgtgtgtgtatatatatatatagagagagaaaaagtcacagtgtacatactttaataaacttatttgtttaacattatactgtgaacttttccgtattaacattcctcagtaattttttcaagtgtatgagtaatttttctgtcatactgtgagataccatatttagtcaaattgatcatgtagaatatttaagttcatttcaatattttactattgaaaaccacactgtggtgaatattgtggcttagtttttatttgtatatagatatattcagttgagggtatttctatccatatttctatgtgaatatatttgtcataagtctaaaattacagaaagttagaaattaaagagatgaaagatttttttattttggtagttaaactgaagaaattgagagttatattctttgccacatattagaggtagagttggcagtgaagagattgggctgtaatgtgcttagtgcaatgcctggcacataatcatagctaacacttattgaatgcttactaagcaccagacccttgaaaaacttgaaattatttttcaccctgtggcagcatggcatccctgatgactgcacaggtgtgtagaatgggtctcattttgtccctgatcagttacaccacaatacctcaatagttagtggtcaataatcccgagtacaaggattatacttgtattaatttttcaaatctttaccacaatgatataagtattgttattaaccccatgatcatgacaaggacactgaagtattgaaaggttaagttttttgcctagagttatacagctaaggacaaaactaggattcaaacccaagtagtctggcttcagaatccatgctatcaccactccccaaaacagccacaataaatgctagctaagtgtttgagtgttcaataaatattaggcgtcatcattattcctactgcacagttgcatattccagaggtggttttggttccaatatttttggattttagaaagataatttagtttgtatactctattttatgtaacattctcattggggtttggagcagcccttcataaacagatacattcacgtttcttcagtgaagcatgtttgtttttatactaagtgagattaaaaagcaagaatattaatagcctgatgtcactacatgctgccaaatgagttatgaaaaccttttgtctttgagaattgcagataagggattatggacctgtataaaactcttaccatagtgcctggcatttagaacacactcctccttctactagatttatactagtagtattgggtgggtactactactaccactactgttattagtagttatcatcagatacatacttacagaaaactggtgaattgtagagtactgttagtacttttctcacactgtgaccttgggaggggaagacacctaagttttggagtctttcagctattcttccctcaatcagaataagagggtgtaagtcatagtgttctgtgtgttttccccgccctaaattgagtcttgtatagcttagtgctcctgtccctctatccatgtgcactcccagttgtgcagggtttgattttagagtctaagcaatagctcacgtggtgtgttcaccgcttcagagatcttagtgaaacaacgtttcaagtttttccttattctttattacagccctctttatgagcccattgggagaacaatttaattgtttgaaattgagatacttccttttctttctcatccattttaattgatgaaaaactataatcacagtcattataaccacttataacaattaccaagaaatatttagtatgtatacacttactgtaattatatggtcatgttacttttattgcagtctgatccaaatataaatttattaaataaccttgatatgcacatttgctattaagtttttttttttttgcacttgaatttaaacctatactctgtttttggaaatatcccgttgaacagcagtttgaagatctgctgtatatagtttgacctccctttctgcatattagagtagcatttctcttcctccccaccaacccccagtaactggaaacatcctcgttcaacctttgttttcctcttttgtgggctagcctgtggcctatggcaagtccaatggcctggaagtggtcttacagattatctggttaaactgaagcagagagatagaaatgtaatcaatttgttgagagtgagaaagggattttatttattgtatttgatagtttttgatctgcaattgaaatataaaatacagaaatagatgttcctttttttttctttttggaagggatgtgtaaagtttagtttttgtaaaatcgttagttttaattgctctctatgcgtatgtatatgtgtgtatgtggtttgggggttatggtatagtatgtaagagtatgtgatatgaaaaataggatcgttttcagtttatttcatattgtttgatcctcacaaaacatatttgttttggcagctggccttccttgtaacatggtgttggaattttgcatgcattatttaataagctctagttctttcctgttgagcattttgttcagtttcttagtgatagtagatattgagtttgaattccagggcagaaaagttggaaagggggattaatgtgtaattaccaactaatacagtgttcaaaaataccaactaatacagcgttcacaaataccaactaatacagcattcacaaatacagttattagtttggcacatgttcactaactttttcatctggcaacattatttaatttaggatcttagaatttgaactgcattgacataattgataattggtatttatttttttacagaggaaaaaggaaaatggatggctgaaaaaattatttgtcattattttaaaatttatatttcctttatcttttctaggttgctgtagtaaaactaaaaaatgcagataaagtgtttgccatgaaaatattgaataaatgggaaatgctgaaaagagctgaggtaagagtcttatgtattggaatatataaatattttagaaatatttttcaggaattataaaattccatagagctcattaaatattacttggtaacattttgtctgtggtgacattttttaaggcataaaagacaaattcaacacaattgtgatataattatgataaaggttacaatccataatgctaatttaatattagtggaatactaaatggaaacccttgtaatggggggcttatgcagctatatttaaaggatgtctgcaaactactttcttctatagaaagacattttgtaatggttgatttctaacgtgacgtaacttgtttatattattctgtatttatctgtattctgctacaagcaaaagtcagcaggagttttgaacatgccctctagaaattctgtttaatgctgattatgcagtcactttgtattttgttttatattacaggagttgtagtaaaatctagtaatggaagaactgcctgcatttttatgtagatttgagggaaggattgactggagtgatgttaaaaatatccagcagctggtatggcctggtcagaactgctgtcacacatagatttggagtggacttctggggggtccgctgctgtgctgtatcatggtgaagggttgaatgggataggcattctggggcttcagggaagcagaacttaactggtgtagaattctgtcagtattttaactggtaaaaggtgatactgacgagcaggctgagtaatagccctggaagttagtaagattagtaagaaaataatgacaaattcgcctttagaaatctttatctgtcagtacttgtagcaacccaaagatgaacaaacatacagggaaaagcaaaaagtgtttccatgatgacagatatggtggcagtgaaagtaaatacttcattatttatttatttggagaaatttgaaaacacaaagaagaaactaataatcacttttgttctgttacccagaactaataacattttggccaagtttttgcttttagtttttttttttaaactaaaaaaaacaaacaaacaaaaaccctcagaagtgaagcacaaatatattctctgtaaaacaaataatagcatattacagataaagccaaagtgttctttcaccacccaagtccatcctttctctaactcccagaggtcattattacttttaaaatactatttcttcattaaacattttttttgtttttatatatttaggagatacaggtgcagattgctgacatgcatatattgcattgtggtgaaatacccatctagtgaacccatcacccaaatagtgaacattggacccaataggcaacttgtcagccctcacccccttcccaccctcccaccttttgtagtctgcaatgtattattccactctgtatgtccatgtgtactcatggtttagcttccacttataaatgagaacatgtggtatttggctttctgagtttttttcacttgggataatgatctccagttccattcatcttgctgcagaagataagatttcatatatttatttatgtgtatatgtacacacatatatacatacatacatacatatatgtatacacacatcacattttcttcagtcctgcgttaatggacagcaagattgagtctgtgactttgctattgggaatagtgctgtgataaacatataagtacaggtatctttttgatataatgattttttttcctttgggtagatacctagtagtgggattgctggatggaatggtagttctgagaaatcgacgtactgttttccataaagattatactaatttacattcctactaatagtgtataattgttcctttttatctgcatccccccagaggtaattattgtatagtaatatcctgtttgacaaagtatctgggagctttaatgtcacatgtatcactgggatatgtgccagtgtccattatattcaacaccttagtttttacttttaatttccctaagactgaattgccttactgtcactggttggatttctcaaggagtaaataccgagattgagtttattgtgcagatatttgtttgggatttcttttgagaaatccctacctgtagaagggaagggagggagataggatttgtacagttgtcccatcagcctcagttgattccactgggagctctgtagcagaaatggctcttgagaagtgtcctacattggatcaaaatgtctagacctttatacacctgcctctactagtcagtggacatgggctacccctgaaggacatggccttggactggtaggctttcttcagctgatgcaaaccctgaaggtgtgacagcatcagcagctagagcaacaaatcctgttattacaaaagagtaaataattatgttctgtttagcagaaataacaactgtagtcagtttactgtttcagagttagaacttttaaaaaattgaattaaagtttatacttttttcaatgaagctggatatgttggggaagaattgtgaaaaggatgaataactgggttagctttcattacagctggaagtggcaaaattcaaaataaaacagtataatttaaaatcaaatattttattcaattaacaagtatttatatattctgtttctgagacaagatggaatagactcacttctccctgttctcctgtgaagtatagctgaagattctggacatttatatataaagcaaacattagaagaacccaaaaggtagagagaataaggtagaccagctagggacctcaggaccttacggtataagacccattttggaggtcagtattatgctgatagaaaaacctgacaaggaccatacaaagaaagtttaagataaatagtcctcgaaataccatttgacccagtcatcccattactgggtatatacccaaaggattataaatcatgctgctataaagacacatgcacacgtatgtttattgcggcactattcacaatagcaaagacttggaaccaacccaaatgtccaacaacgatagactggattaagaaaatgtgtgacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccggccagagacacaaccaaaaaagagaattttagaccaatatccttgatgaacattgatgcaaaaatcctcaataaaatactggcaaaacaaatccagcagcacatcaaaaagcttatccaccatgatcaagtgggcttcatccctgggatgcaaggctggttcaatatacgcaaatcaataaatgtaatccagcatgtaaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatggacaaaagctggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattatatatctagaaaaccccattgtctcagctcaaaatctccttaagctgataaacaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagagtatacaaacaaatggaagaacattccatgctcatgggtaggaagaatcaatatcgtgaaaatggccatactgcccatggtaatttacagattcaatgccatccccataaagctaccaatgactttcttcacagaattggaaaaaactactttaaagttcatatggaaccgaaaaagagcccgcatcgccaaggcaatcctaagccaaaagaacaaagctggaggcatcacactgcctgacttcaaactatactacaaggctacagtaaccaaaacagcatggtactggtaccaaaacagagatatagatcagtggaacagaacagagccctcagaaataatgccacatatctacaactatctgatctttgacaaacctgagaaaaacaagcaatggggaaaggattccctatttaataaatggtgctgggaaaactggctagccatatgtagaaagttgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaacatttttgcaacctactcaaagggctaatatccagaatctacaatgaactcaaacaaatttacaagaaaaaaacaaccccatcaaaaagtgggtgaaggacatgaacagacacttctcaaaagaagacatttatgcagccaaaaaacacatgaaaaaatgctcgtcatcactggccatcagagaaacgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccagatgtccaacaatgatagactggattaagaaaatgtggcacatatacaccatggaatactatgcagccataaaaaatgatgagttcatgtcctttgtagggacatagatgaaattggaaatcatcattcttagtaaactatcgcaagaacaaaaaaccaaacaccgcatattcttactcattggtgggacttgaacagtgagatcacagggacacaggaaggggaatatcacattctggggactgtggtggggtggggggaggggggagggatagcattgggagatatacctaatgctagatgacgatttagtgggtgcagcgcaccagcatggcacatgtatacatatgtaactaacctgcacaatgtgcacatgtaccctaaaacttaaagtataataaaaaaaaaagaaaaagaaaaaaaaagatgaaaaaaagatatgccagtaaaaaaagaaaaaaaaaatgtgtgacatatacaccatggaattactatgcagccataaaaagtgaagagttcatgtcctttgtagggacatggatgaaactggaaaccatcattctcagcaaactatcgcaaggacaaaaaaccaaacaccgcatgttctcactcataggtgggaattgaacaatgagaacacatggacacaggaaggggaacatcacactccgggggactgttgtggggtggggggaggggggagggatagcattaggagatatacctaatgctaaatgacgagttaatgggtgcagcacaccaacatggcacatgtatacatgtgtaacaaacctgcacattgtgcacatgtaccctaaaacttaaagtataataataataaaataaaataataaaaaagataagtagtccccatgcatatagatgcaaatatccttaacaaaatattagcaaatacaatttagcaatatgttaaaagaattatataccatgcccaagtgtgatttattgttgggatgcaagactgattccatatttgaaaggtactctcctcaaactatttgagaaaacttttatcttttagacagaaattctgcattgaaacttttaaggaagaattcactttaaaatagaaattgtatttctattcttgaataagcagatctttttaaaaacaaaaacatttctaaaaatccttctgaccatgacttatccaactttggaaaacaagacctaccagtgatgcttaataaattacaaatgagcagcaaaattccttattttttatttgtgtattgttgatgctttaaaacaattttttcagaggtttatgtacaacttatttaccttattctgtttcaagccatatgtcaaatatataattaatgatatacgggttactcaaaggtgctaggaagcctcctctcttttctatacctgggcagaaaggtataataatataatgtccaataatttcacagatttatcatttacaaactttgctagtttatcaccaataactctacaagttcatcatttacagactttgctagtttatcaacagcctcctaaattaacaaatgaactactgctctcaatctgttctgtaaattttacttctgtcttcacatttgttcagtgagtactgacttcgctcattaacagatgtccttactcatttcatgaggagatgcggtatagtttacagaaacactcactgtcttgagagttaaacctttttataaaaccttttaaaaacattttatttattgaggcagagtcttgctctgttgtccaggctggagtgcagtgttaggatcttggctcactgcagcctctgcctcctgggctcaagggatcctcccaccttagcctgggagtagctgggactacaggcacatgccaccacactcagctaatttttgtattttctttagagatggggtctcactatattgctcaggctagtctcaaactcctaggctcaagtgatctgcctgcctcagcctcccaaagtgctgggattacaggtgtgagccactgcactgggctgagagttaaacctttctaaggctcaattttctcatgtataaactgaagataataaggtctcataagtagggtaacagtatatcttagtttatctgtgacagtgctgatttatgcctattgttttattagtttttctattgttgttatccttgtttggctatttttataattgttagtaaagtactacacaaagtaaaaaatgaacaaatgcaagttcccttttctccctcaaatacccctaagtccttctgtcttaagtagatcattagtaagggtttcttatttatcctcaacagaaaattttattataatgaaatcatattacaaggctgatttttcatattgctttttcactaaaatatgtattgttttttcacttctatgtatttaatacatttataatatctcattctttgttaatagcttcattatactgaatggctctctgtgtgtgtgtgtgtatatatatatatatatatatattttttttttttttttgagacagagtctcactctgttgcctaggctggagtgcagtggctagatcttggctcactgcagcctcctccttcagggttcaagtgattctcctgcctcaccctcccaagtagctggctgagtacctcccaagtacctcccaccaccacacccggctaatttttgtatttttagtagagacagagttttgccatgttggccaggctggtcttgaactcctaacctcaggtgatccatctgcctcagccccccacagtgctgggattacaggcgcgagccactgtgcccggcctgaatggctatattttttattaggttgattttttttttaagtttatgggaatttagattgtttccttatttttactattttgaaccatgttgtaaaaatctttatatatactggataaacttttgtgagtttatcggtagtgtgaattcttacaaagatgaagtgtcaaactgtcaatacatttcattattttaccatttatctatctgcatgtgtttggccaagagaaatttcaaaacaggagagaaactagtgcttcaaaactagtcatgctacccaaaaagtatatgccatgtaaaatttaaaaaaattttactatgaaatgctgttagagatattggtgtgggctaccctgaggcacttcagcttgtgtatactgaagttgaaatgatttcaaggataatttttacatgaagggattatcattttatgcttgacctagaacttatccactccctaaattaaactccttgctagtcaaactctgggattttagttggggaggggagacattaaaactttgatagctattgttccaataaaattatcttctataaaagttggactattatctttgcactcatagtatgtaaacatgtctgttttctcacacacttggcagttgcggatgttaccaaattatttctatatttaaaattacatttaaaactttttactgaaaaataagttaaaaatgatacatctcatgtttgatttggccatgaaatatatattaaaatgaagacttaaaagtgaattgatgccatggtaatacttggaattcttacattttgcaatttaaaatttcactgatttagattttaaaaatgaaaaatgttgttctttccctcaaatattagagaaagattcagttattatttgaaagagtttctctgtgatagtattctatggaagagtgaagtctttattcctactaaatgataagccaaagtagatataatcatcagtggattttgtttctttttaactcatgctttccaagtatctgtgcaattttgatgagcagtataagcttgttagtctgatgagtgcatcttatcaatacgatgaagagaatcctgtgtcaactttccagaattaccatttatgtatgtagtccttactaacttgtgtttcaagataggcattcctgttcctgtttatcccaatagtccattaaggataaaatttaaataatatagactgaatattttttaaaaaggaaaactgtataacagttgaaaacatcactgtggcaagctgaatgtttggatgaacatttggttgagaaagtgagtgaatccgaggaagtgatatgatctacagtagcccttcctacatgtttgttattaatacattcttagatatcaaatattctgtttttaaaggggggagatattgtttagttttttttaaaaaaggtaatgaagtagatgttactaaagcctttaagcatgttgaatccacagagcacctttatgaatatatatatacccagggtatatgtgcatcatgatttggttaatattgatctagaacagggcttctcaacagggacttcattgacaactggggccagataatgctttgttggaggggttgtcgtgtgcattgtagaatatttagcagtatccctggcctctacccactaaatgccggtagaacccatcctttcccaattgtgacaagcaactgagagcagtgtgatatgttgaagcaaaaacgtagcctgtgctttatatctagactcaggattcaaggcattgataggaatcatttaatagctagatatttatggataaaatcatatgctgtctggggtttgcttaaaaatatgtatatgctcctgtgtgtgtggtgctaggggatggtagtaagtaggtgagggtctaaatgaaataagattgaccaagaaaataattgttgaagttgagttcattagtaggagggggtttttatactagtttctctacccttgtatacgtttgaaattttgtatcataaagagtttatattgtttattttcttattttaattaatgtttttgaagagacagtcttgctctgtggcccaggttagagtgcgatggtgtgatcatagctcacttcagcctcaaactcctaggctcatgtgatctttctgcctcagccttccaagtagctaggactacagaggtgcatgccaccagcctggctgatttttttttttttttttttgcctgtagagacagggtcttgctatgtcaggcaggctggtttcaaacttcaggcctcaagcgatcctctcacctcacttcccaaagcgtgggactgcagatatgagccactactcctggcctattatttttatttttaaaaaataatttttttagttaaacagattagcatagattagaactcaaagtttaatatgttctgttgactaaagtctttggagctttttttagttttgagttattagtcaaattaaataacgaatgtttattaaattctaactagaatgtttataaaatttcggattgctattatagtgagatgaagccaggagaaagtagtcttctaggctctgacagtctttacaaactctctaaaatgttagcagtaaaccataacctcaggttggttaaatcataaaacaggacttggtagtaagtatgtaaagtgctttctgttttccccttaaaaagaaccagagcggccgggtgtggtggctcacgcctgtaatcccagctctttgggaggccaaggtgggcggatcacgaggtcaggagatcgagaccatcctggctaacgcagtgaaaccccatctctactaaaaatacaaaaaattagctgggcctggtggcactcacctgtagtcccagctactcaggaggctaaggcaggagaattgctcacacccggaggcagaggttgcagtgagctgagatcacgccactgcactccagcctgggcgacagagcgagaaaaaagaaccaaagcatagtgttgtatagattttagtaatttaattgttttgtggatcatggctgttgaattttccttgtgggaaataataatcacttattatatatagcatactgtgtgataatgtttttagtgtatctggaatatggtgtagccattaagaaaaaattaggtagatttctgtgtactgatacggaaggatgttcaaattcattgttacttgaaaaaaaaaaaaaacttacagagcactataatctcatttgtataaagaccaaaaaatataggggaggtgggataccatgtgaatatataatctgtgtgtgtgtgtgtatgtgtgtgcacgtgcacatgcatgcttatatagacacagattttctgagaggattttgaccaaagagttaataatggtaacctctgcacacaacaattgggcaatgaaactatgggaacatgactcagggagacttttactttcttagagttatctttgaagtttctgtcatagtgttatttttgtttctttttagttaatgtattacaaaattatgatacataaaattgatttttaggctgggtgtggtagctcatgcctgtagtcctagcactttgagggggctggaagattgcttgagcccagtagtatgagaccaacctgagcaagatagtgagacctcgtctctagaaagagataaaaaaaattagctgggcatagtggtgtgcacctgtagtcccagctactcgagaggctaaggtgggaggatcacttgagcccaggagcctgggctgcagtgagctgtgattgtaccactgtactccagcttgggcaatagagtgagatcctgtctcaaaaaaaaaggttaaacaattatttttttatttttgttcatatatttctaaggttcttcgggatatacttttatagtagtggaagtgtattctcagaataaactacaactttaaaaaatcaatttgaaaaaacaatccattagagaaaatggacaagggaagtgaacaattaaaagacaaagttcaggtgtccagtaagtgtatataaagctatttatctgcacctgtaattaggaatatgttaattaaaggaataatgatattatttcacacccgtcatgttggcaaccacttaaaagtctaataatgtcacatatagttgaggatgtggggaaaagcagagctttcatattctgggtggagatagtaattggtatagcactcaggaaagacaattggctaaatggtggagttgaaattttcatttagcatttctacttctaagtgtatacagtggagaaactcttgcacatttgtacaaatatgtttattccaacattgtataataataatacaaaactggaaataacctgtgtttccacggttgggggttgcataaataaattatagtgcattcaaacaatggtacgccatagcagttaaaagaagaacagtcattcttgagaaaaaaaaaaaatcaaattgcaaaaggataaaattataccattcacatagattttttttgtttttgttttctttctttctttcgttttttttttgtttgtttgttttttaaggcaaggtctcactctgtcacccaggttggagtgcagtggtgcgatcttggcccactgcaacctgtgcctcctgggttcaagcaattctcccgtcttagcctcctgagtggctgggattacaggtgtatgccaccacaccctgttaatttttgtatttttgttagagacaggttttcaccatgttgcccaggctggtcttgaactcctgtgctcaagcaatctgcccacctcggcatcacagagtactgggattataggcgtgagccactgcgcccggcccatgaaaattttcaaaacacaaatctgttgtttgtagacatatacatgtgtgatcaagtcatataattggactatccactgacttcagattattacagcaggggagaaagggaagagaatgggttcacagtttggagtaggaaggatacaatttacatcttatttctttaaaaagatcagaagtaaatatggcaaaatgtagacatttatattatctggatggtgggttggtccatggttcttaaattattctgtgcatttttctcattgttttgaactataaaagtattatttaatataaaatatatttttaaaaggtactattccagtagcccagtttctgagggtggtttgaaacttgtgttattgaaatgtcttataatatcaggtgtattccttttccagaacagaaataatataataaacatagtaattctttgtatatttcctagttttacataaagtatgctctaaaaattttctttttgtgtttcagacagcatgttttcgtgaagaaagggatgtattagtgaatggagacaataaatggattacaaccttgcactatgctttccaggatgacaataacttagtaagaatcatttttgtatttctatatactgtttttttgttggaagaattagcattatttttatttaagcattgtttaaatgtaggtttcatatagaaaattaagtgcatttcatacagggtaagttgttcacttgatatgtggtgtttttttttctccctggaaatttgataccttttcattggaattctttatgctttttaataagcaagtcaaaactaaatccaaacatttaatttccattggttaagttctatagacggtcttcaggagtttttcatgatacctttaacaccagtaccattcctcttcccttgttcctgttgaagtccagctagtactttaaaattgtgctcaaattcatcttaaaataatcatttccagaattttccactgaaattaatctttctcatctcattctaactttacatttttaaattatttttattacataactaacacatgtatctctgattttttttgatacaactttaagaaacatttaaataggccggatgcggtggctcacgcctgtaatcccagcactttgggaggccaaggcgggaggatcatgaggttaggagattgagaccatcctagctaacacggtgaaaccccgtctctactaaaaatacaaaaaaattagccgggcgtggtggtgggcacctgtagtcccagctactcgggaggctgaggcaggagaatagcctgaacctgggaggcagagcttgcagtgataatgccactgcactccagcctgggtgacagagcaagactcggtctcaaaaaaaaaaaaacacatttaaatatgttacatggactgtaccatctttacctaaaataaaattaaaggtttttccaaccccactggaaacaaggaaaaaaaataaaggtttatgcaactctataatgctcatggggtttatctgatttcaggccagatctaggtgttcaaacagtgtcattactagtcttttatatcccttacatgcttatagagtataataatgtttttttaaactacagattgtgacccattagtgggtaataaaatcaagttagttacaagcaacattttttttctttctttctttctttcttttcttttttttttttttgtttgctggatcttgctctgttgcccaattagagctaactgctgtatctgattcctgggctcaagcagccctcccacctcagcctcttgagtaactgggactacaggtgtgtgccactgtgccccactaacttaatttttttgttgttgttgttaagatggggtctcagtttgttgctcaggctcgtcttgaactcttggcttcaagtgatcctctcagcttgaccccctaaggtgtgtggattacaggcatgagccaccatgcccagccataaggaacatttttaaagattaaatagaatagaaaatgacagagttcatgacaagtaagtagtaagagtgaatatggtctcatgacacatttcttttataatatactgaattatcatataagccatatatattattgtgggttatagtgagaattgtgtaaaaaccatagcatagagttttttgtatgtgctagatgcatagttgttaaattgaatagaatgatgttttaactggatttattatacttaatatacaaaattttagggatgaatgtatcatgcaaagataatctgcatgggtttgttaataacatttgtaagaacaaattaaaacacatcccacatctttgcctagaaaaattatagcaatgtatcatgataattttcaaaatgttttcaaataatgaataaaatccactatgacagtgtattctgtaatagataaatttaacactgcagatttgtgcattgcttaaaagtctacattttggtataaatatagaaataattatataattttgtaggtatattaatagaaataaagtacccaaataccaaattttatatagcaaaaaaagcctgaactgtgatttatctctctcctcttgtttagttttatttgcattcttcgtatttgacattaggattaacatttctttttcaaagacatttttcagggaaaaatagtctgtatatacccctcaataattactaaaatagaattaaagacgtaactggaggaggaatgaaacactctagtagtcaaatctcctgtaacttgccagtgtttctttaggggagccttcatcatatattcattcatctcaagagtcagaggtcttggttatcatcaaaggttgccttttgaacatttatacaatattagcaaaaatcattaaaaaatgtcgacaaagctaattttagataccaaaaaaggaaattttattatatataattgtttttcaaagtaacttttaaccctgatagcttttaaattgccaagtaaagaacataatttataatgctatatggttctagaaagctgtggcaaataactttcatttctaacctacttactacaatagtttatgaaaaaatttgcaattatagcaagtagactttttgtgtgtttcagaaaaaggcacataatttaatgaatggtagatattattatgtgattagatctttttttctttaagaaaagctcattaaatacaaagctgcttagttatatcaacattgacacataaaatttttatcacttacataacactagaatataatgaaccagtgaaatttgttcgttctgtactttcttattaattgtttcctgattagttactttatggttgaggaaaaaaaggaaaatatcttgcactgacatatgtaacttgtttaaaaggtgaaagatacttgaattttaaattaattgtagtaactcatatgaactctaaattctttataggaatccaatttgtgaagacagaaattattagaaaagtaatttttttaagaaaagtattgtttagggccgggcacggtggctcatgcctgtaatcccagcactttgggaggccaaggcgggcggatcatgaggtcaggagatcgagaccatcctggctaacacggtgaaacccggtctctactaaaaatacaaaaaattagccgggtgtggtggtgggcgcctgtagtcccaggtactggggaggctgaggcaggaggatggcctgaaccctggaggcggagcttgcagtgagctgaggtcacgccactgcactccagcctgggcaacagagggagactctgtctcaaaaaaaaaaaaaaaaaaagtattgtttaatagtaaaaagaaagcaaggaggattaactataaggtgaggctctaaagattgactgttaatctctttgttatggcagcatgagaattaaaagagtttcctgatattcctacgaagacttctagaattatatctgttccttgaaatgctcattttgggacacataactcatttattgcatgttttcagatgttttagcattgtttcattggactggagctcttttaaaaaaaaaatccccaaagctgccatggtctttttagtaatttaaccagtgattcctcaaatcaatgattgttgctttggctttcatttccctagtgactattgaggttcagcatgtattaattggctgattgtgttccctcttatgtgaattatctgttaatattcttagcctagttttgttggattgtttgtccctctcttaacaattggaaggggctctttattttaggattatatccttgacctattatgaatattacctctcagtctatgttttttaaaaacttgtataaatataccttagctacattgggtaatattttaaaagtagtttgtgattaggagtaccaaatattcaattttactataaaattaaccaatcagaacaatatgatataataatataggaataggtaaccatagcagaatagattaggaacagatataagtatatttgggatcttaaaatatgacgaagggacatttcatttgaattgaggagaaagaatggattatttaactgttactttagacttttagtcttatagactctgtctataagaaaatagtcttcacactttaatcaaaagtaaattgtcaggatagggtcagttcaacgttagggtaccccgacgtggtggctcacgcctgtaatcccagcactttgggacgtccaggtcaggagatcaagaccatcctgggcaacgtggtgaaaccccgtctctactaaaaatacaaaaattagctgggtgtggtggtgcgtgcctgtaatcccagctacttgggaagctgaggcatgagaatcacttgaacccaggaggcaggggttgcagtgaaccaagattgcgccactgcactccagcctggcgacagagcaagactctgtctcaaaacaaacaaacaaacaaaaacgttgggcctagtaaatacagcaagtaggccaaagacacaggattttaaatatattctgcttccctaattttcaaggctttaaatatgcgaaattagtttctttggtttaacacacatttcctatgtttgtaattttaacatatagtaataaaaggaatttgaattttttcaagactctttaaatcttaatgtcaactcagtaatatccctgaaacaatatcttcattctgtaataaaaccttaatttcaaggcattcatgtgtcttgtactcactagccttcatgctaagtgctacattatcattattgtagttaggtagatgagaaaatgaaatgtcacagagattaatttttcaacatccacttacaacatggagtcagtatttgaatacaggtttctctgactacaaaacccatttttccactatgtctagttttctccctcacttaaaaataatatataatgtacacacaaatacacatgtatatgtaatacatgcttataaagcaatgtagaacataaagttataacatcagctgtaatctaacaacctacagaatctcagtgaacagtttgatgtactcttctcatcgtttctttacaccacatacatacccataaggatccatatctaaaattagttggcttctgtttattatatacacctgagaaaagcccattctgatatttttacagtattagaaatgggaagagacacatatggtgataattactatattctacgtagtagtggtttctaaatgctgatctataggctgatgctggttctaataaagttcttactgatccaaggtgaaataaggaaaacataatgataatatgaatttctttcaatgtagggactatcctgtattccaagttttttctttcattgtttttttgggggagggggtggattcaaatgttcattcttctaaaatcttggaaagctgtgttccattgttgtaggtgaagatgataataatgatgatattagctctttgcaaaatacaacaatggtaaccctgtgttgttctctgccccagtctttaaaaattttgttttactgctgtatgaaatttagaagttttgtaatgactgctgatcatcatcttacacagtttcttgttaattagcagcatatgtaattaactgcataaatatttgacccagtcctgttgaccttgggatacagtatattgatttttcacccttattagtttactgagtacattttatttttttcattcacagtacctggttatggattattatgttggtggggatttgcttactctactcagcaaatttgaagatagattgcctgaagatatggctagattttacttggctgagatggtgatagcaattgactcagttcatcagctacattatgtacacaggtaaaacagtccttcattgtacctggctgtgagttaccatgtaatatctagcaacagaggcctatttcttgccagatttattaattatggtcttggatacatttatcgtcaaccaaaaaaaattattttgagatgattttggttgttttgctttgttgttgttattatttgtcagcattacagaaccgatgtgcctgcttatacatacatgtacatgtatagtatctaaaagttgtcactcctagaataatagacattggagactaggaaaggtgggaggaggtgagggatgagaaattacctatgggtacagggtacactattcaagtgatgggtacactatattgcataactcacaaccacacaatatgtccatgtaacaaagctgcacttgtaccccctaaatctatgaaaaaaaaagttctcggccggtcacggttgctcacgcttgtaatcccagcactttgggaggtcaaggcgggcagattacgaggtcaggagatcgagaccacggtgaaactccgtctctactaaaaatacaaaaaaaaattagccgggcgtggtggcgggcacctgtagtcccagctactcggagaggctgaggcaggagaatggcgtgaacccgggaggcggagcttgcagtgagccgagatcccgccactgcactccagcctgggtgacagagcgagactctgtctccaaaaaaaaaaaaaaaaaaaaaagttctcacttccagtcagcatttctagaaatcacttcttaaaaaaccactcttgtttaaatgtacatatgaattccatctcaaaaggagtatgcattggtcagtttccttatagttgagtcttacatatttaaattagctggaattctagaccataagtcataggttcatttgctaaataagtcctgtattatatattttatgtttctcaagaaaatactttcaaggattgtatgtgtcaaaagagattttttttgtatgaaagtgataattttgatgttcatggagtaattataaactattaatactttatatttaaaaattttaaaaataccagcatgaatttggaaggacacacaaaaaataagaaataaattaaggatatattggatgatttaaaaggtaccctcacattttaagaggaaagtaggaaacagcagaacgttgttggtgaattaatcattcaaatgagagtatctttggatggtgcaaaatgtgagaaagagaaagatgctgaggagaagtacgtaaagggatactgccaagttagaaataaactaaaccattttctaagagtgattttcaaactttggcatgcatctgaatcctatggaggaagggtggttgaaacccagattgttgagtcagctgcagaagtgctgattcagtgggttgggtcgggctggggaattgccatctctaacaagttgccaggtggtgatgctgctgctggtgtagtgaccacactcagaactatgctctaagacagcagtgactgtttcttttaagttttgggtggtgagagtgatctctgagaagaacatgaatgtggcaaggagtagaatgtttctgtttcagtgtttgctttttaagatgtgggtgtcttaattgctgtttcatttaattagtattgaagttctaagacattattaaaggaagactactttaattaaacaatttgtattttatcagatctctgtttggcttttgcctattcgtgtgcttttctctgtgggtatctgattgtcacagtttttattgaaaataaagatatggaaatgctttgaaaattgtacaatgcagttttttttttttaatttaaatttttgtagagatgggggtctcactgtgttgctcaggctggtcttgaactcctggactcaagtgatcctgccacctcagcctcccaaagtgttgggattacaggcatagctaccacttcttgccacagtgcagccttaaagatggtattgtggtctcaagagtcagttatagaatgagaaacgaaagtgctattttgtggcttaaacagtaatccaaaatcctagctgaggactatcatttaaaaatacttacagaaaatactatttcgttgaatatttgaagaatgttactaaacatagagtcttaggcttgtggaattgagagatttcacccagtttatatgtaattcttgagaaggaataactgcttctgaaaattatatgcctagattggtgaaagtaaatatgaggtatttgtagtatctttcattctgccaggcttgttagagatactgttatgtggactgaaaaccatttcaaccttgagctctgcttaagtacatctaattttacaaggtacttttaaatgaatcgtatttattccattgttgggcagctctaatattataaaattttattttatattaagctgaatttcttctcttctcttttttttgagacagagttttgctcttgttgcccaagctggagtgccgtggtgcgatcttggctcactgcagcctccgcctcctgggttcaagcgattcttctgcctcagcctcctgagtagctgggattacagtcatgcgccatgaagcctggctaattttttgtgcttttagtagaggtgggttttctccatgttggtcgggttggtctcgaactccctacctcaggtgatcttcccgcctcagcctctgaaagtgctgggattacaggcatgagccaccgtgcccggccttgaatttctttttattttagtcattggttctagttttgcttttagagtcacatataatttatttctcttctagttatcatgctttctgaagtcttctttaggttaaacatctaaacatctctagtttctctgttataacaatttgtatacacttcctaccttccttgtcttaaccccccaccacacactctgcccattcctacacctcttctccctccctccttttctctacttttacctttctgtggatgctccattgtgttaatgtgctccttaaaatgttattctcattttctggatagactattttcagcaaatgctttactgaggaaatattttttgagtcctcttttataagtaacattgtgctaaactatgtggaattgtaagtaagtgggtatagcatatagttgtggcttttgaaaaggtttcagttgtttggaggcacaaaacctaagatagaaataaaacttaaaataccacaagttaaataatcatttaaggccaaagtataagagatgatggagtgagtccagactgtggattgctaaatgagttatacaagcaaattacagtgagctcaagaaatgagtaataagtttatttctaatgatcagttctaatccttatttaactctttgtgctattcactgtattctaacacaaattctgtgattcagatgtcatctaaaatcgacgttgccccattttatagatgaggaaacccagcttcagagacattagttagtaagtagcatagcctagattaaaatctaagtcaggcttgtctccagatttatgttctttgcacaacatcatgttttccatagaagactttaatggaggggctttgaaggatgagaagactctgtaggcagataggaagacattcaagataggtgaatggtaggagaaaagcacataagaaggtaaatagtagttttggaaaatacttaatagactagtttggctagagaaaagagttcatgttgagtttagtaggagattaatttgtaaagagattttggttcttatcatggaactcttgaatgtcacagactttgtatcttggtagctaataaactacaatgaatttcaggcaatgaaatttgaaggtaaacttcatgtcttagagttttatgaaatttatcaaatttccaaatgtgttataattcatgaacttaaaatatagggatgtggagaatacaacaagggactagtgagactgttgtgtttaaggaaggagatactctcctttttcttgtgttctttttaaggaaatatatttctagacttgtaaaagtatgttgtttgtcttctatcagcacaaaaactcgcatatgaaaaaatttgcacaaaggtttaacaagagcaatggaaaatagcaaatggtacgaataattaaagtaaaatattttctaataacattgagtagccaaaaagcactggactaggaatcagaagatttaattccatcacctatcagattccccatgtgttaaaggaggataataaataatgtttactctgcttgttttgccagactattgggaaggtgagatgaaatgtgtatatgaaagtgttttgacagtatagacaatatgccattgcaattagggaaacatctttttgcattataaatttgaggcattaaaattattataaataagatagtttcatcctttggttctataattctaaatacatttttctgtctaggtctattgagaatatttcttactcttacttagttttcatttctgattttcccttcctttctttgggcagtatttttcataagcttttgtgtgtgctaaattttatttaagaaatgcaggggtataagcatatatttctaaatttgcttgcatttcctaaggaaagttttacaactgggatacaccggcagttgtaaaaatggttgcctaaagagagtagggtggagagaaagtgggatggacagggataggaatgaaagctcaatttctaagtgaatacccttttcatatatactttttaaatcagtaaacttccttatttagagcagttttaggatcttagaaaaattgagtggaaagtatagagttccccttatatctactcccgcccaccacacacacacacgcacagcctcccccactatcaacatgccttaccagagtgtggcacatttgttaacatcaatgacccttcattatcacctaagtccatagtttacatgtttacattcgtgttctctgttggtgttgtacgttctgtaggctttgacaaatgcagaacaacgtgtatccgccataatagtattatgcggaataatttcactgccctaaaaatgctctgtgttccacctctttattcctcccttcccgctaacccctggacatgactgatctttttactgtctcataggtttgccttttccagaatatcatatagttggaatcgtacagtttatagacttttcagattggcttctctcgcttagcaatatttaaggtttgatagctcatttctttttagtgagtaacattctattgtcggcatgtaccatagttttccatttacctacttaaggacatcttggttgcttctaagttttgggaattgtgaatgaagctgcattttatatgattgctttttttttttccctctctctctttttagcatttcaattatacttctattttttaacttttcttaatggttaccctagagtttgcaatataaatttacaactaatctcagcccactttgaaatgacatggtactgcttcataggtagtgaagtaccttgtaataacagaataatcctaattccttgttcttgtcccttgtatcattgctgtcatttatttcatgcataagtaataattcatatttgagtacattgttggcattcttttgatcaaactgttatcttttagactaattaaaaataaaaggtaaaagtttttattttaccttcacttattcattctctgatgctgttcctctctttacatagttctgtttctgatttgtatcatttttcttctttttgaagaacttttcaatttttcctgaaatatagttttcctggcaacaaatcccctcagtttttgtttgtctgagaatgtatttctctttcacttttgaaggataattctgcagtatatgaaatcataggttggtgaggctttttttttcttttaaatatttcacttcactctcttcttacttgcatgatttttaaggaatcagatataattcttatctttgttcctctatgcataaggtgtttttttcctctggcttctttcagggtttttttctttatttttttatattctgtagtttgaaaatggtgtgcctaggtatagttttttttttttggggggggggtggggggtgccatttatccttcttgatattttttgaatttcctggctctgtggtttgatgtaggaaaattttggggaattatcagacattattgcttcattccatttccttctggtattcccattacatgtaacttataccttttgtagtaatcccacagttcttggatattctgttctgtttttttttttttttccagtcttctctttgcttttttcattttgaagtttctattatattctcaagctcagagattcttttctaagtggtgtctagtctactaatgagctcatcaaaaatattatttatttctgttagtgtttttgatctctagcatttctgattctttcttagactttccatcttatttatctgttcttgagtgttgcctactttaaccataaaatctttaacatattaataatagtttttaaaattcctggtctgataattgcaacattgttgccatatctgactctcattctgatgtctgtccagtctctgtcccgtttttagtatgccttgtaattttttgttgaaagacagatatgatgttgttaaccttaaataacaagattagaaaataagtatagactttgagcccaaagcttgaggatggccaccagagagcatagattctatttgccttgaatatacattctgattagcagtgttacaagtgggtttttaaggaaaaaagaaaaggcagttcctaagttgttaccaagaatttacattaaaatatcagaagctcttggttagctatacattcgttctttgtatcacaaactccaggaacgagaagacgatgggtgagacaggtagccagtaaaatgccttcaaacaattgcccctgggtttgaggggccagtgactgaagtcccatattcatgtctctctgggcctactaaattttgcatgcctcacatagctcagactgctttgagctctttttcttttctcaatgtattgggcaaaaggaattgcagtaagtgggccttgagtgatgtagtggcaaggggcgtgtgtgtgcatgtatgtgttggtaaggggccattctgtggtcctatgattaggtcccaatctttagtgaggctttgagactgcacagtgaacaccagggcttctcagcttctcagtacccctgccacctctgtacctcccttcctgccttcctgcttagttgggacaggatggctagaaggtgccagacttgggtattgcccctccttctggtaggttagtctctgataataccccagcaggttaggctctgaaaaattccaaacagattaggctctgttaaaatagtttctcctgagggcaggccttcttaagaagagaatactctggcatatttcagaatgcagcagatattctcttttctcctccctctgttggaagcatgagggtatgtttctctggtattcactatgaggacctggttgagctcttagtggtaaaactcaaaaataaatgtgcggcctccctatgactgggctgcctttggagtttttaatctttcaggcttgtccacactgaacctccagcaattcttcagtcacagtttaggttttcctaaccaggcactggttctctgcaaggtttctgctgtgggtttttaaactgccaagttgtgattctccatagccacctgtctgtccaatttggggacaacagtttgccctgtgaccttacttctcttacatatctaagaagagttgttgatttttcagtttgttcaggtttttactttttgttaggatgctgtggtgacttctggactccttacatactggaagtggaagtctccccataatcttttaaaacttagatttcaaaacaacatgttttatcattgtgatacggctctgatgagtggaggaacaccagattcttcctcttaagttgaattagaaaaaaaacgacatggacacacgtggagtagttttaaggagcagggagtttaataggcaagagagaagggggaggaaagaaagaaaaagctcgcctctacagagacagagggaggggggctccaaagccaagagacagaaccccactttcaggtagtatcaaccagctatactggaaggctggaggaggcagtgtctgatttgcatagagctcagggcattggtttgaccaggcatgtcattcacgtagccggcgaaaaaactggccctcccaccctctctttttaatatgcaaatgcggggcaccatgatgttccaaacacgtggggatatgtaggggcagccatactgccaggcacatgtgggggcaagggcaagaggacaacggtgggaatcgccatgttaggtggacccagtttctaatggctaacatttgcatatcaaaggttgccagcccgggtctaagacccaaggctttcattctagataagagctgcgaaaaatcttccaaggacccctttttttcctatgtgcctaaaataatttcttaataactcctacctcaattgagggtacagcaaccaagaactttgtttttttaaaaaaaaaaatttcttgtaaagatgaaaagatttccaaagatgctaattaaagtgttaaatgactagctggaaaaataacagcttgttattttattgagaaacctaagaacggtatgatgttataaagataaacactcaaaggggctattactattattttctactgagaattaccccagtagccttctcccttttgaaggaggcagggaaatgatgcagtggtattgaggagtgaagaaaaatggtattagtagagcagctaataatactggtgcatattgtttggaggaagtagaaataatgagtggctagtagatttgaaatgctttaagcattaaagatgtcagttcttcccaaattgatctacagacttagtctttattctttatttttttttcatgttctttcatgaggtggcaaatctataggtttattgcagtctctcaaaatcctagcaagattcctttagatagagacaagcttattttaaattttatatggaaaggcaatagaactggagtagttaaacagattttgaaaaaggagaataaagtggaaagaatcactctaccagatattaagccatgctatattgccaccttaagcaggaccatgagataattgcgatgtaataaacacacagatcattggacgacattagcaagcccagatgtaggctaacagaggtattttcaactgattttgagaaaggtgcaaaagcaaaaataatcttgaacaaatggtgctcaaataagagaccaaaaaaaaaaccccaaataacttccccaaagctctcataaatacaaaaattaattcaaaatgggtcatggatttaaatgtacaacataaaactataaaactgttggaagaaaatattggagaacattttctggatctagggcttggtaaggagtttttagatatgacaaaaaaaatcaataaaaatgaataaatgggacttcattaaaattaaaattatgtgctcaatgaaagaccctggtaagactataaaaagacaagctacaaagtgggagaaaatagttgtcaacataccttacaaaggttttatatctagactatataaagaactctcaaaatacaattaaaaagcccaagcaatctaattacaaaatagggaaaagacaatagacatttcacccaagaggagatagagatggcaagtaagcacatgaaaagatgttcaatatactgatattgaattttacgaaaatgccagttaaaaccataatgagatattattacccacctgtttgaacagttaaaataaaaagtagctaatactaaatgctagcaaggatatggagaaagtggatctcttacatgttgctggtagaaatagaaaatggcacagctactttggaagacagttggacattttttaaaagaagttaagcatgtaacatgatctgacctgtcagttacattcttgagcatttatcccagacaagtcaagatttatattcacagaaaaatctgtacttgtgtgttcatagaggctttatttgtaatagcagaataccggaaacaacacaggtatccttcagtgggtgaatagttaacaaaactggtatatccatgcagtggagtactactgaacaataaaaaggaatgaacttctgatatatacaataacccggaggggcctcaagggtgttatgctttgtgagaagaattaaatctcaaaatgttacatactgtatgtttccatttatataacatacttgaatgacaaaattacagagatagagaacagatgaataatttccaggggacagggcctggggaaaatgaatgggggagtaagtagaaatacaaagaggcagtcagtgtgagggagttcttttgtgataatggaacagttatatattgtgattgtggtggtagttacatgaatctatacacaagataaaattgcacagaactatacatgtacacacatgtacatttttaaaatggcatgtactaggcttctccagagagacagaaccagtaggatatatgtatatataaaagggagtcagttagggagaattaactgacacgattacaaggtgaagtcctatgataggatatctgcaagctggggaaagagagaagccagtaatggctcagtccgagtttgaaagccggaaaaccagggaagccgacatggcagccttcagtctgtggctgaagtcctgagattccccgggaagctgctggtgcaagtccaaaggctggtgaacctggagtctgatgtcccagggcagggaaagcggaagcaggcttcatgcactggaagaagaaagagccagaagactcagcaagcagaattatcccaccttctaacacctgcttgcccacattgagggtgggtcttcctctttcagtccgttgactcaaatgtcagtttcctctggtaacactgtcacaaacacacccagatacaatactttaccagccaattaggcatccttcaatccagtcacactgacacctaatattaattatcagagggtgaaaactgaaataaggtctagtctaacactaatgtaccattgtcaatttttttgttttatattgtgctacagttatcatatgttaccattgggggaagctggtggaagagtacaagggattcattgaactatttttcaatttcctgtgagcctattatttcaaaataaaaatttttaggaaaaggaagggcctctatgacttgcttttctaaagactggaaaccaagcccaagaaattctgtaccttatatttcacctgcagtgcatataaatttggtgagttcctcaagattgccaaatttggttaggctctttggcctacaaggaagtgatttttcttaccagctataaggctgggatctgtaattcaaacttttgggtgttattaacatgtagatgctatgcaaatcatgggataagatgaattcactttgcgaaacagagtaggtaataaagagagtgcaggaccgatgagccatgaggactccaggtgttagagactggatagattaagagtagccaataaagaaaactaagaaggagcagtcagaggttaggaggaaaatcatgatagctgagagcatacctacaatgtcttacggaaaataaaagtaatcattttccccttatatttaattacattaatgtcttaatggatgcatttcaggcaaacatttattatgtttttcctgtggatgctagtgtcctgggtgttggaggttgaagtagggaaggctgtagggtattgcctgcttttatgtaagtaatatactttttaccttcaatttactgtctttggggaaatgataaaagcttaagaaaatacttctacttcatagttgtgcccaagttggacagatgttcatctcaattttaattttgtaaattcattcatttatcatgaacgtattaggctgtacagtttttcctgatattctagctattttcttgggtaagaggtgccatagaactggaggaaatactctttagaggagctacttgaagattaactgttataatagagagtaagcgacaaccaaaacaggtttaaaacaaaaagctgcaaaaactatttttacgtctccatataaaataaaagaaaatagtagatgaacaagtgaatcaggaagatctcttggaaaaagccatgtttatcataggaagaagatacttcaaaaaattgaaatagcttaaagaaggaggaccaaagtaaataatatgtacaaaaaatgaccattgaggttctgaaataatattttatcattattttaatgttaaagatgtcacttgaatacatagaaaaatgcaatatgaagatcttaatattatgaaaatatgtccatctttatgctttttaacaaaatggtgggtttttttccctgtgttaattgaaatactattttggcagtcatatctttttttcaattatctgtaaacttagatttgtgcatctatgcactatgcatctgtaaagtgaatagatgcactttaatttcagctgaaagtttgaatcctagcattactgtttttgatttgctgcataggcagtttgcattttaagggtgtaccctttcttttcaattatttttttgttcaaatacaaaatttgggagtagaggttatttctaatgacttaacagcatcatgtggtatgtctgattaaggttgattaaagtttatgccaaataggttgtggtaatgtaaggcctaatttcaggttgaaaaaaaaaaaggccccaagttatttctaaccatgtttaaactcagcactagacttgctatttagattgtgaactataacttcaaaaatgctaatgatttaagacacagaatcctactagaacaagaaagaaaaactaagtttcatctgattagaatgttatgttcgattatcatgcgcttcagttttagatgacaaaaatgggaagatgaggaacttttgtggtgtttttcagcactacgtagataatttacatagatagtcagaatgttgattctggcttctggcaccaaaatgttaccaactgatattgtgtgtccttcagtgacttagatcttaccttgattctgtttgtggtatagtttcctacaatatcaccatttaaacaatgttgcacactttgccttcaaactggaaggaccctattagaagccattttgattgagaagggtcattgctggttggcgtattggtctgttaaagagaatctttattgttgtaaaatatataatgctttaagcttgtgtattagagaggataacagtttcttttcttagatcacctgtcatttcataaaatgaaattttatattaatttttttttgaaaagttcttagtggaaatagtagaatatttaacagctttttggaaaaaattgagaattccttctttattttaaacccttcaaaggcagattgattgattgattgattgatttatgacggaatctcactctgtcacccaggctggagtgcagtggcatgatcttggttcactgcaacatctgcctcctgcgttcaagcgagtctcgtgcctcagcctcctgagtagcttggattacaggtttgtgccaccatgcccggctaagttttgtatttttagtagagacaggtttcaccatgttggccaggctggtcttgaactcctaaccccagtgatccgccctccatggcctcccaaagtactgggattacaggcgtgaacctccgcatcctgtccaaaggcagttttaaaaaatgatctaaaaatggtgaacttttctttattagctttaatcataataacactagatattatccttgatagttaatattaatagtagtcatttatatattactacttcttaagactttttttttttcaaacttttttgccctttggaggaaagatgtctacctttttgtataacttgccagtggtattcagtggatcctcattaaaaattattgtgagattaaattgtaaatagtcttttaaaatagctttttttttttttttttttttttttgagatggaggctcgctctgttgcccaggctggagtgcagtggcacaatctcggctcactgcaagctccacctcccgggttgacgccattctcctgcctcagcctcctgagtagctgggactacaggtgcccaccaccacgcccggctaattttttgtatttttagtagagacggagtttcaccatgttagccaggatggtctcaatctcctgaccttgtgatccgcccgcctcggcctcccaaagtgctgggattacaggcgtgagccaccatgcccggccttaaaatagctttttgagataaattcatataccatacagtccactcattaatgtgtacagtggtttttggtatattcacagatatttgcaaccattactatgatctattttagaatattttcatcatttcagaaagacactcttctctataccttaagtctctacaccctgtttccctatttccccagccttaagcaaccattagtctaccttctatctctgtagatttgcctattccagacattgcctataaatgaaatcatataacacgcggttttctgagtggcttttttcacttagcataatgttttcaagattcagtcatgttgtaggatatgtcaggacatatgatctcaaccaggtagactgcctggtaagactaagacaccaacattttccagagttttgagaaagaaccaaaagtgtacatgctcatagcatacacagtgcagtccaaaattactcagtctatcaggaaattatgatttagtctcaagagaaaaaacaactaatggcaactgtatttagtccattttcatgctgctaacaaagacatatctggccaggcctggtggctcatgtctgtaatctcagcattttgggaggccaaggtgggcggatcacctgaggttgggagttcaagaccagcctgaccaacatggagaaaccccgtctctactaaaaatacaacattagctgggcgtggtggcacatgcctgtagtcgtagctacccaggaggctgagtcaggagaatcacttgaatccgggaggtagaggttgtggtgagccgagatcatgccattgcactccaggctgggcaacaagagtgaaactgcatctcaaaaaacaacaacaaaaaagacaagacataccccaagactgggcaatttataaaagaaagaggtttaattggacttacagttccacgtggctggagaagcctcacaatcatggtggaagtctaggagtagcaagtcccatcttacatggatggcagcaggcaaagagagaatgagaaaccctgataaaagtggaaatccccgataaaaccatcagatctcatgagatgtattcactatcatgaaaacagtatggggaaaactgcccccatgattcagttatctcccactgggtccctcccacaacatgtgggaatcctgggagtacagttcaagatgagattttggtggggacacagagctaaaccagcaactcaagatgatccacgtatgagaattattggacaaagactttaaagcatttagtttaaatatgttccatgaactcaagaaaaacacatttgttttcttccaggtgaaagacatgatagaagtatctcagcaataaaataaaaactataaaagaaacaaatggaaattttaggacggaaaaatacagtattggaaaaaaaaattaaatgtctttgagaggacaaaggagattacataggaataaagtatattcaaattcaatttggatatagatcaataaaaattatcccatgaaaaacagacaaaaagattgaaaaaatgagcagattctcaggaatgaaaaggtgtaacatgcaagtaattggagttccaggtagagagaatagagacaataggacagaaaagaataatagctccaaacttcccatgtttggagaaatacatgaatttgtagaataaaaaattgcatagtgttacagctcttttagaattgcaccagaaccctcccctgccctccaccccacggaagaaaattgcagcaaacccaaaacaacataaattctgggaaaaccacacctagctcatcaaaatcaaagtacagaatacaatggatagagaaaaagtcttgaaagcaccagaggaaaacagtatatcacatacagggaaaaaaaaatggaatgatctcagatttctcatcaagaccacgggggctaaaaggtaattaacatcttcagagtattgagaggaagaaaactatcaatgcagtattctgtatctggggatattttcttcagtaatgaagtgggggtgagggggagacattttcagataaaggtaacccaaaagaattcattgcttcaggccttccttacaagaaatgctgaaaaaagcacttcagaatgtagggcaaagatagcagaaggcaacctggatttttaggaaagaagaaagagaataataattagtaaatatctcagtgtatatgaaatactgtatatatatatattttttttttcttacatctttaaaatatatggctttaaagtaaaagttgttttttgggatattgaatgaatacataatgtatatgacagctatgagataatcgagagaggtagggcataaacaaattctagaataattatttacctttaaagttaaaaaaaaaagtagggggcataaagagccagtggattagaggggagagaaaactactttatcattagacttcccagtgatgaagctttatgataaagatttataataccctagaaaagaaaatgtgaacaaaacagactttcaggtataaaagacatgtacaaatgttatcaaatacaagaattttaggaatgttgtttccatgaattcctcttgaagaagatactaatctagttagtatagtgtaataatatatactagttagtatagtatacattttctagtataacctactagaaaatgagcttcagatgactaacatggctatagagatatcagtataaggactggtattgctcattaaatagtcagttgtagaactaaagcagaaaaaagttaaaaggagtgagcacaggattaatggctatatgctgtggcatgagcatgtagtataactgtaaaagtaggtagtgataattgggagaatttatataaaatttttttcaaactgtttgcagtaatcaaattagtggtgacagtatagttactgttattttgacattgttgtgtttataacgtgaaatgaaacagaatgattatggagtattctaattttatcccttatgttaagaatcagaattcttggtgtagaagaaaggagatgctgatgtaatctggaagagatcattaaaaaccctaatgtcgtgaatttgaattgaagatatcattgtgggctgggcatggtggctcacacctgtaatattagcactttgagaggccaaggcgggcagatcacttaagatcaggaattcgagaccagcctggctaacatggtgaaaccctgtctctactacagatacaaaaattagcccggtatggtatcacacgcctgtagtcccagctactcaaggagctgaggctcaagaatcgcttgaacctgggaggcggaggttgcagtgagccaagatcgcaccactgcactttatgtcagtatgaacttctgcagtatttcatacacacacccagtacaccatacatacagctctgtgtggtgaaaataactagaaacagtgaccagcacgtagcagtgagcatccctattgacagattatcgtcctcacatacgatttcctactgcagggaaaacaggctacttggagaaattgctgactcaagatctagataggaagtgtacaagatgagccctgtatgtcttgtcatgccaaatagcaaataagctttcaaagacttttagggtcatgtttgaaggatacaggagtcaaattggaaaggttactagtggcgtaagatgggaaaatttcaaatttaatagggataataatagaaagaaatagaaactcatcagatgtgcctgtattaatgagttttaatgagtgcataatgtacctgtaccagcctcagtgccttggagatgaactgaaaatatgaacagtacatgtaatgaatgattacttggtagtttatcatatgctgtgttaaagtataggatactacccattatccagttatttatttatatatatatatatttaaattagacttcaagtttgcagaggcatagactatgactttttttctattgtactcagtggatatattttatgatgtctctctggaggttttcttcatctagacctgcagccttgtggtttcaagggcttctttctgggtgttggttaataggttgctgcaacacagcactacagttgtcaagtcatattttaggaacagttgctgttatatctggaatttagaccatgaattctatataagttccaaaaggggttatatcagtcatgattgcatggaatgtacacgaaaatatatttcctgataatcaaattatttatctagttatttattcctttcatcttcactgtgttccataatgaatttagataattagaaataagaatgcatgcaataaatcaatggcagaatataaaaaggaataaagaatcacaaaatggaaattatattttaaaatgaagaccccaaaccaaggagaaataatgaacagaagtcgagtcatatgcttgaggcacaccagctttctgttgcgtagaatctctccctgagggcaagcaggttacatgaaacttagtgaaacttagtggaatatacgtgctttcctatctttgttttaaatcttaaatactggattgaatagattcttaggatggaatgtatttttaaagtaatttttctttaccctagtccaaaaaactaaaatgaaaaaccagttaacttatttatggttttcttcataactctttttatctcatgtagtttcatagtcaagatttttgattacagcttttattaacctcatctctttaatgttgataatattttatataatgtggttgagtaaagtgtaccgatataggaaatagagcaatcctattttaatagaatttgttgggggggaaataccacataattcatatctagagagtttttcatctgttatcccataagaatttcatgaaggattggtatgtgctttgcctataccagagctttgcgctgatttcttctctttcagcttagatttgtgggtatgatttggcagttatcctcttggaatgtgtaaaatcattacttttacaatgagatagaaatattttgaggcctaaggcttactcaaaattctctcagtctcttacaggcctgagtcacatttcaaaattggaatttttcatattgctaatggaggaactatttttatagtattgtgaaactattaaagaataggtaatgttatatggatgctcctcgacttacagtgggctatgttccagtaagcccatcataaagttgaagaatcataatttgaaccattgtaagttagggaccatctatagttaaaaatatagttaaaaactgttacactagagtataggtgaactcaggatgtgcacaattaggaatttttaaatataaatatagttactatattacagttcagttggtatttcagtaactacaaggaatttggggcaactacagagttttagaggaaaccttccagttagaccactccaagttctgacaccaattggaagttcgaggggttcccaaaaccacctcttagttttgataatttgcaagactcacagaactcactgaatgctgttatacttaacagttgtattttattacatggaataccgattttattacatggataccgatttaaatcagccagaggaagaagtattaatatatagggtagagttaaaaaaaaaataccacatgtggagcttacatcattctttcttggtggaattaggacagcccagcatacatatatgatagtgcttaccgagtattgccagccagggaagcccacctaagcctttagtttttatagtttttttagggtggcctcaattacttactgcctgtgtgactgtctttagtctccagcccttcccaaatgttgggctgatagctttagtctccagtcctttccagaggcaaaacatagtatgactcaaataaattacatgtatcataaattacattggtagattgtctagtagtcaaagacactcctatcagttgtgctattccaggagcctagcgaccatcttccagtagctgaggataaaagccagacctctctttgggcaagattaggccttcactatacagataattccgtggtctttaggcaagctttcctatgatatttggacatcttcatttagtgtaatgttcatatggcagatacagcaatagtatcggtttgaatgtatctgtcatttggaggagccaatgcagggtaattgaacgaaacttctggtctatcctataaagccattatatacgttttcatatttttgtactaatgtaattacttgtttcctccttttatctgtcactatttgtacttgtacagaactatttagcatagaagttacttgataggtagctaaatgtagttattcctcaggctggccatttgattagatcctgaggagcctttaactgaatctcccagtgagtattcctgagatcagatgctattggctatactgtagttttagaaggtttttcttttagtgatatattatttatctacatacaagtatttgttaaagagagttagtgtaaagacatgttaatatataacaggataatgagaagcataaaataattctataaatttgctcaagatgatttttttttagcttagaaaaccttattttgaaataagtttggaatcacaggaaattgcaaaggtagtacagaaaggtcccatgtacctttcgcccagtttcccccaactatactatctatcctactcatggtaggacttcttccttccgtctcagtgggcagtggtttaatctgcattttattgccccattactccccgcttttctcttctttttctcatttgctgaatttgaatgtttattttcataattacacataatttgaatttcatagtagtctttctttgaattacattttaaatgtggtatgtgggttgttttacttgttctccttgttgattgtatctggatggtttttggaaagatgcagagaaagattaggatttgtataaccaccattattttgcagtacctggaattatagaatcattagttttttattcccataattcttaaataatagcttcactacccagtggaaaagattagtttgagaaaagtttactgacagaattttttgaataactgttttctcaaatgtaggatgaaccccaaattaatgttccataaagaattctaatttctgactgacagaaaggctgttggtgatgtaattttaccagtgtggactttcttttattactgatgtaatatttctttgacaaaattaagagacaatttcaaaaagcagtttcattttaatataatgcagtatgctgtttttatgagtataaaaaaggaggagtaggaaaattagaaaataaaagtattgttttagaagagtccactaccctaacctatataaatgataaaaaggaaccgaatgggagatattaatgtgatgttgctgggaagagaaatgcctgtcttaaattagtggttgtcagggaccaatcccctgtgcaatattttgattagtggtgtctgggttggggccaaggtacatgcaattaaaataaccctctatagttgaattcagtgtccagccagaattgaaactatatagattaactaatgtcgtatccgcattttggtcttatgggggtaatatttgtaataatcatgcttttggtactgatgttctagtgaagttaaaaaaaaaatcacccatagaatgttgccctttcaatgtaatcgttgttttagaatgctttttttttgagacaggatcttgctctgtcacccaggctagagtgtagtggcatcgtcacggctcactacagctttgacctcctgggcacaggtgatcctctgacctcagcctcttgggtagctgggaccactagcgcaggcgtggaccactattcttggctaatttttgtagtttttgtagcgatgaggttgctcacgctggtcataaactcctggactcaagtgttccactggccttgcctcccaaagttctgggattataggcgtgagccattgtgcccagcatagaatgcttttaaagtttttaaaactattattttaaaactaaaatcataaaacttttaacccaaatcttatttacttttgtttagggacaaggaaaattattcattttagaaactttaattagtgtacatgttttgactaatattcaaattatggaaaacttgaataatgtttttacagtaatagatattttatctcttccaaacatttctcagttttcatgaattatcaaagttgaaaataatgttttacctgaactttcctttcactccttttattgacaattcttagtatctggttgtctggctgccacgttatttgcaagacgtcactgactcagagtggttttgaatgccagatgttattttgctgcttcttccagaaaatggaatttgttgggctactgttccacttaacaattgctgtgtaacacattatgttctccagaagcaggcactgagacagaatgtgtcatgcagggtatttattaggggttaacacctgtagaagggaattggagaaagcaggtttgggtggaggagaagtcagattacactgaggccaaagcttcagtcagccctactaggagttctgaagcgtctgtggtcacctgaattgttgctagtttagtagaaatggcatggtctttcttatttccttatcagtcattcaatgcatatgaagttctccaagaaacacaggcagttgtttaaagaggctctctgtaactttgaaggaacctggcagtggggagctatctgttgacatctggggcaaagctcatcattgagggagaagataatacatctctgtccaccatacaccctgaaacactatagtgactaatataaaacaacaacaattttttttttcttttttttttttgctcatgagtctgaaatttgggcaggactaggcagcacctaattgtatcttctctatgcagcatgagttgcagtagctcacctgtggttggaagaatcactgtcaagatggctcacacacatagctagccaattggtgctgcccatcagttgggagttcagccagagctgtgggcatggggtttttgttcttcccatgtgggctgcttgactttcttaacaacatgataagtatgttctctagagcaagtgtctctagagaacaaagcagaattgcatgacattttaatgacctagccttggacgtcatagccagcctaagttctatcatactgtattgattgagacagtcacaagagtccatccaggttcaagctgaagggacaatcttcttgatgggtgagtggcaaggttctagatgaaaatgtggagtgagagatattattgaggccatgtttgaaaaatatggttttctgtattcataaaacttaaaagttcagggtgccttaattagaaataggattggctacatcttttagaaaattcaaattaataatggtccaaatgtatgaggagggctagtgactgaatgaggtccttctgggctacggccctcacagaagcaactaaaaatctgagcatagcacaaagaccattatcctaaaggcactaaagagtgaacagaagcggggagaacctgattgggaatacatcctcaaagaagatggaggtatatgaaatgacatctcatgttttgcagctctcagcctggggctgggtgaaaatggcatggtgtacattgtggcatgggagaagataacaagaagataagtagaagaactctggtctctatggcctgtgaaagctgaatttggggaaactatgtttgttagagaggggatccaaaatctgtctactgacagctcacatgacccctgagtgatagcttcactcagagctgctcagctaaagacaaaagataagaaacttcttcccaagaaacagtttgcagtttaaatgtgtttaatcagctgattaaaaaaagaaagaaaaaaatgctaactggagaaaaattaaagaatccagagtttcagaaatttaacatttattatgttcagggaacattcagaattacccaatgtataaagaaaaaggagtatgtaactcctttacaagagaaaagagtatccctgaaatgacccagatgtagaaattattaatagcagactaggatttttaagtggctgttaacaactattctcagtaaaggtaaataaaatgtgttcacaatatatgaaaaaataggaaatctcagcacagaactagaaacaaatcaaatggaaattctagaaatgaaaaatacaaaatctgaaatgaaaattttcactgcaaaaaattaacagcctagtggagatgacaaagtaaagacttgaagttaaataagccagaagttattgaaggtaacagagaggaaaagattaaaataatagtagtccaaggacctgttagaaaatatcacaaggttttatgtacatgtactttgagatcaagaaggagaggaaagagaatgggccagaaaaaatacctgaagaaataatggcctcaaatttgatgaaagatataattttatgtatttgagatgctcaagaaacaccagggggccgagtgcagtggctcacgcctgtaatcctagcactttgggaggccgaggcggatggatcacgaggtcaggagatcgagaccatcctggctaacacggtgaaaccccttctctactaaaaatacaaaaaaaattagccggacgtggtggcaggcgcctgtagtcccagctactcgggaggctgaggcaggagaatggcgtgaacccaggaggcggagcttgcagcgagcggagatcgcaccattgcactccagcctgggtgacagagcgagactctgcctcaaaaaaaaaaaaaaaacaccagggaagataaatatgaaaaaggccatgtcaaggttcattatagtgaaactattgaaatccaaagacagagagcaaattttggaagcagcaaggaaaaaatgacaagttacatttgggggaactacaattccattaagagatgaattctcattagaaaataaagaagctaaaagagagacttaagaattctatatatccagtgaaaatatccttcaaaaataaatgtgatatgatatttttaagtaaaagaagaacaaaaagaacaagaagccaggggtgatggctcatgcctataatccctgcactttgggacactgaggcaggcggatcacttgaggttaggagtttgagaccagcctgactaacatggtgaaaccctgcctctactaaaaatacaaaattagccaggcttagtggcgggcacctgtaatcccagctactcaggaggctgagggcaggagcattgcttgaacccaggaggtggaggtttcagtgagccaagatcatgccactgcacttgagcctgggtgacagagtgagactccgtctaaaaaaaaaaagaacagaagaatttattgccagaagacctgcactgtaagacatgctaaaggaagttctttaggctgcagggaaatgatactacatgaaagcttggatctgcagaaaggaatccaaggcacttaaaattgtaaatgtctagatatacatactagactataaattttttattcttactaatttcttcacaaaccatatgactgcttaaagcaaaaattataacattgtcttgaactcatcagagatttgaggtcatagggcaaccaactaacctgaaatctaagaaatgacaggtacttccaaggaaaagatcattgaggtacaaaggagagcagagagctgcatattaagaaagggcagcattaggggaatggaaattatgcttctgggaaaagaggaaccaggaaaggaaactgagaagcattaattttagatgggagaaaaaatagagaagaaagtggtatagttgggagaataaccagcagtgtcagatgtcatagagaagtcattacaggattcaaactaaaaagatgctactggatttggcagtgaaaaggtcatttgtcatcttaaagagtattttctgcataatgaatagggaaagggaaagccaaaaaaaaacttttggacaacttcttttcagcactcaaattccttttaagaattgatcatacatttcagtggtaatgtaaggacgaggacttgcattttcttggagcaggtataatcataggtaactttatacttatgaccttcattatttaaaaagattttaccaaatatggaatgcaaaacattttctaggaggcctctagtttttattcttatgtagtattgtaagatgccaaaatcttagctcagtgatcaaattatttgtacagagaataggtagatgtttatctacctacttttctttgatcctacttcttcaagatgttggaaccttttgggtttgtgggtactgtcaattaagtgtaaccttctttctgttcaggtgacactagagagctcttgctattcctcctctcttgagcccccctcccccaagtttgaatgaagtatctatgcttgttttactgcctattgagaacatccttatggagtaattaagagccttctttactcagttgatagatgttggtcagcagaggcattgaggcacccccactcccgcccctagtgagcactaatgggaattggaatgtgtggcttctcctcactttgtttacactttagagtacagaaagaaccagggtggtccttgtataagttcagcttagttcacatcatactttgccccaaacatttttcttatgactactataaatttagatttaaatgaaaataataggtaagtctgaaggaaaaaggaaacctcagaaggccaagctatagtcttggtcaaatgttttcttttgctcgaggtgataaagtatgtgaatttatgtaagttttacgccttactttcacctggtaatttagtgaaatattcaggccagctagatggaaaagccattttctcttttaccctatgaatccttcaaattctgcctcataccagcattatctattatattgcctcacccccaaaacaaaaataaaacttaaatattttcaaacacaacagatgactagggagaagaaatagcccaccctcctgaggcctcgttatttcgaaggttaggagagtttccgtctgcccaaatagtgaccattttaagaacagagacttcagccatggaataaaatgagtaaggatgtggagtgagtcagtaggctacatactttattaaatgtataattgtactcattgttggataaacagagaccaattaatattgtcattttaacatcatggtgcttatctgtgatattgataaccattaactgtttggactaaaatatattgcggactgcagatgatcttagtggcttagtgaaaacattttcatattctttgattaaatgattcagacatttacacatgtatttttggtttttaattaattttaatcaaacaatacttaacacagtaaagaaaaaactaatacaaaaaaaggttatattgaaaagtagtctctccagcatacctcttatgcctgctccctagtggcagctatattcaattctattttttaaaagttatttagccccatatctctaatgtcctgatatgttgatgtttctagatttgcgaattttggacagtttgtaaagacttcttttgcctgccttctatgctagtggaggatttagctgtttgtattcctctttctacttttcctccctgcattctctcactatacttttatcactatttttgatcttcttggtagataatggttgcatttttgagactttgtaaatattgtttattgctgagccaagaaatatactataattttttcctttcttatctaacaatttttcctataattaataataggctcaaatttgttttcagttgtttgtcagtactcttaaaatttccttttatgtgtactaaatgcctaacagtacattttcaagtattcgagtacatcaaatcatgtatcaagtcaatttagttcctttctcccaaccttgtaggcagttataattcagcttccttggctctgcattatttatcatatgtatgttctccatctttgaaaattgtgttgacacccatcatcttccattgtcttttcttacattcacttgtgagtttctaccttttagttcttgtattgtcattttactgtagttctggagggagcagagataaacatgtttactcccataaatatttttggggtgatgagggaataagaagaaggatttctgttttctacttttatgtactcctatagtgcatagtattgcatttaattcagtgctgttgcatgctgtaaatgtttaattaatgcttattgaatgttttactttgtcagttgttacattcttatcccaaccctcactctacccccaacatgcttatgggatcctgaaattttatttcctaaaacctgtctttctctcagctgctaatatataacataagattatttatacaagaagactatgtattgatttggaagaaaatgtgaagtgataagagtaatgttgagccctttgcattttagtgatttattgagagtttactgaatgttttgaaactaggatctggtttccagagtctgaatttttaaaaatttagttaggggtgtgtgtgtgtgcgtttgtgtgtgcgtgcacgtgtgtgtgcgctcatgcgcacgcacttgaaaagagataggagtcttgctctcacctaggctgaagtgcagtggcatgatcatggctcacaacagctttgaactcctgggctcaagtgatccttccacctcagcctcctgagtagctgggaccacaggcatgcaccacaatgcctaagatttaatatttttttttatagagacagagtctcactatgttgcctatagatgagatatgtaagttctctgtggaaaataattcataactgaagaatataaaaaaagacttataggtttagtgtatatacagatgggaagtgtcacattgcaaagatgtcagttctcttcagattaatctataaaatcatgattcccataaaaatttcaatatgtattatagaacatattaagctaattccagcattgatctagaagagtaatggcaattaaaaaatatgctctgccgataggaagctcattattttataattaagacactgtggtattggtgcaggtagaggcatatggatagggtggccattcatcttggcttgtgtgggagagttccaatttatgcctgttatcctggcaattattaataggctccctttcactgtaaagattgtcaactgaaaaaaaatagagtaatacagtaatatttttgctcttcttgagagtcctgaaacaaacccactaaatttatgacgtatgtggtattagataatagtggtgaaaggatatcattcagtaaatggtgctggggtagaaagaaatgtaactgccctttatctcacactacacacaaaaattaatccccggtagatttaaaaactggaaaagcataactttaaaacttacacaagagaaaattaggacaccatccttatgatgtctgggaagacagaaatcatagtataaattataagactacattagtattttatatatatatatattttttttttttacaaataagaaggacattaaaaacaatggaaaaacaagcccacatgcagggagaagggatttgtaacacatcatgaagaactaagttcgagtaaatagaatccctgaagattaaacaaaaaacagtgcacacacaatttttacaacggcaagggatattaacaggcattttatagaagaggaatgtaaaatgaccaatgataccagtgataatatgaaaagattctcaactgtattcgtaatcatgctagcacagttgaagatgtccatatctttcatctcagaaatttcacttctacatctatagtctggagaagcattcatatatgagtactagaagacatttattaaaatattcatccagcattctgtgttttaacaaaataaaaatgggcaacaatcaaaattccgttatcaggagaattgataaattttgatatgtatataattaaaattaattaaaattaatgaattaaaacaatatgtcccaaaatagatgttttagaaacatatatacacacacatatatatgtttggaaacatacacacatatgtttggaaacatatacacacatatatgtttggaaacatacacacacatatgtttggaaacatacacacatatatgtttggaaacacacatgtttggaaacatacacacatttatgtttggaaacatacacatatgtttggaaacacatatgtttggaaacatacacgtttggaaacatacacatgtttggaaacatgtttggaaacatacacacgtttggaaacatatatgtttggaaacacacacatatgtttggaaacacacacatatacacacacatatatgtttggaaacacacacacacacacacatatatatttattttattttatttttttcttttggagacagtttctcattccatcacccaggctggagtgtagtgacacagtcacggctcactgcagccttgacctcccaggctcaggtgatcttctcacttcagcctcccaaatagctgggatcgcaagcatgtgccatcctgcccagctaatttttcatttttattttttgtagagaaggggtctcactgtgttgcacaggctgttcttaaactcctgggctcaagtaatcctccctcctcggcctcctttggcctcccaaagtgctgggattataggcatgaactatcacacccagctgatgaagcataatatttgaataaaccaagttgcaaaaggcaatgcacagtttggtgtcatttataaagacattttaaaaagtacatagttttatgatgttgtatataggcataatagtgtaaaatatgcatggatacagtaaacaccaaatttaggatagtagctatgtctgggtagtggagggagaggatgagatcaggaatggtaatagaatacttatgtttttcagtactatctgtaatgtcttgttaatttttagtattttctattttatttatatagtattatgaataaaatatattcacataatatgctttatgtatatgtatatagtttataattactatctataaaataagcaaagatattattgatgcatataaatcctgtctttgcagttcctttaatctcctttacaatctaagaagtactataccagtagaagtaattcgtagtgactgtatagcttaatttttaagataaagaataaaatattttttcctcatctaaaaatggtcttagtaattgctaagcttccttccagaactaaactgtacttctttgatgtttcctctacagcagatctttttcaacaggttagaatacagtcaaatgttgaggattataaagctaataccctatacagattgttgttttcaatcaccctgtctctctttagcaaccatctatcatctacaataggggtttgaaaactttttctataaacagcctgagagtaaatatgttaggctttgtaggccatgtggtctgtgtcacagctactcactttgcctttgtagtgtgaaagcagacataggcaatacctaaatgaatgggcatggctgtgtttcaataaaactttatttacaaaaacaggcagcaaaccagatttggccgtgggccataatttactaactcgtgatatacaacacactcagagaaattgcttcagtaatcaaagtaatactgttataatattttacccttattatgggtggtaaaactgaagcatagagatcttaaatggcattattcaggttaaagtagccctcccatattcctgtaatttacatggcaatgtaattttttaaaaaatatataggttctccagagattctttttctccctctaaaagtagagtgagttgggtgggtataatctcttagttattcacaattacaacctttactatgattagaaacttaatattgttaagtccctgagaatcttctttacagaaccattttatatatgattatttttctaaggtttgcattcacatgcaaaaacaaatacaaaagctggtatatgatatagtttagatttgggtatcttacacaccattgacttaacatccaaagacaatgaaagctttaaataatatagacagtctattaggcagttgttttagttcttctgtaaaatcaactttatgaagcaatttctttgtgttgtcatgacctgcagtaattgagactttatctatctgcagttatcttaaggtctagaaagtatatttttccctgtccagtttcatgggctagaggatagtattttttgtggttatcaggtaatgttgactcttctgtatgcagaaagtaggtctaccatagtcacattggaatctgtgtaaatcaaaaggaaagatagtaagattaatttaaccagaatgaaaattaccacactactttttatctctagaagaatactgaaattacatgtgtttgagaaagttttaatatgaatcagaaccaggatttgaattaataaagtaattaaatagattttcttagaatattacttttaaaataagttgagatttttttctgacaaaaagaatatcttaccaaacaatgaattgtttatttttccactaaaaattgaatttatttattttttcagagacattaaacctgacaatatactgatggatatgaatggacatattcggttagcagattttggttcttgtctgaagctgatggaagatggaacggtaaataaagataaatcctaaattattttgttcacagacatttcccttgctatttgtctgatatatctgttttagaaaccatctatttatactatctacccatccatccatttgtctatctatgcgccacctccttccacaaaggcatttgggcatacttacagtggggttgtctaaaaagtcacaagccatttcagctgcttatatcagtgatcttaagattgataaaatataccctttatgagacccttgtttgctccttctttagttggtgacttctgttgtactttagatatttcaaagttcaccgggggtaaaagaactaagtctcacatagaaaaagaaaacgcagctttgcccgcacttttacttttttgtctttctttcctaaattgcttagttattctaagggatagtgttcaacaaatgaatccctttttcagaaagttcacaagttgatttagtttcatgttcccatttgcttaacttttgctaaccctaaacccgtcagttggttttttttgtttacttaatagctgggcatggtggtgcgtgcctgtagtcccagctactgaggagtctgaggtgggaggatctcctgagcatgggaggcagaggttgcagtgagccaagattgcaccactgcactccagcctgggcaacagtgaagtcctgtctcccaccccctcactcccccagagccacccagaaaaaaaaggctgggcatggtggctcacgcttgtaatcccaacactttgggaggctgaggcaagaggatcacttgagtccaggagtttgagaccagcttaagcaacatagtgatactctgtctctgttttaaagaaaaaaaaaagtttatatgccacagttttattctgtttttttttttttttaacttcatttttttctggccatataggagaggtccaaaaatatatcagtttaattgacagaaactttttggaggacagtttagtataatacattccaaaagccatgaaaatgtcacattactctagaccagtaattttaactttggaaaaattttattattttttttttagacaaagtctctgttgcctaggctggagtgcagaggcgccatcttagctcactgcaacctccgcctcctgagttcaagtgattcttctgcctcagcctcccaagtagttgggatacaggcaagcaccaccacgcctggctaatttttgtattttttgtagagatggggtttcaccatgttggtcaggctggtctcaaactcctgacctcaggttatctgcccacctcggcctcccaaagtgctgggattacaggcgtgagccaccgtgcccggccaactttggaaaatttgtcctacagtgataactttgttaaaaagaattatgtgacctctgtctctggccatgatagagggattaaattggtaccaaattagcactcccactgtaaggaactgtaaaactggatacaatagttgaagctactgttttccagcagtggacaacaggcagcataatactattatccctgacataaatgaactcgtgaggtattcctcacgattgcgcaaagactggggcagttcctgactctgatgcagaaagctagagtgaaagcagagctggactacctgcagcagctggaatatgcagggcttggcattggagaggagggaattgtgcagagagagggcataaagtgcctcatgaaggttgggctgtgcattgtaccacaagaccatatgaggcttgacaatagcagatgatagcatttgaaaacagaccagaatactaatgatcaagcagatctcccaggcaggaaacagtgctaggggaaattgaattttcatccctggagagccagctaacacctttgtatcacctaagacctactctctaacaacctaagtccaagccctgattagatccatagagtttggaagtcttccttccaagtagaggggcttatgacaaatcttagatttttgtatgaacctacaatcacagagtgtatctgtaagctaactcatggtcaaggagatcagtcagtaatttttttatgtgcttacataagaattgtttttcttcataagaagataatagaatcaatactctctataacatcttattcacaatgacaaggattcaaaaaaaaaaatcactgaaccaaacaaaaatgggcatgtggatagtgatacagagtcagataaaagcagtcagtagaggcctggctggcacacatgttggacttagcagacagagaattaaagaagtgatcataggtcggtcacagtggctcacgcctgtaatcccggcactttgggaggccaaagagggtggatcacctgaggtcaggagtttgagactgcctggccaacacagtgaaagcttgtctatactaaaaatacaaaattagccaggcatggtggcacatgcctgtaatcccagctactcactcaggaggctgaggcaggagaatcgcttgaacccaggaggtggaggttgcagtgagccaagatggtgtcattgcactccagcctgggcaacagaatgagactgcgtctcaaaaaagaaaaaaaaaaaaagttataaaaatatttaagaaaacaaaggaaaatgtagccttaaagattacacaaataaggaatttcagcagaaaaatgagtcaaatggacattttacgattagaaagtacagtaactgaaatttaaaattcactggatgaggttaaaagtggactagagataggagaagaaacagccagtgaacttgaagacagatgagtagagatgagccaatgtgaaaaacagagaaaaatattgagactaaataaatagaggcttagggatccatatagaagaagagagtgagatgtggggaaaaaaaaatgtgtacgtaatggctcaaccttcccaaatgtgatgaaaaactcagatctaagaattttaccatatctcaaacctataaagagaaccacatctggccatgtcagatgtggttaaagtgccgaaaactaaagattaaaacatttaaaagcagccagaaggaaagacatattacgtacagaggagaaatggtaaggactactgacctgtcatgagaaatcatggagtgatgtctttaaagtgctgaaggaaaaaaatgtgtaaactgaggtttctgtattaagaaaaatatccctcaaaaatgagagtgaattagacatcttcagataaatggaagatgagaaaaattaatctctagcaggcctgaatgctaaagaatgtcctccatgtcaaaggaaatgatactgtttggacatttggatttatagcataaaaatatcatatgcaataaataagtgggtaaataaaatgtctatactgtctttcttatttaatttacataaaaggtacctaactgttaaaagcaaaaataatgtaatatgtaattatttgtaatgtgggtttatgacatgtagaagtaaaggatatgacaatagtcacataaacaatggaagatatgtatatggaattatactgctctaggataactgtatataggaaatataaagtgagaagtgggtagtgccaggtatgacattggaagagggaaatagcatggtggtgttgctgagttgagaaaacagagattgaaatcagggaggctttagcatctggaatttggggccaccattccagagaggatagagctgcagggaaaaataactccacggagagagctagtgattctccagtcctgcatattacaagcccgatggactcaaagttggagatagagtccctgtagtctgatgtttgcctctctaaattgcttttgaatgcattcgaaatgcaaattccagaatgcatgagtaatatttctgtctctgagtttcctccaattatatttgttcttgaaagtctggtgtgtcctcccagtcattcattctgatttttctggacaataggataatattttatgttttgtttctagcatacttattgatgaactcaaaatggttttcttggacataatatcaagttggacttccattttcaaaaccataggctttgagaggcctatggcaggcctctcaaagtctttgagaggcctatggcaggcctctcaaagtctttgagactttgggaggccaaggcaggagaattgcttgagcccaggagtttgagaccagcctgagcaacatagcaagacctcatctctacaaaaaaatataaaaaattagttaggcatggtggcatgcacctatagtcccagttactcaggaggatgagatgggaggatcgcttgagcttgggacctggtcaaggctgcagtgaccgtgatggtgccattgcattctagcctgggtggcagcaagatcctgactccagaaaaataaataaataaaaaataaaaataaataaaaacaaaaaaaaaactataatgaagaaactttattttatttcagatttttaaattaatttttagattttattgtcttattttttgaggcagggtcttgctctatcacccacgcaagttcagtggtgctttgagcatttcatttacttacatatttcccataaccatatttgtgctgctgtctcttgattatttatttttagatactaactcatactatcctaccatggtagatgaggattcaggtcttttgctctgctcttgcccatccagtacacatcctctctatcctcccaatgtaattatcacacaatacctcgttaaatcctgtttggtattttattatgacaatacaaatactcatcgtcgtgtcatagtttttttaaattgcatttcttttcttcagaacctttttattcttcctggtgtaagtgaccactttgctctgcttaatttcccgtgtaattgtcaccaatttatcctcaaactctccaccacgttgaattacttaataaaaggaatttagcagttcctttttttcccatggagatattcatactggagtcttgcattctcctaatctggactgttcgttctagagacctactgcataggtactatcctaggactacctttcatcgtcttcatggaatttatgttgttctctagtattggactctgtttcctggatcctgtgtggtgatagctgcctgaggaaggttccattggaagtaaatatttcataatcttccatgtctgaaaaatgccttcatattgtattgatagtttgtctggacatagtattctagatttgaaactattttcctcttagaatttagaaggcattatgttgtcttttaacttacagtgttgctgttaagacatctgacaccattctgagtctcagtccttttattacagcctttctctctatatctggaagcttttagaatgttttatttattcccaatgtcctgaaatgttatgattgttgactttgtgtgggtcattatttattatctggacagctgcctcaaatctacgagcttttcccaagtttgtgactttcaaattaagtttcaacttactttttctgttatatctcggtcaaaaccataccagctgaatcaatttaccttaagaagtcaatttctgatggtgaggtgtttgctataattctttttcttgctctaaaattatcttggctattcttggcccttcatttttctatgtgattgttagaattagcatattggtttatatccatacatgtacatacatgtgaacaatccttcataaacactggcttatgtatttaagacctgctttgaaattagcttaattttgggaacatttatgtctataacatggaatcttctcatctatgaatgttgtgtttctttttattgtttcaggttttatgtctgttaatacagttccatgatgtttactattaatccattacctagatgagttagatttgctcctaaacgacttatggattttttaatgttacctgtattataaatgatacttgtttaaatttgcagtttaatagtgtgttgctcttctttaggattagaattgattttgtatattcatcctgaatctagcaatcttgctaattttttatcggtttaaaatagtttatagattcttctagatttttcatataataaatcatgtaatccgtaaattatgagaaactttgggtttgtttcttcacaatctttatatgtgctatttttttctcttaccatggagtctaatgaccttcagtacaatgttaaataggtgcagtaatgtttctgtagcttcaaattaatttaatgtttgcagttagcttttggtatatatatcttatcaaattaagaaatcccttctcatttctgattaccagagtttttttgttatgattctggttgtaactaaattacttctctgcatccatcaagatgatgttaggttgtttttcctttaatcagttaatctgataaatgacagcttttccattgttaaatcattcattctttgagtaaatatgactttatcaagatgttatattgcagtattttaacacattcctagttgactctactactattttatatagtattgttacctggcattcatacatgacattggtcatatctcagactggagtataattttttttccttaaattgttcttgtctgatttttaggtttaggtcattttagccttataaaataaacagaggacccatattttccccttacccattttggctctagaacagtttatagtacagttgtctgttaacttatgtcattggtagaatttacttttaaatcaccttagcctgggtgaagttttgttttcttctattttattttgttttgcagatagattttgtactattgattcaaatttttaatgattataggtctgttggactttctctttcttcctgagttttaatacgttatagtcttttcaatgaaaattgtccattttctctgagttttcaattgtattgccataaagtagttcagaccaccttcttcctagttttaacatctttgttacagtgtcattttgccccccttttcctagtattgtttatttgtgcttctcttttccttcgtaagttttgatacagagcattctactgttcaattctaaatattttccaacttaagttagaattcttctatgggccactatttagtgatatgcctttttaatattcatagtattatatttatttgtttagttagttattcctggtttcagtttactgtagattgggtctatttggtatcagatttttttggcattttttgaaatttgctttgtgattttgtaacaggccagtttttatatgttctatgtttatttgaaaagaatactttttttttctaacttttgggtacagatgtatatgcccataagattaaaattgctaattttgtcattcagtttttttgtgttcttaaccattttatttctctgatctatttattcgttttttaaaaatccttatgatggtaaatgtgttaacttttctttgtaatcatcaatgttttgcacagctcttttgtagctttgctgttaggtatatattattcagaattgacatttcttccagggtattttcttttatattatattaatgaatttttaaaaaatctcacaatgattttggcatgaggatatatttaattgatattactgtagctaccttaagtttcttttctttatcatatgcctgatatatccctttccatccatttacttttaactttcctgcgtccttatgttttaagtgcatcccttttaaacagattattgctgatgtttttcccatttgttcattttggttttgtgtgttgtcctgtgtaacaggtttgtttaacaggtgaatttaatccatgtataaattttgtgattattaatatacttatttctagtatcttacgtgcagtttattattggttttgcttgtttctttgcatgtatgcttgagtttgttttcttctttcttgccttctgttgacttgatcaagtttagcttttaaatttctctttgtttggaagttacatttctaagtattttagtgtttatctttacatttttaaacatttgtagtttacctgctgtctagagtttatcggtttttctgccacattccctatcaaaacaagaaacttagattacttcacactgtaattaactcaacgtgtaacactcacaacaaaaattaactcaaaatcggtcaaagacctaaatacaaaaactaaaactgtgaaactcttagaaaaaaaatagaagggatacttttatgaccttggatttgtcagtgatttcttggggatgacacaaaattacaggcaacgaaagaaaaaaatagataaattcggcaatatctccattaaaacttctgtacatcaaagggcacgatcagagtgaaaaggcaacatggaatgagagaaaatatttgcaaatcatatgtctaataacaggttagtctctaaaatatgtaaaaactcctacaagtcagcaacaaagaacaaaggaccctgttaaaaaatggacaaggtatttatttatttgtattttattttattttagagacagagtcttgctctgtcgcctaggctggtgtcagtggcgtgatctcggctcacttatcctgcctcagccacccgagtagttgggatttcagacatgcaccaccacacccagctaattttttttttttttttttttttgtagagactgggttatgacctcttggccaggttggtctcaaactcctgacctcaagtgattgacccacctcagcctcccaaagtgctgggacaaggaacttaaatagacatttctccaaagaagatatttaaatggccaattagcacttgaaaaggtgctcaacatcactaataattagagaaacacaaaaccacagggatacaccatctcacactcagcaggattgctactatcaaaaaacagaaaataacaagtgttgtcaaggatgtgaacaaattaggatccttgggcactgttggtgggaatgtaaaatatggaaaatggtataggtagctcttcaaaaaattgaaaatagaattaccacgtgatccagagttcctcctctgggtatatacccaaaagaagtgaaagcaaggagttgaacatacatttgtacactcatttttagagcagcattgttcacagtagccaaagggtgacagatgaatggataaacaaaatgtgctgtatacatacaatggaatatcaatcaattttaaaaagaaaggaaattctgacacgtgctacaacatggatgaaaccttaggacattatgttaatgaaataagccagttagaaaagtacaaatattttatgattccacttatgtgagataactatagtaatcaagttcaaagaaacaaagtacaatggtggcttccagggtctaggggaaggggaaatgggggaattactgatgggtacagagttaaaattttccaagatgaaaaaattttagagaaggatggtggggactggttgcacaacagtgtgaaggtacttatgccattgaactgcacacttctaaaaatcattaagatagtaaattttatgtctatttttaccaccattaaaaataataattaaaaatttaaaaaacctaagaaatttagaatacttgaatcctgtttacaccctcagtaatatgtttttgtttttccagtgtttaatttccaacttctttttttttttctttttttttttttcagggaggtaaagtgggtggtttttaaaaatttttatttttctatttgtaaactgacaaattatagttgaatacatttatggggtaaacttatttttcagccctaaggtggttactcctgcctctttttctagtccttgtcctccttcttcttcattatgttatccaattaaccaccatttaaatgtattagtaaagtttactaatatctttgttcataattgcttctagtatcacattcttccatcttggttaaatttcttgttttccgaagtataccctttagtgcttgtttagccgaaaggaaatgttagcgatagtttactcagtcttgtgtgaaaatgtatcatttctgtatcataatttaggtaggtaggtaatactatattgacaattattttttcttatcactttgaaggtacaacttcattttcttctgactgcaattcttagttattaataattcagctgttggtctaattgtcatttcttagtagataatctctattctttaatgtttttaaaatctctttggctttggtattctgtagtttaattccaatgtgtatagacatgagtctggttttatttatcttctgagtactttttgttttttttgtttttttttttttgagacagggtttcactcttgtcgcccaggctggagtgcagtgatgccatctctgctcactgcaacctcaacttcccaggctcaagcaatcctcccacctcagcctcccgagttgctggtagtacagacatgtgccaccatgtccagctaatttttgtattttttgtagagatgtggtttcacgatgttgcccaggctggtctccaacttctgagctcaagtgaaacacccgcctcagcttcccaaagtggtgggattactggtgtgagccactgcgctcaacctcttctaagtactttatgcccttcctgcatccaggaattcgagtcttatatcattcttgaaaaaatttaagctttgtctctttggatattgctttccactattctctcttttatctcattctcttatactatgttgaacttgtccattctagggtctgtacgtcttagcctttcttccaaattttccgttttttaagtcttcatattagatgctagtaatttcttcagctcttcttcaggtttattattctcgtcaactgtatctaatccactgtttacctatttattacgtttattttatttcagtgactattttcatttctaggacttccgtttgatttttaaaaacttttgtgtttgttgatttttttaggtctttaataattttaaacatgcttatttcatagagtggatctgattgttgttagggatctattgttctgtttgttgggatttctgagttactcataatagacagtttactcatttggtttatattattggattgtgagttcatattcagcaagattttatgtttaagaattatatctgccaaatttgagcatgtgtcctccagagtagatttgaatttgttttgcttcctagaggcaactaaccttgggtcagtgttaatgccggtttcttggcttgggaacttttcaaccacagaagcggtgtgcatttgaatcccaaatgttgagactatgtgatgtaatgttacgaatttctacaggaacaatatttttcattcatcacacattagtcaagatagatgaaatgtcttgtccgtctctgctttgtggcagatttttataatgtaccgtttttcttacagtatacgttttaaggcaaaaggtatgtatatagggcagcctttgtcttcaaactcgccccctcatgtaagctaaggataaggtcttttcttttgttcttacctcatataagcataaggtactcgcttttgtgtatgttaaaatttgagtacctaggaaatgaaaaccaacaattccccaaccctactcatctctaatgcttattatcctgattctcaagcatttcttgattactgacctctaagaatctctctttgtaaaaaagttcttttatatgtttatacaaataattgttatattttatctagctttttttttttttttttttttttttttgcttttgagaccgagtcttgctctgtcgcccaggctggagtgcagtggcgcaatcttggcttactgcaagctccgcctcccgggttcacaccattctcctgcctcagcctcctgagtagctgggactgcaggcatccaccaccatgcctggctaatttttttgtgtttttagtagagatggggtttcactgtgttagacagggtgtttgtctagcattttaagagtttgtaatggaagggttttcaagtcatttaatctcagtattgctaaaatgtaagtttatcctaattattcagaattggaaatgtagtctagaaaatccaaaatattaactggtattctactttaggaatgttcatgttttggataagttcttctaaaacatgtaaagggctaatattcttttacttcaaagtaccttacaacatgcatacccaggatttttctagttacctgttttattttttcttccacttttttacagagatagggtcttgctgtgttgcccaggcttgtctcaaactcctgggcccaagtgattctcccacattggcttcccaaagtgctgggattacagatgtcagctcccatgcctggttttaattacctgttttctaattaaacctaacctgctataacaagtactcaactttttttctctattggaactttagattttgaaggatatacctcttcttttatagttttttaaattagtaagtagtttgttgtacattattgacgtgtattttcttaggtttctattaaggagtttgaacataatctccaggcttctcatagtgttggcctaaatatcaggagctttttccccccatctcattgtacaattttgacggtttcatttttttttttttacacgtataggtttgacaggtaattatcaataatgagtgttctaaaccaaatattcagtttgttcttaattggtatgatggtttaaattaaattgttcctctcaatgtcatcagttaagtaacactataataaaagttctatagtgttatgaaatcctgaaaactattaatgtggggataatatacaatttaacatatatacaaggattattattatttttcagataatgacaaagatgtgtttatgagataataatgtctattgtgtatcttaagtaactatttaaaatattttatttctaatataggagattaataaaaatgtaaatttcttcaggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagttagtatgttttacttttgttcaaattaatgtggtaaataacacatataataaaaccatttttaaagagaaaatatttttctaaaaacagtgaacaatcacatttctatcctagtatgggacaggacaacataaatagtcaaaatccataaattattcataagttattagttctaattttcttgtattttattagagatgccgctaagtaggaaattaagtggtctccccagtagaataacaaaggtcgtaagtagagaatttagatcattgcttactatagtatatgtataatcatgactagaatatgtgtaaaaaaattttcaactttagtggtaataagtgcaatacaaatttaaaataaggatgagatacttttttttcttgtcaaattagcaaagatcaaaagaaaaatagtactctgtaccataaataatgcagtgagatgggcattctaagacattaataggaatataaattggtgtaacctttctgttcaggaagtttacaggtgtgcacctagagccttaaaaaatggttagaggttttgattgagcaacttcagtctaggaatctaccctatgacattctcagtagaacaaagatatatgtacaaggatacctattctaacgttatttatgatcacagaacactagaagcaacacagacacacaacaagaacaaattaatgaaacgttaatatatttagtactaagtgaaatagactgttcataataataagaagaaaggttttattagcagtcttagaagattgtgagcagttgcaaatacttagaatatgaatatccgatagaagggaatgataatctattctttttaatttgttctagtgaagcaattatgattagttgctttacatgtataaaaatcagttttatagggtttatattcttcttcctgtttgcaaagataatgtttcatatagttataaagagttgaaagactggaaatagcagcagggttgtaaatagcatgtacatcatttgaattagaaaaaaatattgtagtatatatttaacagcacagattacagcttcagttcaaattctggttctgccacttcctagatgtgtaatgttgagaaagttacttgaattctgtgtgtctttatttcttctataatattagcatagtaggagtacccacctaaaatgactgttttgagggttaaatgagtaacgtactttaaatagtgtcagatacatattatgtcctttaaaaatatttattattagttaatcattagtatgtaacttatatgaccattatcaatcatctatcttgatttaaatagagtcaaattccactactttgaagtaatttctcttcattctgatagcagtttaagatatctaaggtacaatgtattcttctttctatagcgcatgcatgattgagtcatatatgaaattaaaagtcctaggaaaatgatcttctgtcattcatccctgtattcctttagtattagtactttgcaccaacatgcagttattagatatatttaaaataaaatgtatttttaagaaaataaataagtcaaccaactacttagtatgttaaacactgatttatattttgtttctgtttttctctgtttaggagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgtaagtatgacactgtgaagaagttctgtccctctgtttctttctactatggttatatagtaattttttggtttataagtattttgctaggatgattttacaatgatcagttattagtcagtgatcatggcttctggtgcttattctgtcacaaatcaaattaagaagaaagttaactgaggtgaacatagttatttgtgactaagaacaaaattaaaattcaaagttttacctcttagataagttatgccattaagcttcgtaagagaacaaattagatatttaaaaaagcagattttatgattgtaaagtgcagaggttggcaaatttctccctaaaaccataaaactggacaaaattatcaaaatcaaccatgtcagggcctgatacaacaattgaagagaaataaattgagaagcatttatttgtgaaaaactgctgaactttagtttaaagtcacatataccacacacgtccatccccactactgacttggtctgggacagtagtactagtagcatggaactggatagaaaaatcagcagctttgctgatacagagggcagattccaggactaaatacccaagcccagtgtgttgctgctaacaatagcaaacttggtaggaaatcaatagggaaaatagtccacagacgtggtatagctctgaggtatagccctgcctgaggtgaatacagacctcaagccaattattcggccagtccaatagccaaataattcaaccattcttaacttgtgagccatgccaaaacaggccaacatagtatattgacctctgctataaccctttaggttatatgagattaaaatttaggaaaataagaacttaaaatttttgagttttttgcctttttagccttcctcttttttttttttttttttttttttttttttgagacagagtctcgctctgtctcccaggctggagtgctgtggcacaatctcggctcattgcaagctccgccttccgggttcacgccgttctcctgcctcagcctcctgagtagctggaactgtaggcgtgcgccaccacacctggctaacttttatgtttttagtagagacggggtttcaccgtgttagccagaatggtcttgatctcctgaccttgtgatccgccctcctcagcctcccaaagtgctgggattataggcatgagccactgctcccggcccctttttagccttcttaatttgagcttttatttttattcagttattttatttactatggctttaatcctgtactaaaaatttttatgttaatgttatatgacttaacaaaatctttatttttaatttttgtgggtacataatcggtacacgttatataacttttcactgaaacagtgaatactatttcaatacaataagctgtgatcactgtttgataactgataattgtaaaaccatcctagtactgtattcaaggcagataaaaatttctcatactttcctgtctaaacttcacaaagaataattaaactgacttctcttaccaattttttataaatagaattatatttactgttaacaaattatgaatcattccaaattaaatacatagtacagttgatcctaattattcatggaggttatgttctatatagttgccttgaacactgttagctaatattgaaccattgctctgagggaaatacagggttaggtttctgtgagcctctgatcaactgatcaatatatagtcttgttttatgtgtgcttctctttaaagacactttatataacatatgttgttgattcattaacactgaactcaccactgaactcaccaccagcagcactgtaactcgtgcctgaatgaagcttttctagcacattattttctccataaaggcacatcactgtcctctggcgctaggaacactagacagcgcttcagcactatgcttgggagcctttgcaagcagtgaatcacatacagagggcccaaaaatgtgaaatgcatgacaccaaagagaccctgtagaggacacttgtttataatatgagagcttaaatgagaaggcagagcctctcctgttcaacctcagctgggaatgtgagcataggacatctcaaatttttctctgctctgcacgtgtctacaaatgatcataaaattaccacaagtattgatttggggtttacaaataaatattagcttctacacaaatttgcaaatacagaatacatgaataataatgactgtattctcaatatcagactttgaatcttcattttactttaattagaattttagagtagcagtgttcatggtctaaattttatatcactaaacaactataccaaacttaccagtgttttaaaattgaacagtcacaatttttttttaaatatttctttttggcattttatatttatagccaagcctacagatcatatagctatctatttcttaccagatgttttttcctcctttaggaaacgatgcccccaccaacacatactgcattttctggccaccatctgccatttgttggttttacatatactagtagctggtaagtttgaaaagttaacatagtttgggccaagtgcagtggctcacgcctgtaatcccaacactttgggaggccaagacaggtgtatcatgaggtcaggagatcgagaccagcctggccaatatggtgaaaccccatctctactaaaaatacaaaacttaggtgggcgtggtggcaggtgcctgtaatcccagctactcgggaggccgaggcaggagaatcacttgaacctgggaggtggaggttgcagtgagccgagactgcgccattgcagtgcagcctgggtgacagagcgagactctgtcttaaaaaaaaaaaaagttaacatagtttggacaatttaaagcaaattaaattgaattgaggttcgtaaaagatgtatgagaaaactttgtgaattaaaactttttaaaaaatagagtgagcctactgctggaaatagaaagttaagcattacaaaatgaatagaacgcatgaaaatcttaactcgttttggaggggaaagaatggaacagagagctcagaatctaatccttaccaatgaagcagtaattagaagagtttcacgctgttgaatattctctagatgtcaagcaggagaactttcaacccattaattctaccatcctttcactgaccctcacttcacttatattccctatttcccccttaccctgtttaaattccattgagaatgattataatcactccttgtatgccatttcagttcctttgactgtctctcattctgttatatttgttttgctaagtgaacattaactattacaattttattctctacctgtacagttccaaatgactagaaaaaatagctgactattcttactggtctactttaaattcatgattaccaacctcaagtcccccttgtctgacaaatgtactgtattaccctagtatattcactcttccactcacctagtaactattttttactttctttttttttaagagatggggtcttgttctgggcagcagaagggctggaatgcagtggtgcagtcctagctcactatagcctcagactcctgggcacaaatgatccccctgcctcagcctcctgagtagctgggacaataggcacaagccaccatgcccagctaatttttaaaacgatttagaaatggagtcttgctgtgctgtctaggctggagtgcagtggcacagtcatagataactacagcctcctactcctcaagccgtcctctggccttaacctcccctgttgctgggattacagatgtgagccactgcatctggcctatttctttctacttgagtttgaaacctctgtcatcctcactttcagcttgcatctcctttcactgaaaggattgaggcaaaccgcagacaacttccacaagctccagttaccatatttaccgcctacttactgttagacccaaattctctgttcttttcatggatgaactgtgcaagcctctagtaaggccagtatcttccatcccttcctggctagtctagtgcatgttttgctttcatgtcatgaatttttttcttcttgtgtcatctgcatcatcagatcatttctatcagcttacaaatgtcagttctccatcttaatgcaaaatataaaatctggattcctcttcctttacctcttatcaaccatgtctctgctttacattatagaaaatttacttcaactgttgactatattttgtttatgtttctcatactgttgtttcttgaatccattccagtcaggtgtgtgcccccatcacttcatgcaaactacttttatcgatgtcactgttgaccaacatgttgctaaatctaatgatcacttgtcagtcctagtcttacttatttgcttagtctcatcttatttgccacagctccatacttttaaaataccaccttctcctgtcttctagggcacttgactgagtttctctcaccttgctggtcattccttctcagtctccatacctgatccctcctgatttccctggcttgttaatatcagagtgtcctatggctcagtctttggacttctcttttccatctaaactctgtagtgttctcccaaagatttgctgatgactcctaaacgtgcatctccaactgagacctctcctctcgtctacttaaaaatctgtcttaaccacccacttactatgtaaataactttcttttagttctctgatcctgttcaggtgatcctcttaaaagataatcagaacatgtcactcccctgttcagaaccagtccacccatccccaactccagtggcttcatattttaactccaaatcaaacttcttacaaggccctacatgactgccttacttttatctttctgagtttatttttccttgtttactcaactccatccacacaggcctcctttctgggctgtgaacatgccagacatactcttgtctcggggctttagtacttctgtttcatctgcttggaacattctttcttttgatattcccttaactggtcccctcacccttacttagctttttccaaagttactttagcagtgacagctttcctaacttctttatctaaatttttatttcctcctcttcaatactttatttctccctttcctgctttatgttttctccttagcatttaacattttctaatgtaatgaatatctccattattttctttatttctgtctcagtcactggaatataagctctatatgggcaaggatttttgtctgttttgttcaccaccaaatgtccagcagtttcagcatttttatttaaattgtattgaattaaagacagaaacttgcttttgaatttcaaattctagtaaagagggccgtggttggtgcttttgactactactgtttcacctaggtggtcaaattgttttaaactaccagtaacccttcagcaaacttaattttataatttgtggggtttttaaaatcataataatttgggggattttaggttttcattttttaaaatgcttctaaaaacagtttatggtgattttgcaaacaaatttttataattattccagctggctaactgcaagatattcagatctgtgttttaaatgagcaatttaaaaatgtttttgccataaatgtggagtcagttaaaaacaatttttaaaaaatgttaacgtttttcttcaagctttttatcacagtatgaacctacatttttttttcttttcttcagtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaaggtaaatatattttaaatatattttcactttttgaattgtactcacagtgttatgagctgtttattataagtggttgttttatctttgaaaaaaattattttaagtggtgaaaaatcaagttgtagagatgtatgcagaacacagcataataccatttatgtaaaatcacacagttaatagtaaacaacaacaaaatagctttggtctcctgtgggtacatatttatgtttataaaaatgtgtgggaatacctttggggatggggaaatgggaccctcctcacttcgttatagcactttaatgacttttcctatattatttgctcaatctttaagagctctagctcctttcacactgtcattctctgcagcattgcttctgccatatttggtgattttaaaatgcacatacacataaactttttaagattctgagtgagtttcttgagtcttcaccttcagtgattgtttactccacctggtttcatccagtccatcctatggtaataagatatgtcttaagattacaatacctaaaactcttctttaatcgcagtttccagcaaatcttttataatctcctgctcataatttttagtgctctctctctgaccccttaactccagtatttcttcactgccaccgttacctacaagtctatcaccgtttaactctgctatttataccctcatttttcgttctctggtcagccatagtcataccctggcatataccttcaaatctattgttcctctttctctttgtcaaatacctttggcagaaccccaactgtgtttgaatacaactttgtatcttcaactatccagctgaagacagcttgcttaaaacacccacaacgtgctgactaatattaattcagattcacagacactcacctcaagtcagctcttcatgctatttcccctagtctatttccctatcctgtgttgtaaaatccagtgatgatttctgtcttcaccttttaacctatcagcaatatttgaccctatggaccttttattccttctgataacgctctctttttttttttttggcttctggggcactttatctcctggttttctttttcctcataaacctgtccttcccagtctcctttgctaagttttccttaactcttcgacctttgaatgttagaatattctctatttgaagcaagtctctaattgaatgaggccttcagtgaaggttttcctgaccatcctatttataatttaatcatatatatatccccagtactactgtctcctttttctgcttttttctctaaaataaaggatgtaacatattttacttacatattttgtgaatgaaggaatgtatttatggacaaataatcaggaacttttgtaactaatcaaagttttacaatcacaaaactttactgtcatacttttagaggcccagtagagaaaaaggctgtgtagacatcaatagaatggactattttctgtttttccgtaagttgttaagatctctgcatatgaattacttcccttttgtgactgaaatttttctgtttcttttttttcctgtggtgatacacatatagcaaagtgtgcaagcattctacttttaagtataagcctaataaatatttgtatatgtatacactgatgtaaccttcacccatattcatgtgtagaatatgtccagcatagggtaaagtcctcacatgtcccttcccagtttgtaacctaccactatgaaataaacatcatcctaagttgtttcaccattaatgaatttttaccggtttttgatcttcatataaatggtatcatacagtatattctcttttgtgtatggcatctttcacttgttttttgaaattcacccatgttttgtatatatcagcagtttgctctttttttttttgtactgctgtttagtatttcattgtatatcagcaataaaaaattacccagtctgttgttggtaaatatttgggttatttccagatgttgactactgtgagtaaagttcgtgcaaatatacttatctatttattttggtggtcctatgtactatttctctcagatatatacctgggagtacaatttctgggccatatagtagaggattttcagctttagaagatattttcaaagagttttctaaagtgactataccaatatatagttctactaataatgtatgagttctactgtcttcaactcctcaccagaacttatcgtccgcgtttttcacttgtagccattctggtagaagtatagtgatgttctgccatgattttaatttgcatttccctgatgaataatgaggttgaatatcttttcatgtatttactatccatttggatatctagtcttgtgaagttttggttcgaggttcttgcccatttttctattaggtctttatatatctttttcttaataatttgtatgttactacttcacaaacaacgtagaaacctttagacaactccttgtatgactgttgttacatagtttactttaatctgtgttataaatcttttaatacacttttactccattgttgctttatgttttctttactcattaattttaagtatctttttatttacccatatatttacccgtttggtgctttttatttctccctagtgatccatgtttctatctggaatcatttttctttagcctaaaaaacttcctttattgttttcttgtaatgtgaatgtgttgtgacaaattcttgataggattttgttgatctgaaaatgtctttatttttaccttcatttttgaagaatacttgtgctgggttagaattctagcttggcagctttttctttcagagctctactgtattatttcattgttttctataataacttccataatatttcttgagaagccagctgttaatcttaagctcttgaatgtaatgtgtatgttttcccttctggctgctttcagtattatgtccttaacttcaatttcaaatagttggactgtgattcacgtacgtgtcgctttctttatgtgaacagaaaatcctggttgagattcattgagcttttgcaattttctttgatgtcttttatcagttttgcaaaattctaagccataatctctgtagatattattttgcctcatgcactttctcctctccttctgggactgtaattgtgtatatgttagatggtatctcacatttcctttatgctctgttctgttccttccgttctttctgttttttgtgtgcttcattaagatattttctattgatctgccttcaggttcactagttctggcttctgctttatccattttgctgttaagtccatctaattagtcttaatttcagatattgtcttttttagttaaggattattcatttgattctctcagtttcagttttctgttgaaatttccccatatttttatgtatttttttctctgttttctttaacattttaatattttgaggtccttatctgttactttcaacaactgaatcttctgcgagcctgcctttctgtttttttctttcatttgtcatgcttttctgcttttccaaatgtctcatgtgaaagatgtcatgaataaaaataacacagagaaggaagtttatattatttttgccccagagaggtttctcccttttcattccatcaagaattgagcttggacaagactaaattgctttttttttttttttttttttttttttttttttttttttttttttttgggagacagagtctcgctctgtcgcccaggctggagtgcagtggtgtgatctcggttcactgcaacctccgcctcccaggttcaagcaattctcctgcctcagcctcctgagtaactgggactacaggcacgtgccaccatgcctggctaattttttgtatttttagtagagacaaggtttcaccatgtaagccaggatagtctcgatctcctgacctcgtgatccgcccgtctcagcctccctaagtgctgggattacaggcaagagccactgtgcctgcccctaaattgcatttttaattagactcaaccctacctttgatttcaaatgcccagaatcgggagctggatagagcctagttgggcctctttctccttcacttcctaaactatgggagatttattctgttcttcagccttctgccctataccatttccaaatttggtgtcttgatgaagagactggccatgtatttgaagcagattctcttcctcaagcagctctttgtctctgaaataattctgtactatcggagatttctgtctgacttttcaaagctccctaacttcccatgcagcccccaagtacatcaattaaaatataccatgggaataaaagcaccatatgcttagggactttgagatttccaaattgttgcaccatccccacacatcctccagaagcttcagtggtttttctttccagcatgttatctctcaatttaaaggccaggcttgacctaagtacactcacagaaatggataaggcttccaggtaagaagcagttgtaatagcctcttcacctcagaatgcctcacttccctggctcactttcccaactccaactgaaaaagcaaagagaactaagtaaaataaaccaaagatgtttttaaaaataagattttctcaaattatgtattgaatttttactttctacggcaggagaaacaaagcagtgacctgttgcttcctagtccatccccttatgactaagaatttcctatgttttgggttttttttaaatgttttgaattctttaatttgttcttggtatttttacatgtgtagtatcgtttgcacagagcaaagtgaacaaaaatgtaagatcattgccttttggtatgaatacttgtttcatagcagtgacatagattaacatttaaactgattcattcatttattagctgtttattgagtatcaaacagcccaggagctgtactgcccatgaccaggaatgtaataaaaagcagataaaggcaaaaatacctccccttgttatgtttgcattctgttttgaggagacagacaataaatcacatacaaagtagggtcatccactgagagttaggaaggtagaggagatattagatatttgacaagaaaaagagaaaatgtgaaatggtcagtatggagacgaaaagagtaaatgagctagggaaatagtttaggatcgccagatatttccaagttatttaagttcagtaatcatgagttttaaatgactgtgtatttttttcagccattttcagctacttgggtaaaatcatacagtaggaggagagtagaaattatccaagatagagggccttctagaataagtacaatggaggagagaagggtaaagaaattgaaggtatttgcaaaacagtgatggaccaaagaatctaaccagggtaagtaagaaagtaaagaggaaaaaaatggaaaatgttaggaacacattgattggcatttctggttggaatgaaaaattgttgaagtggtccctagagtagtaagctgtacagatgagagagatgattttggaggccatgcagttattgataatgacaaagtgtatagttgaatttcttttttatttatttatttatttatttattcatttatttttttattgatcattcttgggtgtttctcgcagagggggattgggcagggtcataggacaatagtggagggaatgtcagcagataaacaagtgaacaaaggtctctggttttcctaggcagaggaccctgcggccttccgcagtgtttgtgtccctgggtacttaagattagggagtggtgatgactctcaacgagcatgctgccttcaagcatctgtttaacaaagcacatcttgcaccgcccttaatccatttaaccctgagtggacacagcacatgtttcagagagcacagggttgggggtaaggtcacagatcaataggatcccaaggcagaagaatttttcttagtacagaacaaaatgaaaagtctcccatgtctacttctctctgcacagacacggcaaccatccgatttctcaatcttttccccacccttcccccctttctattccacaaaaccgccattgtcatcatggcccgttctcaatgagctgttgggtacacctcccagatggggtcgtggccgggcagaggggctcctcacttcccagtaggggcggccgggcagaagcgcccctcacctcccggatggggcagctggccaggcggggggctgtccgcccccacctcctcccggactgggcggctggccgggcagaggggctcctcacttcccagtaggggcggccgggcagaggcgcccctcacctcccagacggggcagctggccgggcggggggctgacccccccacctccctcccagacggggcagccggccaggcagaggggttcctcagttcccagtaggggtggccgggcagaggtgcccctcgcctcccggacagggcggctggccgggcggggggctgacccccccacctccctcccggacggggcggctggcctggtgggggctgacccccacctccctcccggacggggtggctgccgggcggagatgctcctcacttcccagacggggtggctgccggacggcggggctcctcacttctcagacagggcggctgccgggcggaggggctcctcacctctcagtcggggcggttgccaggcagagggtctcctcacttctcagacggggcggccgggcagagacgctcctcacctcccagacggggttgcggccgggcagaggcgctcctcacatcccagacggggcggcggggcagaggcgctctccacatcccagacgatgggcgggcgggcagagacgctcctcacttcctagatgggatggtggtggggaagaggcgctcctcacttcctagatgggatggcggccgggcagagacgatcctcactttccagactgggcagccaggcagaggggctcctcacatcccagacgatgggcggccaggcagagacgctcctcacttcccagacggggtggcagccaggcagaggctgcaatctcggctctttgggaggccaaggcaggcggctgggaggtagatgttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaatacgaaaaccagtcaggtgtggcggcgcgcctgaggcactcggcaggctgaggcaggagaatcaggcagggaggttgcagtgagccgagatggtagcagtactctccagctttggctcggcatcagagggagaccgtggaaagagagggagaggaagaccgtggggagagggagagggagagggagagggttgaatttcttaattggtgaaccacaagcatttggggtgaggtaattttttcacatgagagagagtttcacactctgagatattgaacattctgagtttccagatgttaaatgcttgtagcagtctcctcatgtgctgtgtcaacaactgactcccgttctcctgtccccttacataaggtgatggtaccacctgcagtagagaaccactagtttaggatgtggccagttaatctgatggttatgctggagagaagtctatcagctagattgttttgggctgcagatgtgagaattcttaaataatatggatttattttctcacttaagtcagaagtaaatggtttcagtgccaattttagggtagcttccctattaatttcttggctttccttacatgattccacaatattgtaagcctcaactttcagatgtaaactttggaaggtaagacctcccttcatacaccagattcagttcttcatatatcatctgacagacataccaggcatttcatttatcacacggtgatgttccctgctaggacaaaaaggagctaagtagattcattggcagagtacaccaagaattccatcttcatatctgcacatatccagagacccagaaagtggaaagattcatttagtttcatacatctttcatttaatgggagattaaaacctctccctgaagccccctagtggacttcttctcaaggtaccatttaagttctaactaggtcacatacctaattcttgaccaacacttgcaatgtagaatggaattattatgattaacttaaaccagccagttttgactgggcccaccttacatgtgcacactgtagcctgataattgaatttggttcacaagacagaagagatgaatagatgtcgggtaaaaacaagcagtatctgccgtaggggatttatgtgcctcagaagtcagtgttagatggattatctattttgatgttaaagttactaagaataataagaagagtagtaatggaaagaacagcagagaacaacatgtaaaatccttatttaaaaaagagtaagatagggaagacaagtggataaccacataagcaggaaatggtcatttcagtagacctaggaattttgaggaaagaggtggcaataatgagcgaggatgcctgccccaccttcatacctgtggtaggtggggtacaggaggaaaagtagctcctattaatgtccatttggtattctttggtcttttgtttgtttgtttttttttgagacagagtctcgatctatcacccaggctgggtgtagtggcatgatctcagctcactgcaacctctgcctcccaggttcaagcgtttctcctgcctcagcctcccgagtagctggtattacaggcatgcaccaccatgcgtggctaatttttgtatttttagtagagacggggtttcaccatgttggccaggctgatctcaaactcccaacctcaggtgattcatctgccttggcctcccaaagcgctgggattacaggcatgagccaccgcacctacacctcccctgcattgggtatttttatgtctccccattttctacccccaatttagatgtcttaaaaaataaaaacaatggatgttcttttcaaaataataaatacggaaaggaccagtttttagtatgttttgaacccaaagagaaagaaatgtataagaaatacttataggatgcagaaaatcaacatcagatgcacaatctagtatatcttatacctttaattcaaattaacaaatatttattgactgccaaacatatagggattatggtttacacacacacacacgtacatatgcacacacaaagtaatcagtaatgatttgcactaactcataaagaattatggtaagggagagacttattatgtgagaatccctccataaatagcagaatacctattttagaacaaagggcaatttcatttctgatgtaaaatggtaaaaaatgttttctttgttccatgtcttttgatgatatctgggaataagcctcaatagagttattgtttttttaaaaccttgtattttttaattagaagtgcaagataaattaatattttctattttaactaaatattttagctaaattgttgagccatggttacctgtagctgggcctcaactttcagacataaaatttggaaggccagcatttctgcatatgtatattaacatgcctaactctccatttgtaaaccagattcagttcttcgtatagcatctgactgacataccaggcttttgagttatcacatggtgatgttcctactaggagaaaaaggagctatgtagttgattcattggcagagtacgccaatagtatttaaaaccaaaaattattagaaggtggattcttttgtatatatatatatgcagtggattttttttttttttttttttttttttttgagatacagtctcactttgtctcccaggatggagtacagtgccatgatcaaggctcactaccacctcaacctccggggctcaagcaattctcccatctgagcctcctgagtagcgggacttcaggcatgtgccaccatgccctgccaatttttatatcttttgtagagaaagggtgtcattctgttgcccagtctggtctcatactcctgtactcaagtgatcctcccactttggcctcccaaagtgctgggattaccatgcctggtctgattttttatgacttaatttttgagtattcacatgctttttgtcagtgagtagatgttttgttctataaaattgtataagaatttctctccaaaaaaataatgttattagttttaagaatttagagtatggtgatatttttatttcttttatccttttttttaaagagtcaacacagactgtccaagctctgcagtattcaactgttgatggtccactaacagcaagcaaagatttagaaataaaaaacttaaaagaagaaattgaaaaactaagaaaacaagtaacaggtaaatatctgtgattcactgttaattcaatttaggaaatgtttaaaaaatggtttattcacacaaaaaacatctattgagaacctgtctgtgttatgtgatgtgagttgcatgctagtcagggaagggcaaataagaatgggttctgctctcaaggagttcacattttggtctgggaaacagataaacagttattgcaatacatatgaaaaggctatcaggaaaaataaatggaggtacgtggagagtacataggaggatcacctgacacagacttacgtgaacaaggatggcttttttggaaggcctattcattttggaatttgtctggcaaagcatatttgtgaggagaggaaaaggtgagttaggagtgaggaagaaggacactagagacaagcagagtgcatgtatacaggcatcaagaaaatttattttctttgttaatgcaattattttttcagtgtattactgagattaaaactaaatttgacaagtgttcgtatacctattattcatttattgcattttttcaataaatatattgagcacctactatgtagcaggtgttgttttaggctcttgggattcaacattaagcaaaacagactaaacaaaaattctttgctttggcctgggtaaaggacagaaaacagaaaccagtaaatatataactttgtaaatgatacaatatgttggaaggtaataagtgctttaaaaataagaatagaataaggagaattagtcagatgtgcaaaatgaggagttttatcattttaaatatagtgctccaggggtaggcctgactgagaaggtgacatgttagcaaaaatttaaagaaggcaagggggttagccatacagttatctgcaaaatatgtgttccaggcagaaggactagccggtgcaaaaactctaaaatcaaatgtgccccaggtgttcaagtaaaacagagagtactggatggctagagcagaatgagcaggcagggagaatggaaggaaatgagaactaaaggggtgaaatgggcttgttgcctgatcagtagagccttactgattgttgtaaggtctttggtttttactcagaatgaaatggcagtttttcgcagggtttagaggcattacatgatctgaataagcagagggatagggagagagagcagaaggtactattttaacgagaatggtgaggcctctccagaaaggtagttttaggcaaaaataagtgaaagagaagaaataatctaatgtagcatcttttataaaaatgactatttaaaatgccatattaatactttgtttatattaaatatatggagatcttagttttgagcataatttatgaatgctattttgtgtttttaagaggctctcctcctaagaaatatctatatatctaatctctgttactttatctttccaaaagtaagttattgtagattgggaacatgataagtgaatcatggagtttgctttggtaccaacaataacattaagagtgccactgaatgtctgtgttagagttgtatgacactaaaaaagcagtagaacagaagaccagctagaatggtcagtgattcgtcttcagagaagcgatatcgatttggaaaacttattcataagcatatctctcctctttttaatagtagaatgtggctttgaatggcagtagcttttgaaagcttgctaattaattttaaaactgccttgaaatagatggtattgatgtaaaatattcaaatcaacaatctagttgttatgtcattcactaaaatagttgtgagcttctttgttagctctatgtaagagctgaatttttaaatattaaaacgttttgctgtcattcacaataatgttctggcactatccaaaggaaacctttgttgatgtctaacccagtatatatagaataataataagtaatttcattttctgagcaattccaaatggtatcgtatttttaattttattgttcatgtgtttattgtaatatatagaaatatagttgatttttatatgtttattttgtattctatagtgttgctgaactcacttattagttctaggagggtttttaaaaaatagattctttgggatttttaattctgacaatcatgtcacctgcaggtgggaacagttttatttctccctttctgatctatatgctttttgtttccttttcttgccttattgcaagaacttgcagcactgtgttaaaagaagaatgatgagaagaacattctagcttcttaatcttggggaaaagcattcattttcctctgtttctgtacttctaagggtttttaaaatcattaatgggtgctgaattttgtcagattctttttctgtatcaattgatatgaacatacgattttcaaaaaataacctgttaatatggtgaattacattggttgattttaaagtattgaaccagccatacatccctgttgtaaaccatggtcatggtgtacaattatttttatatattgctgaattccattcctaatatatttttaaggatttttgcatctatatacatgaaggatattagtctttagttttccttttttttcttctttttcctttcttaccttccttccttccttccttccttccttccttccttccttccttccttccttcctttcttgtactgcctgttttctctgtcaacgtagctggtggctcctgtcaccagcagccaccagaggcctgaacaaaagagtaccagcaggggatccacctgcatgcatcctttctgaagcaaccttgcagtcaggagtcagattgctggtacagtgtcaatgacaacctcgatgtgaacatttaagagtttttagtacttaccttgtggcacgtggcacccctggaggccacacacctggaggtcagggagtgcaggcagacagagaactttgagcaggagagcatggcaactagcagtatatattagggaatagggtgtaggtcactttaagtttgtaagccagtgcttgaatggtccccttagaggaggcagctggaaggcaggatcccagtctgctaggtgggagagatgtctcctgcttgagccccttgggtgtggtgtagaactggaaactgcatcaagagtgactaaaccctgcctctgaaacaagaaagctaaacctgcattcaaagtggatgctgaggcaacataaaattattataaaattatacatttattataaatttatgatttattttaaagtaaaattaaatatgctgtaaatttgtaaatacagttgatccttgagcaacatggatttgaactgtgtggatccacttatatgcagatttttttcccaaccaaatagagattgaaaatacagtatgctttggatccgaaacccaacccaggttggaggtagaagtccaggttccccgtgtggtttctactgacaatgtgtgaggagaggcttgttgtcagccagtgagggttaatgtcctgtctttttctgacatcactcttttttttttttttttttttaatttgtagacagagtctcactctgttccccaggctggagtgcagtgacgcgatctcagctcactgcaactaccatctcccaggttcaagcaattcttgtgcctcatcctcctgagtagctgggaccacacccagctaattttttgtatttttagtagagacggggtctcgctgtgttgcctgggctggtctcaaactcctgtcctcaagtgattcgccctcctcagctttccaaagtgctgggatttttgggatgagtaaccacacccagcatttttctgacaccactcttgcagatgtgtttgagcatctcattatagcctcatgaggttggaaatctagctccccctgcacttgtccattgttgacattggtgacatggggccagtttttttttttctgtgatgtttatctcaagtagaattgttactttctgtgagttgtctgtctttctggtctacccctttcctaatcctttggctagaaagagcaggcttttgttggggctttttctctttacagctgttgtcatttatgggttaccatcttctttagttctaattctgggatatatgaaccaagaagaaaccccagaaaactcaccgttatgttgtttatcaggtcccagtgtcctgaggaagtttttttcttcacatttcggagtcgtcttatgtttgttttatgtataatgtcttagggttttaagttatacttaaaatgggaagaatgggaaatatatctattccttcttcccagaacttgaagtctccagagtaagcttttaaagtataagtctgttgaggtcacagcttcaacatacctatcttcagtggatcctcattgcctccaggataaagtagaaatttctcaattctaatacaaggcccttcattattatgcatgtatttgcctctcgagctttgtctcttgttactacttccttgcccagtgattccagccatgctgaatcacccagtgatgctccacttccttcacatactgtttttttcctaccctttctttctttccttccctttttttaaaaaaatacaaattgaagtctccccttaggacctgcctgatgagtagccccaactttaatttggctctgaagaaaaaaatatatataccttcaaagaaaaaatatatacctccaaagaaaaatacatacctctgaataatatatacctctgaagaaaaaaaatatacctccaaagaaaaaataccttcaatctgtcattcctccagatacttcttgagcaaagtctttgtgtatacaaatacccaccattaatgactgtttctcttgtgtttcccagcagcagtgttctccaatatttttaagtttctggaaaaaaatgcgacagttttataattattgacaacttctttttaatatttgcttctttaccatactctgagcttctaaaggttaggggtaggttatagtaggttttcccactatattcctagtgccaagcttattgccagtattgtataactgacactatatatatatttgttgagtatctgcagacaaaaataaaatttttttaaataaaaaattcatacctcatttaatatttttgtatgagaaaatagaatttttttgtctcctaaatgaaaaatttattataatctataatgtacttctgagactctcgttcttatgttgccttgaggttggggatatgtgcctctgtgtactgtttctgtttctccaaccccaaactaacacacacacactctctctctctctcccctccctacctcctgtgaataggggcattgataataaaggagcctatttttactgattataattagaaataaagtttcttcgcatctcagaagagttacataatgggaaaaatgaaactatccatcttgtggatcagggagatgttttggttattctgccaacctcccactgggtctagtcttaactcctttccagtttatagtgttccactttgaatactgctttaatcatgcccattttttgacctcaattcctatagcacatacagcctgccacacaatttgcatttgattttctactttattatttttttaaagagtgttgctgttgtctaacttacctccttcaagacagattccatgttttatatttctcttccatgccatacagtgccaagaaaataaccccatatgtatgatgccttcattaagtcctcattactaacaagttgaattttatagtcctaaatagcacccgtgagctaagaaccatttagttggtatcagctaacccagtttcgtagtactgttttttcttttgagacagagtctcattctgtcacccaggctggagtgcagcgatgcaatcttggctcactgcagcctccgcctcctaggttcaagtgattctcccgcctcagcccttctcgagtagctgagtttataggtgtgcgccacacctggctaattgttgtaatactagtagagatggggtttcaccatgttagccgggctggtcttgaacccctggcctaaggtgatctgccagcctcggcctcccaaagtgctaggattacaggcatgaaccatggtgcccggcctagtacagctttttctatttgttcactataattagtttttaacaactttatctaaatgtcatggctaattgtgttgggtatttataatagtctctggatttctttcagaattatagccatatttgctatttgttgtagtgaaagtaaaggctctgctgccttactcattttatagtatttgaccaaagttcagagcattctggatttttcgtgatatggggttttcatcttttgggaatgcaacattctgtgttttccaaattacaagtgctgtgtttctctccataatggaggattttattaaatattaggggaggggttatcttttccaacacttcttaatctagtacattattttttacttctcataattcacatactgttgtttaaatgaatgttttgagcttttttcacttttgaaaagtgactgaagtataaaacagggaaatttgacatatattctctaacaactccattgcaaagcagccagaatgaaatggctgtggtgagaactgaaattaacactatattgaaacaaatcagtaaaaatatccttaaagcttttagaagctatcccctgtgatatcatctgttacaaactttatatggtagagaaattttatgaaatactgaattttttgtttctcagagctgttgaaataagtcagtaacaataatttctgaaaaaacaacatgttagagaagaacacttcagaagtagaagaaagaaagtgtgctcagaatggattactaaatgtactatattgctactctaaattgattttccttaaccataagattagattaaaatgaaccaggaagtgacagaagtcagctgccttacaggctacatttttactcttaattatgagaaataacaaaagtaaattaatatttactttagaaattgttgaaatccgggcaaggggcagtggctcatgcctgtaatcccagcactttgggaggctgaggcgggcggatcacctgaggtcaggagtttgagaccagcctggtcaacatggtgaaaccccatctctactaaaaatacaagaattagccagacgtggtggcgagtgtctgtaatcccagctgctcgggaggctgaggcaggagaattgcttgaacctggaaggcggaggttgcagtgagccgatatcacaccatagctctccagcctgggtgatagagcaagactccgtctccaaaaaaaaaaaaaaagaaaaaaaagaaattgttggtatcctaaaaatgttaaaaacttaaactagaaaatatttaaatgtgtttgaaagaaattgatttaaatagaaatattcccatatgaaatgccaaaatttgataaagtgataaaatacagttttctgaatataagactaaacaccatgattaagattaaacaccctatgatttttagttttcttcacataagcattcattaattgatactgttcagatactatgaaaaccagttaatacaactttacatcttcaaaagttaactatgctattaataactatactttcaaagtaggttttaaatctatcaatttattgcactgatatcagttatttatggaatgtagaactatacaatgcatgatacactaatacatttaagtaatttttagactccaggattcatctacacaagtgaattgctcttcccaataggactaacatattaacactgcttcatttattgaaagcatcagtctcaacaatatacaacactttgtgcactggttcccacacattaatgtacaaatgaatgacttgaggatactgtatagattctgcttcattaggtcttgactggggcttgagattctccatatctaagttcctaggggatgctcatgtcacttgtctggggatgttacttagagcagagatccccaattctcgggcgacaaactggtaccagcagactgggccgcacagcaggaggtgaatggcaggtgagtgagcattagcgcctgagctccacctcctgtcagatcagcggtggcattagattctcatgggaccgtgaaccctattgtgaactgctcatgcgagggatctaggttgcatgcctcttatgagaatctgactaatgcctgatgatctgaggtagaacagtttcatcccgaaaccatctcccggactcctgggctgtggaaaaattgtcttccacaaaactggtccctggtgccaaaaaggttgggtattgctgacttagagtaataatgtgtaaagaacagaaaatatccagagcagaaccgataatgagtgttgtttagatttctctgtatcactgacttcaattctttactagtttacttttgataccaggaacatttcctatcaatttattacattttgaggcataggttaaaatcaataatgttgtttcttaaaagcccctcttatctgagaatgttaaacattatttaataacattatcttgtaaggtggaaaagtcagtgcaagatttcctgggctctagtcttagctctgatacacattttgcaatgtgactgtaggcaaattattcaactccctgagtttcttcatctgaaaaataggagaattgatttagatcaggagtttttcagatatttgctctttagaaatcagagtttattcttcagataaatagtggtgaaactagactgagtgatttggaaccaccctgttagaatcaaaaccgtcttacacggtaatttgactaacatcagcactaggatgcttaccaacactgcagtaaaacttgccctttttttggttggttttattgttgcttgttagttttaaatttttaatttttccgaaggtgctgtttttggaagcatgctttttttttttttcctaatgagtatgtaaggcattgttgcacatcttcacactggcatacaccattcaccgtctttacagtgaactgataatgcatttaatttgtcaagagtcatactggtatacactgtcagatctaacactaaattgaaaataccaattttaaaaaaaattttagttgttttaccttaggttcaatcatttgcttttatacaaatagtaaaagaaacattgtcttttgtttttagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggtaaaatatgtgactagatcattaaagctttttctctattttgaatcttgtataataagaatactgaaagcattcataatgaattacaataatacatagtatattttatcttcttaaaagttggtctaaaaatttaggattattttggtgtatgttatttggttagtagctagaaattaagaaactttgttgaagcttgaaagttcagaatcttttgttcttttagaaagttaatagtcaaaggactagattaaaagaatgttattgaaaaagaaacatgaagaaataagaaaatagtagaaactgtttagcatctatagaaaaaatttaaaatacaggcatattttcattataacttactgatatgaacattcttaaaatattataatttaaaatttatttggtgatttgttttaaatgtcagtttttatctttcaaagcagcaggggtaaataagctaaagttattttcataagaactttgtgaaacatttaaacattattttaaacatcaaaaaaatttattgatagctaagcctctgtaacacagcccaatagggtaaataatattcaagcactagagaaaacacttttcttgaaccacatgctgctaagcaccgtgactttcattaacaaatagaaaaatgttgggactaatactagccattgcaaacaagaaatcagtagtttgtggcatagcataagttgtattcaatgatgtaatatattaatataatgcactgataatatagaatgaatgaagtcctcctggggaagatttgaaagtcttggtgccaggaaggagatggagggaattaaaaataaaacaaataacctttagctgatgaaactaatcaaaaggactaaaagagaacgctattaaagaatagattgaaatagaccagtacatttttactttctgcttaatgaggtttcaagcaatttttttgtataggtccatttaaattcattgccaatttaataatatttgtcatttaaaactgttagtgttctatttgctttaataatattatagtaatattaatggtttaccatttttattggtaggattactcagccaaatttagttaacataatcggcgttatgcttcctgctttctactcttctgagcgatttccttggaaatctaaagagaaggatcttggattctttctctaaccctttggaaagaggatgaaaatcagatagctagatttatagtgacaggtggtcaccaatttttaatgttttagtattaaaaatcctttttatatattttgagaagatgatagtgctgacgaaaagaaacagattataccaataaaggactttgagtgatttgcttaatatcctataggcagtagaaaatgatttttctccacattccttgccaacacttgttatcctttgtcttttaaaaaaaatagccattccaatagatgtgaagtgacagctcattatggttttgatgtttacttctcttatgactagtgatgttgaatactttttcatatacctattggccatttgtatgtcgtcttagagaaatgtccactgaggtcctttgcccattttttgattgagttagcaaatattctgattttttataatgccaaactgttttctagcataccaacttccatttccacgagtagtgtagagtttctgtgttcatatttccagatttattacttttggccaatctagtctaaattgagattttaggttttagaaaatgtttggttgtggtcttaatttgcatttctctaattagtaatgaggtcaagtatcttcacatgggtctattgtcgtttacatttcttttgtgaaatgcttcttaatatcttttgtatatttttctgttgggtttttttcttactggttataagaattcttggaaatatttgggcattctaatcttttgtgagttatatgtgttacaaatatctctcagtggcttatctttttgcttttaggaatctttttattaaaaagtgttcttaggtttgttgtggccagatttatcaatatttttatggttagtgtatttgctgtcttgtataaaaaatctgagattttaaaaaattctcctaaatttttatcttaaagttttaaatttttaggtctgtatctcaactattttttgaaaactgtgaagatggaattttgattaaaactgcatttaatcagctgggcatggtgacttatgcttgtaatcctggcacttttgagaggctgaggcaggaggatcacttgagtccaggagtttgagaccagcctaggcaacaacagaatgagacccagtctctacaaaaaataaaaaagttagctgggtggtgcacacctgtcatcccagctgctcaggatgctgaggcaggaggttcacttgagcctggtagattgaggctgcagtgagccatgatcatgtcactgcactccagcctgatcaacagagcaagaccctatctcagggggaaaaaaatgcactgaatttataggtcaatttagggagaattaacatcattacaatattgtctttaagttcttactatctatatttattactatttttctgaatatacacacagatttccagaatagaacggattgttattacttacatacagcaaagaataactacatggctcccttctgtgccaagtcttaccccaagagaaataccctgagagctggcaggataaaaccctacacataaggagtctgtgttgtaaatgaggagccttgaaaacatttatgcaggtgcttatatagaggaaagaagcaactgcttcctgctttctcctgttctgagagagttccttggaaatctaaagagaaggatcttgggttctttctctaaccctttggaatatagataaatattccctctggaaatataagcccagagtctcctgctccatcaaaggaagcccccttggtccaggctcctactctctcccaccccaccttgaaatgtaaacacataacctccagaaggtaaatctcttagttttctcactactaaatcagttataagttactttttaagactttcatttagcccaggtttcggtaaaatttgttcaaaagggaccagctgcaaaaacataaaagtttctctgcattcctaaagtctttttatttgtaaacatgatatctctccatatatttaaagttcttttaaaatgttcttccataaaatttcatacagaaaagactttcatttcttttcttgttttactgtattagctagaacctcagtacagtgttgactagaaatgataatagcaggcatccccatcttgttccccgattttaaagaaactgcctctgatatttcatcgctaataatgtttgctgtaagtttttaataaataatttttatcaggttaaagaagttaccttctattcctattttgttaataccttttatttagaatggatactgactttattaaatgtgcccttctgtgctctattgatatgattatatgattcttgtcctttaataagttggtgtggtgaactacgtttgtagactttttctaatattaagccactgttatatttctgggttaagcccaaatttcttataatactgtgatagtatagataacatttatgtagcaaatatctgttctaatagcactgttgtgaatgctttacatatattaaattatttaatctccatcacagccccatgagttaggtgttattctcattttatgaatggtgagaccaagcacagagaagttagttcacttgctcaaggtcatagaaatagaaagtggtggagctagattttcagcacaaggagtttagctccagacttcatgcatatctactttatatatcactggaactgatttactaattttcaaaaagggttttcactgttttttataagtgagattgacgtgtttttttttttcctcttttcttttttttgatattcagattatactggtccatagaaagagttgaattgcattcctgctttttctcacggaccaatgagttatttataagtatcttttaaaattttcaatatatggagttttatctttttttgttgacttctaatttagttgcagtgtcattacagaacttgctctacgtggtatctgttctttgaaatctactgagacttgcttcatggcgtagcctgttccatttttaaaacattcaatgtgtgttcttgaaaatagttcgtgttccaatttagagagcaagcttctgtgtatgaagcttttcagatcgtctttatattcactatttttttttttttgcctacctggtttatctattaatgactaagaaattaaaatttttcattatagtgatgtttaccaatttttctctgaagttctaacagtttctttttaatgattttgagactctcttatagaaggcacaaaagtttaggataatatttcttcttagtgtattgaattttatcattatgtagtgatattccttatccttagtaatactttttctactgaagtcaagatttcatttcttaatccagtataatagatggcctttaactggttactaatgtatatggatgtgtttctactatctttttttctgtttgtcatgatttttgcatgctgctttttatttcctttcttcccttctcaaaagtttttaactgtggtaaaatacgtataacataaaattaccatctaaacaattttcaagtgcacagttaagtaatgttaagtgtatttacattcttgtgcagcagtctccagaactctttttgtttgcaaaatcatttcttcttcactgaaatttgttgttgttgttgttgacattttagtttactctctagtcttttggtggttactcttggcttctaccatgtgtattaaccaagtttaagtttaagttaaatatcctaaaactatttcccacaaacaatttaaagacgtttaattttacagattgagtatcccttatctgaaatgcttgggaccagcatttggattttggaatatttgcattataccaattgagtatttctaacctgaaaatccaaaatctgaaatgctccagtgagcatttcctttgaacatcatgttggcactcaaaatgttttggattttgaaacatttcagatttcaaattttttggattattcaagctgtattacctctttacagctttatgtgttgttattggccagtattttagctgttatcttttgtttactgtacaaagttaacatttttatagtataatcttatatacacatttgtttacattcacattcatgttaaccattttattagctcttcatttctcttgcattagatctctaaaatcttttttttttttttcctgaaataaagctttactggttcctttagtgcagatctgattatggtaagctctgtcagttttgtttatatgaagcctcagacttgaaaagtaatttttggggtatataattttaattatcttctcatatctttgaaaatattttaccctgtttctgttgctgttgttacttcttcagtgtctgttcttagtctaattttcctcctccccgccttatttgaggatggggaataggtgatttgtctttctttccctctgatttctttacggtcttttatttctctttggtattacccagcgtcattttttgaacacttctggtttgggttttctaaattttttcttgattcataaatgtagagcttcctgtggtgatggatgcatgtctttaattttaacatttatattttttcacttcttttcttttctttttttttgagttggagtctcactgtattgcccaagctagagtgcaatggagtgatctcagctccctgcagcctcagcctcccaggctcaagtcatcttcccaccttagtagctacgactataggtgcataccaccatacctggcctttttttttttttttacattgttattttttgtagagataaggtctcacaatgtcgcctaggctgatcttgaactccttggctcaagcaatcctcctgcctcagcctcccaaagtgctgggattatagatgagagcaactgtgcctggccttatgttttctatttctaaatgttccatacagttcttctataaatctgcttggtcatttttaatagccttttgtcatttttttgtttttattatttcatcctttattccttgaaatatttcatatgtagcaattttgtgttgatatctaatgattttaataccaagatacctttgatgtttatttttattgtttttgttgtttgattgtggtgctttgttctttgagtattttggaatctgtggttgtgagctcattcttgtttgttcttaatatgtgaaaaattcagatttcattgcacttctttcccccaaagaaaatttgcatttccttttgctgggaggcaggtagtggtactgccctgagtccactttagctctcctctaagtttctcattttaattagggagtctccggtttagtttctatctccttgcttctggcttgaggcgtagcctccatgtcaagggcaacacttgttttttatgaaaacaacctcacacatatttattaaatttcacaaatatttattttgaccatcatatcgtttattcctaaactttttcctcatttgtggaaactaaggtactataaggttaaatcagcagctcctgtgcatttactgtattagcataaggaattgagactatatcaggacaccatgccgttaatatctgttcagaagtagtttatttcttttaatttgtcctaaggtgaataattttggctcttcttgacttaatgatagctattctgatggccaaatttggtctctaggttgcagaattggtaacttatattctttttacaaaactgtaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagaggttagtagtcaggcaaattttgtagtgcccatgggatagtgattaaagctgctttttgagactagtaatataatatataatttttaaaatatttctaaagttatttttatagttcattaatattatttaatatggatttaaacatttgaattatcttcctgttacaaggtaaattctcattgggataaatgttttgtttggaaaaaaattataaccgtgaaatctgcatttttcattctgttttaaagctggaagttcatacagaagctctagctgctgaagcatctaaagacaggaagctacgtgaacagagtgagcactattctaagcaactggaaaatgaattggagggactgaaggtatcttttgacttcacatttatgaagcttaattgattttcttctctttaggcttgttaggagtgttagcttgtatactgtattcggtgtgcagtgaaaactagcctttcttcaaacctactattcataattctcgttcttaccagtaggaagctaatacagatttcttaattatgctgaagaaaatggaggactatgtttagtgggaaatatgaatctatcaggagggagttagaatgtttatgcagacctacacaagatgtactggtaatctgcatgggagtcatggttagatatccagaccctctatatatctcataaatgactcaggagaagctcaggggtagctttgcagacacttgtgtctgttaggataagatgataatgggcatagtctaaaacatctcagcagaaggtgctttgcaagggaaattcttgagccgttctggagttagactacctattcttaacttcttgctttcaccagttacttgctgtgtaacatgtaacattggacagaacattatggggccgggcacagtggctcacgcctgtaatcccaacactttgggaggccgggatgggcagatcacttgaggtcaggagttcgagaccagcctgaccaacatggcgaaaccccatctctactaaaaatacaaaattagccaggcatggtgcgcacgcctgtaatcccagctactgaggaggctgaggcaggagaattgcttgaacccgggaggtggaggttgcagtgagcctagatcgcactattgcactccagcctgggcaagagcgaaactccgtcttaaacaaaacaaaacaacatttaacctcattatactttaattttctcctctataaaactatttcatgtcacgagtacatacatacatttgtaagctgacacattataagtgttcagtaactgttagtataatagtattatgtatattacagtgagtgaattaagatcaaattgacgtgatatttttaccatactaagtaatagtctgagtgtggtatctgccttttatcttttttgactggaaactttttccatcctgttttctctgctatatctgtcagcccccatttcacctacttcttttaggaccatgcttagtctagtgtctaattatccataacatgtaagaatcatactccttaaaatctacatactcctgtactgcttcttggaattctgttaatacctgtagcttagctcttattgtaattatttatttgcaaatctgtatatttccaactaaactgtgacctagcttattgaaaacacagacagttatattgttaatttggccctggcaaaggaccagatattgaatacttgtttaataaacctgttaagttaatgaatgaatcatgtggtagaattggtcagagcttactttgtctgacaattgaatttcagtggttgcaagtcaaattcctttgctgtaaatagaaatataaactcttgattttattcttgtttttgttttgggagttttagttcatcatgaattcatagtcctggttagctttacgaagtagagatgtgtcttctatatacctctagagcaggattagtatgtagaagtaattacatcaccatcccagatacttttcagtcagggcctgctttgtttccagcactattctgggtgctttggatgataagaataataaagtacaaactggaagaaatcttaggcattatttttatttgagaaaattgagggtcagaagagttaaatattttagagtcataagtgatagagtacaatgtaaacccaggttttctaactttcattcacatgatttatctaatggtttgctttttatttttttctacaataaacattacttcattggagactctgtatcatgtttacctacttgccaaacacatctctgtgtcatttagaaatttgagataatataacacctacctagtaaataagttaatgcatttaacatgtatagaccagaacctggcatgtagtaaagggttaaaacatattttggcccttttaaagattgtaggaatcttcacttcattgagaatacttttgacagacttaaagagagaaatagccctacaaaaagagttaaggacttcaatatctcacttctaataatggatagaacatatgcacacaagatcaataaggatattgaggttgtgaacaccactataaccaactagacctaacagatacagagtcagcccttcatatccatgagttctgcattcgtggattcaaccaaccatggatcaaaaatatttggaggaagaaaattagatgggtgcatttgtaccgaacatgtacagatgatttttcttgtcattgttccaaatgtaaaacctacttatatagcatttatatcacattaggtattgtaagtagagatcgtgacgttttgatcagccacagactgcatatacaacaatggtcccttaagagtataacggagttggaaaaattcctatcatctagtaacgtcttgatgatcttgaccctgtgtaaaccctatattaatgtgtgtgtttgtgtcttaatttttaacaaaaatgtttcaaaagtaaaacaaataaaaattttacaaatagaaaaaagcttatagaaaatggatataaagaaagatagccaggtgcggtggctcacacctgtaatcccagcactttgggaggctgaggtaggtggatcactggaggccaggagtttgagaccagcctggccaacatagtgaaaccccgtctctactaaaaatacaaaaattagctgaacgtggtggcgcatgcctgtaatcccagctactctggtggctgaggcacgagaatcgcctggacctgggaggcagagattgcagtaagctgagattgagtcactgcactccagcctgggtgacagagtgagactctgtctcaaaaaaaaagatacatttttgtacatctgtacaatgtgtttgtattttaagtgttactacagaagagttcagaaagttttaaaatagtaaatagcttataaaggtatagtaagccaagttttttattggataagtaaaattttaaaaatagtgtagcctaagtataaagtgtttatctatcaggtctccagtagtgtacagtaatgtcctaggccttcatgttcactcaccagtcactaactcatccaggccaatttccagtcctgttaagttccattcataatgctctatatgacataccattttttattttttataccttacttttataccatatttatatgcgacataccttttttatcttttatatgatgtttttactgtatcttttctatatttagagacacaagtgtttactgttgtgttacagttccctgcagtattcaggacagtaccatactgtacaggtttgtaacctgggagcaataggctataccatatagcctaggtgtgtagtaggctgtaccatctaggtttgtggaagtacaacttatgttcacacaaggacaaaatcacctaatgagatgcatttctcagaatatatccctgtcgtttagcaatatgtgactgtaatctagaggtgatttaaagtatatgggaggatgtgtgtaggttgtatgcaaacactgtaccattgtatatatgagacttgagcatccgtggattttaggtattcaagtagggtcctggaatcagtgccctatggatactgagagacaaccatatatagaacttttcacccaacaacagcaaaatatacattcttttaaagtacacatggcagattctccaggatagaccacatgttaggccaaaaaacattttagtaaatggaagaagattgaagtcgtatgaggtatcatctccaaccacaatggaatggagctagaaatcaattacagggaaaaaaaaaacctggaatgctcaaaaatatgtggaaatcaatgaacacactcttaagcaaccataggtcaaagaataaatcaccagggaaattagaaaatacgtgaatgaaaatgaaaatacaatacaccagaacttacagatgccataaaggcagtgctcaagagagaaatttgtaactataaatgcctgtattaaaaggaaggactaaaagggaagaaagtaaaaatcactaacctaactttatatcttaaggtactagaaaaagaagagcaaactgaatccaaagatagcagaaggaatgaaataataaagagtagagcacagctaaataaaataaagactagaaaataatagaatcaataaaacaaaaagttagttggttagaagtcaacaaaattgacagcctttaattagactgaccccttcccaataaaaagagctaaagagagagagatgttgcaaataactaaaatcagaagtataagggaaaattttattactgaccaacagaaaacaaaagaattataagaggaacaactgtatgcccacagagtagataacctagatgaaatggacaaattcttagaaggatacaaataacccagtatgactcatggcaaaatagaaaatctctgcagacctataacaagtaaagacattgaatcagtaatcaaaaaccttctgacagaccctcctgcactccacaaccccactccagcggcttgttaaaaaaagacaggccaccttctaacaaagaaaagtccaagaccacaccacttcactgctgaattgaaccaaacacttaaagaaaaattaacagcaatccttcccaaactcttttttgagaaggcacctgtcgtcccagctactctgggggctgaggcaggaggatcacctgagacttcggaggtcgagacttcagtgagccatgattgggccactgcattccagcctgggtgacagagtgagaccctgtctcaaaaggaaaggtacttgagacttgagcttaaaataaattcacccaagttccaggctgcaagatcaacacatagcaatcagttgtgtttctataaggcagcacgaacagtctgcaaagaatgttaagaaagcaattccacttaacaattgcatctaaaggaataaaatcccttgggacacatttatccaactaaaaatgacaaaacattgctgaaaggaattaaagaaaatctaaataaatggaaagacatctcatgtttatgaatagtgggatttaatattgttaagatgcagtactactacctaaagttatgtacagcttcaattcagtccctatcaaaattcaaagtcttttttgcagaaataaaaagctgatcctcaaattcatatggaattgcaaaggacctggacagccaaaacaatcataaaaaaaggacaaagttggaggagtcatacttcagaacttactacaaagttacagtaatcaaaacaatgtggtactgtcataaggatagacatacagaccaataaaatataattaagaatacagaaataaatgcatgtatctatggtcaattaatttttgacaaatgtactaagtccattcaatggggaaagaatagtttctacagatgttttgggacaactgaatattaacctacaaaagaatgaaattggtcacctgcatcacaccagttatacaaattaactcaaattggatcagcaactgaaatcttacagctacaactataaaactcaagagaccttggatttgataatggattcttagaaataatactgaaagaagaattaacaccaatccttctcaaactctttttaaaatagaagaggaggaaacacttcctaactgattctgtgaagctggcattaccctgaataccagagccagacaaaaaaatcacaaaattacagaccaacgtttcttattaatatagatgcataaataacaaaaaaagtataaattgggctttatcaaaattaaaacttaatgtgtatggtatcaaaggacattattaagaaagtaaaaagacagcttaagggatgcaagaaaatatttgcaaatcatatatgtgataacaatttaatatccagattatatgaagaactacagctcaacaacagaaagacaactcaatcaaaaaatgggcaaaagacttgaatagacatttctccagagaagatatatataaatggtcaataagcaaattaaaaaatgctcaacattactaatcactaggagaattcaaattaaaaccaaaatgagataccacttcatatgtactgggatagctaaaattaaaaagaaagaaaaagaaagtaggtcttaacaagaaggtagagaattggaacccttatatgttgctaaagaaagtataaaataatgtagccacttttgaaacaatgtggtggttcctcaaaaagtcaaacagaactaccacatgatccagccattccactcctaggtatatacccaaaatatttgaacataggaactctaatagatgctttacacaagtgtttattgaagtattattgcagtagccaaaaggtggaaacaatccaagtgttcatcaacagatggataaagaaaatgtggtatataaatacaatggagtatcatttatctatgaaaaggaatgaagtcatgatacatgctacaacatggctaaatctcgaaaacgtactaagtaaaagaagccagacacaacaggacaaatactatatgattccacttatatgaaataatttagaataggcaaattcaggcccgatgcagtggctcatgactgtaatcccagcactttgggaggccgaagcaggaggattacttgagcccaggagttcaaaaccagcctgggcaacagagtgagaccccatctctacagaaaattaagaaattagctgggcatggtggtagatgcctgtagtcccagctactcaggaggctgaggtgggaagattgcttgaggtcgaggctgcagtgagtcatgattgtgccagtgtactccagcctggacaacagagtgagaccctgtctcaaaaaaaaaaaaaaaaaaaaaaagagaataggcaaattcacagatacaaagtagaatagaggttaccagggtttgggtggagtggggaacagggagttaattcttaatggttacagaattttttgttggaatgatgaaaaaattttggaaatagatactggtgatatttatatagcattgcaaatgtaattaatgccattgaattgtgcatgtagaatggttaaaatggaaaattttgttgtatgttgttttaccacttaaaaactattaatgcagtataacaagataattgaattttacacttttaaatgagtgatttgtatgatatgtgaatcacatttcaataaaaaaaatttttaaagaaaacttttaagttgttatatatgatgctgtgatgttactagaggtatttttttttccctattgtgttagtttgttggggatgctgttgtgaagtaccacacactgggtggcttaaaacacagaactgtctcagttctggaggctagaagttcaaaatcaagatattggtatggttggcttctggtggcatgctgacagtctttggtattgcttggcttgtaagatacatcaccctgatctctgctttcatgttcacatggagttctccctgtgtgtctgtgtccagatttctccttttataaggacgcagtcttaatgaattaggggtgtgccttaccgttttgattcgatttacctcttaaaaccatattttaaaataaggttacattctgaagtactggtggttagggcttcaacataggaatttgaaggtaatacagttcaacccatacacttacatttttcacttaatagtgtaataagcatttttactttcattaccaaattgtcacaaacataattttaatgattttaagtagttcaagaagaattttcacatacctagttatttctatttgttattacaaaattatcacaaacataattttagtgattataaataattcaagaagactatccgcataaccaattttctattgttacctttaaaaattctttgcagtattataattgccaaaaacacctttatgcactgctttttctgtatcattttcttagaacaggcacccagaaacgaagttagcgattattttaaggctaatttatgtgataaatcccacaaatctttgcaaatacgagaggccaaaaaagttgtacctctttatttcttggtttattagtggattgttttattaataatattttctgttcataaattctctctttatttgctaatttaatttagtagtcttaatgtttttcttaccaattcataaaactctctgcacagtaaaaattttactttttgaagtgttttcagcaactatttaaccaatttatcatgtatcccttaattttgatcttgtttctttttaaaattatagaagatttgttggtttttctcagtgtttcttctgtcgcttcaaagcttggcttgtccttctctcagagttttgataagtatttaattctgctttcttttggatgtttgttgggtctaaaaataattaactgtttaatctattaggagtttgttttgctaaatggtatgacatgagattgatttttgttattttattgctagctggtgattccaatttcatttattaatcattgccttacccaatgactgaagatgtctcatatattgaattaaattatttcggggagcagatctgtcatagtgatactttagtaaagagttatagtatgttttaatatttgaaaagtatattttcccatgcaccccttggtattttctttgacatttttaccagtttattcttatccacggagtagaaacatgtctccatgcccttctatctccacatttataaagaacttttaattagaattatgtggaagataacatgaaaaatattgaatatgtacatttaatcttcccttttaaatactttgtttcaagacttgtaggtttctcatataaatcagaaatttctcactattatccttcaattaacaatgaaatttttgttatgtttattgcttattttaatatctggaagtattgatttgtgtttatcttatatgctattgctttactcaactatcaattctaacacatttcactagatttatttgtattttctgggtgaacaattaaatagaaatgataaatatgttatttttctttacaatattcatttttttaactattttacatgttggtcagagagacaattttatatgttggtctgaaatgaatgtcgcataagagtggtaatggaagacatcctttttgttgatatttctgaatttactcgatgtatctctgatgtttcacgtaaatagtattttgatagctcaaaatggatacttttaaattaaaagaattactggttttttttatgtaatggttttattgtgggacttagagtagtatttggaattattactggattttataaaatgctattgggtaggggtacatactgagattatcatttggatttttacatactgagattatcatttggattttaaaatttaatctattaaaataattcattttatgacacatttattaataagtttgctgacattaaattatcttcggtgtctgcaataaaacctattatttcttggtaggtttttcttttttacagatggtttaataatatcatttgtgttctatttggcttttcacattcttatcaataagtgatatgcatctgtaaccataattgttggtatctttgttaggttttgatttcaggggaatttttttttcttgaaacttactgtacatgctgctgccatcccaacagtcatcacaataaacagaacatcaaactaaaagtgttcttttctttaagtagttagaaaaatgcaagaatagtacgggtcagtggtaagtgccacagatgtcaatttagttctcattttcatagcgatgcttcagagcaagaatctgccttgctctggttcttctcaagttaagcagacttttgcatgttaggctgcctcataaaccattggacgatctggatctggcacatgaaaagtattttttcgataaatggttaatattgcagtggacacgccagggctatttctctggcccacatcacttcctttgctctttttaaattatatacttcaaacatgaaggagtcagggtatttttccttctactttaagtcaactacgcttaccagtttttattgcccttatgactgacttcaaaaaagaatacagtgacctccagatcttgattctttgttgtccctaaacttaagtgcatagattcttttagttttaaaagttttattgcaactggggagacagataagatataacaaattaatgacctttggaaaattacaaagcttaggaaatcttacagtcataatctgtagtctgtatgtttctgtttaccctttaggcagtacctggaagaatctttggactttacattttcttttctttcttattactgagaggatatttcagccttatttctaaaaaggtagatttcaacccaatttcttctccttcttaatcatacctaaaagtgaagagacctaccgttttttttctagtgtagatatgaaggagatgttagtttagacctttgccatttctcacaggactattgcaaaaggtttctgtctttatttttgtacattctactctaccattcctttgcccattttaatttttttaagacacagatatccttaaaactttttatcagttcttcatcagatttaggatgcagttagatttttctctcactccatacaccaacaataattgtaaataaattagaaatttaaatgtaaagcaagaaatcatgtaagtcccagccaaaaatttgaataaatatgtaatctttgtgtgaagaaaactttttaaaaacagcaacaaagacagactattaaggaatgtaaactgaggaaaatatttgcaatatatggcaggcaaaaagttagtagatttaacatagaattttatttttgttaggatgtacaaaaaatgcagttatatgaatactcatttatattacagaaagaagttatttaaatattttattattcttgtagatgcactaatcttttgttattatttctatagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaaggtaagaatcacattatttactatacagtaaatacttactgagtacctgttatgtgtcaagtattggagatacatagacaataaacatatcctagacctaaaggagaccaaagtcaggattggcagatagaaaattataatacagcatgatagaaaagcaaatgggatgataattctgaacaaaattacttctagctgggtatgatggcacacgcacacacacacacacacacacacacacacactagctgggtatgatggcagacacacacacacacctataatctgagctacttaagaggctgaggaaggaggcttacttgagcccaggagttcaagcccagcccaggcaacatagtaaaaccctatctctaccagggaaaaaaagaaagaaagaaacgataaacttctaagctgagatataattagtaagaaagaagtagctagggaggagtgtccagggaggatgtgctaagatctaaaggaaaagggggacatgccacattcagaaaatgatagctgtttactatgactgaaacataaatagatgagagtggtgagaaatgaagctggaaagtaaaatagaggcaaagtcatgacagaatacaaggcatttgcacattatcctcaggccattgaagaaaggtgacatgattatatttacatttttgaatcaccactcttgctactgtgtggagagtgaagtgggaggagcaggctggaggtaggaatccagctgcgagagatgaggtgtgggcctcaggtggtgatagtgaagatggagagaagtggatggattccatctactaagaagatagaacctggagaacgtaataagcagctgtgagaaatgagggagcaggagaaattatcagttatactcagctttctagatttcaggcaactgaatatatgttattgtcattctcagcttatattggaagcccaaatttattcaatttggtgcatttattcattcagtaatattttttaacctaccatatctgacgcactgttgtagggactggtacaaaaagacaataacaatgaaaaaaattcctgtcccatagaactttctataagtaaaacatagaatacattagataatgataaatgctaagaacaaaaaagtaagaggaaatccgttctatgaagcattcaagggagggttaaattatataaatacaggatggccagggaaaactatactgagaaggtgattgatttcttagttaaagattaaaacaagaagagatgtttatacagatgtgtgaaaagagcattctacatggagaagaataagttttttacaaaatagtgaggaggccattgtggctcaagtagaatgatgggaaaagaatagtagagacgagagaggaggcaacagggggccacatcatgtaaagccttgtaagtcatatttagtggatgcatagtttcttattctgagtaaaactattgcagggaattacagtcatgcattgcttaacaccagggatattttctgagaaaggtattgttatatgattatatacaagattttttttaaaaagggtacacctatataaggcacttaccatgaatgaagcttacaggactggaagttgctctcggtgagtcacaactagaaggtcttcagggacagttacatacatgaaattgtcatttcctatgacaacagtgccttcttcgggaatacttcctgaaggacctgcctgaggttgttttacagttaacttttaaaaaaatattaagtagaagctgtatactctaagataacgatacgaagtatagtaaatatataaaccagtaacacagtcatttattattaagtattaggtactgtacataattgtatgtgctatacttttatactgccgacagcacagtaggtttgtttacactgacatcaccacatacacgtgagtaatgctttacattagtacttaaaacagttacaatatcacaggtaataggaatttttcaacaccacatagtgttcccataagattataataaagttgaaaaatttacgcagttatggactaatgcattatggactaatggcagtccatagttgatcaaaatgtcattatgcattacatgactatattgtagaattctgagcagaaaagtgacaactgatttgtgttttaataggatcactctgaatactaggttaagagtagtctgaattaggtaagagcaaaagtgatgagaccacttagaagacgattgaagtaatccaagcagaagatgacagtggctttggcctagagtagtggcaaaagggataagaagggtttgaattttaatgatctttaaaggtaaagatagcaatgtattgatggactaggtatgggatgagggagaaaaaggaagactcaaggatgatactaaggtttttggtccaagcagttgggagaatatattactagaaaggacgactacaggagaggcaagtttgggattgggagtgttatcaagggcacattttttcccctgacaagactctttcataaacagaaagagctcattttaaacagttacagttgagatgcttattagacattcagttggagatgtcaaataggctgatgtatagaccagcctggatttgggggcaggaggtaaaatcctgagaatatttatcacttccatggcatttaaacctctgagactgtatgaaaacacttagtgaatggatatagatagaaaaaaatttcttagaactgagccttggggtactccaatttttggaagtcaagagatgatgaggaaccagcagagtggatagagaaagggcagtgagaatgacagcataataacaggcaaatttagtgtccttgtgttagcagcgccgaatccatatgtgtttgcagcagcctcaattcttgcctcctcagaataaagaattagaccaaggggcataagacagggagagactgaggcaagttttagaacaggagtgaaagtttgttaaaaagctttagaacaggaataaaaggaagcaaagtacacttggaattgggctaagtgggtgacttgagagattcaagtgtatgatttaacctttgacttggtgtttaacctttgacttggcatgcttctgtggggttgcatcccttctctgattcttcccttggggtgggctgtccacatgcacagtgacctaccagcacttgggaggggctgcatgcacagtgtgtttactgaagttgtacacgtgctcatttgaggcattcttccctgactggttgagtgctcctagaagaaggtcatatgccaccagttaaactccaccattttgcctcttagtgtgcatgcttgagcccacttgcctaactcctgagtcttattgggaagctgctgatcaccagtttcaggcttttctatctagtggtagactgccttttcctggcaccaggtgtgaccaattattattttagagagacagtttaacaaccacctgatcatcacctgatgtggccattcctggttgggggtgtcctcctgtcctgcttatgtctgcctgactgcctactgtaacactggaaaccaagtgaagaaagcatataaagtctgtcagcatgtcaaataaaatgagttctgaatcaaatgagataaggactaaataatgacattgagtttagcaatagcaatatgaaggtcattggtgcctttgataagaacaattttgtggaaaagtagaggcagagaccccacagtaggatcaaaagagactggaaggagagcagttagaggcagaacatagaggtaaaactattgtactttgttgtgtgggtgtgtgtgtgtgttttaagatggaaaaaataacagcatgcttgtaatctgatagaaattatagatgattggaggagagaggagaggaggaaagtactggagcaaagtacttgaggatgttcataatgaaggggttggccttactcgatcctgttttgttttttttaacctatcatgaaaagagaaagtagagtatatggacatagatggggtggtgggaacttgtctgtgtgttgagctctcttgttgagttgggcatattgaacttgtggtgcttggaagacatctttgtggagatgtcaggtcagtttgaaggccacaaaagcttcaagtgtagattcagagatcatcagctgaatacataaataaaaccagctggtgtcattgatgagctaactcaggcagcatgtgtagagagggaagagacagcacctaagacagaatactgaggagcattgatatttacaggaaggatggaagagtcacaaagacagctgaaaagaagccaggaatgtagactaaaactaggagagcatgggatccctgaagtcaaagccagacagcatgtcaagagggcaagagtggacaacactgtcaaaagtggccagcaggttggatgtaatcacaggcagtgttgagttttgagagagctgttttcttgagatggtggaggcagaagccagattttggtgtggtggagagcaactaagcgatgaaaaagtagttacagaatctgtttcaggatgcttaccagtgagtgggaagacaaggatttaggaaatgaattgtgacacagggtatggggagagtttctttatttttaatatggaagagacttaagcttgtttaatgctaacaggaaaaagaatggttttacatgaaaattttactcaatttatttgtgtacatatttttctgaaagtctttgcagtttttttattgaagttgcttctgtgttaggaaagcttcctaaacataactaaatttaacatctgtctatagatagtagtgaagtgacaaatttgcttggagatggaggttggcttattttccttgaatttgtcatttaaattataatttatcttcaataatgttatgtaggagatttttaagattacacttttaagatcaaccattacttacattgtttgttcaccagaaagcaatcatataaaattacccagaactgatccacatggaatttcatttattgctaacatcctatagcatccatcaaattgctgtagatatatgcctgtttgtcacataacaatatagtcttcaaaaacttattccttgctgggcacggtggcccatgcctgtaatctgagcactttgggaggctgaggcgggcggatcacctgaggtcaggagttcgagaccagcctggccaatattgtaaaaccccatctctactgaaaatacaaaaattagccagacacagtggcatgtgcctgtaatcccagctactccagaggctgaggctagagaattgcttgaacctgaaaggcggagattgcagtgagctgagatcgcaccactgcactccagcctgggatacagagtgagactcttgtctcaaaaaaaaaaaaaaaaaaaccaaagaacttattccccttttttccttagaagattttttaagtcttattaaaactgtgtttacttctaagggtaaataagtcatcatgatccacagaactatcattttaaataagctttgtaatattataataataatgtgtatatatgtagatgtaagaaggaatggctgaaagtattgatagaactgttggaaatttaattgaacttttaatacaatctagggttgagaacaaggaatcattttgtggttcatatatcctctttccctaacctctcctttcaccatgctttctagtatatacataatcaaataaggtgagcataggaagtctacacatcacagatgttttcctcagatttccaaatgaaacacaaatagatgttattaagtatacgttcattgaactcattaaaagtaaatgagtgtgacttttaattttaagggaaaggatgaggatttggaagcatcaggctataagtaaagcagatggtgcaatagccaatctggaatactgttattttcaataaaatcaggcaatgcagttccattctggcattttctgctgtcatttgcagactgtcatctgaagacacctaccatagtgtttctccaggatgctaatgtgccctctcactggtgtatttattaatgccttggtgaaaggagtgctttgtgggtggctgaccaggttgcacataataggtccactctgacattctcatctctttgagccagtagaccctttatgctcagtaagtcaaatatctcgagctaattgactgtaggccactattgggtccaaagtccaggcttcaattactcagcctagcagtgaaaaactacacctgaatattgagtcaacacattaaaccacaaatcctagatgagtatgtgcatttgataaatttggctgtatttaattttttatttacccaccttggggtaacacccttctgacctgaaggaagaagctgaggcacaggatatgtttaaagagtttgtttgagccaaagtgaggacagctgccaggaacacacttccaggttaccttgaggagtgctccattaggtctttgttacaagtagggttttaaaagcaaaaggaggcaagggctgggctgatacaaagttgtttgacaggcattttcactggtttacaaaataacattgattagtgactggctattcattgttgaactatagcgtgtgagtcatggtctccagtgtatggcattttatggctacttggcatcagtttagagcccacatagcaagtggcctcaagaggtgattatttagctcaaggtgggagtgagatgtgactgctctcacattttaaatacctctctgggcctgataatttaaatggtctcacattcctcagataaaaaaagtttattttctttctcagctcttagaattcatttctgtatgctgcccatactccttccaatataaattgccaaaatgctttaacaccttcattgcttttatatctagtctctgctgtgatcttaactgtcatcataggcctgaagacaatgacaagtgattgggtaggtgttaaagatagttggcctccctttttgatgtaactatttcaggtgaagttaataaatgatttatgcaaaaacaggttggttgcctcaggttatagctgctttgaggaaggggatgagattgcttctacctgcagaggtttgaagcaatacgagagttcagagttctcagcactgtcttttgctgcctgaaggttccaatatgttgtccaaaagacagaaactgagacaaaattaatatagagtttatttgggccaaggttgaggactgcagcccaggaaacacagagaagtgctccagagaacaaaaaagaggctcaggtttttaaagaaaaatcaggagagggaacatacaaaagtctttggtcaggagttctcactggtttgcagaaataacattgattaatgattggctgtacattgttgaactatagggtatgagttatggtgtccagaatatggcattgttgggttaatttatagctattggtgacactcagtctggagtccacatagctggtagattacttagctcaactgggagaataagatgtgactgcagtcacatttcagtgcctgtctggccctgctaatttaaaggggctcgcatttctcataaaaagtttcttttctttctcacatctcatgtcttggggactgcactcattctgaatccacacccttagcctaagaggtttggtcagtgttgtgcagatcaacattttgcaccttctgatgggatgcactgagaaacattgttcttgtggtattccagccaaaaatgaattctttgagactagtcataaacatcagatggccccaggttgagtgtcactgtacataattagagacctatacattataaaactgttgtgagagatagggaagactgaggaactgttctagaccaaggaaaattgaagagacatgactactaaatgcaacacatgtttctcagttggatcctgggcttcataagaaaaggagacatggtagggataacttgaattgtgtctgtgaattcagatggtaagtgttctagtaatgttgatttttttaaattgagaggattgcttcgtgattatggtagagtgtccttgactttgaaagatacacactggagtatttaggggtaatagggcataatatctgcagctagctgcctctcagtggttctgaagaacactaataaaatcggtatatacacaataatagagaaaatgcagtaaaatatttacaattggggaatctgggttaagagtatacaaaaattctttgtactattcttgtaactttgctaataataatgaaattatttcgaagtaaattttttaaaatttctgaactcataaattctaattatgaacaaaatgtttggaatactattgttaatcaaattgataacactaggaagtggctctggcctaatactaaataagggcccagcaactttgtattttgtaagaatattgtggtggaaatacacaaagaaaagtatctaatttggtctcaaactaatttgcctttggatagaacgtaatgcatgtgaagcaaatggcaattattattttcattttggtccattatcaaccttgatgtacgttctctgactatataatctaaagtagccaccctctcccaaatactttttgcattgccatatatatacaatttagaacttattatctgaaattagttcattttactcactcttcattggcagtctgcctctaccagaatataagctctgtgagagcagtagctgtcaagacctgcaacaattccttggcacctagtaagcactccataaatagttggtaaatgaatgaacaaatcagtattattgtaatataaattcctggaacatgctttcaccaggcctgtcattatatataaacaagctgtattctatggggacaacatttctgcagttcaatctgatattttgtgttttatgtaactattggaaaaataatttcaagttttcaaatgacctttaattcccctttttccttttgtgttttgaattgtgttagtcaaagtgaaagggaggaatttgaaagtgagttcaaacaacaatatgaacgagaaaaagtgttgttaactgaagaaaataaaaagctgacgagtgaacttgataaggtgagtgatttaatctcatattaattgagtagtacatgctagatgttcaacactgataggaattgtgggtataactttatatttgacatacatttttgtttaatagtctttctcctgagttatgttgcttctatgatatatgcaattctttgttataataatctgataggagtcttctgaagagagagttttgcttatctccttttattctttgtcccatatatttttttgagcctcttatttatttcactctccatccaattagtccattttggggttactataaaggaatacctgagactgggtaatttacaaataaaatagatttattttggcttatggttctgcaggttgtacaggaagtgtggtgccagcatctacttctggtgagagtctcaggaagcttccaatcatggcagaaggtgcaagggcaagggagggagcaagagagagactggggaggtgcacacacttttgaacaaccggatctcagtgagaactcacttatcaccaaggggatgatgctaaaccattcatgaggggcctgccctcctgatccagtcacctccccccaggccccacctccaacactgggaatcacatttcaacctgagattcgaaggagacagacattgaagtcatatcaccatctgttctctttcttactcttttttttcatatattcatcgtttaccccgtcacggatggctaataagttcaggccaagttaaggctgtcccttggcaagaacagggacaattaggccaaacctggagaaattgtaacagctgattcatattcacaaagaagaactagtaaagctagaaatgataccaggggtaggtgatatctaaagaaaccatctcagcctgatttctagcttgcatacagaatcatgtattgaactgagaagtagccatattcatgaacaaaatttcaaatacttaaaggaatttttttcccacttagtatctcaaatttcccaacttcccaccattctgcatttcttgtgctaattcctagcaagcagttgtaaaaatcctaatattaaccagaagtttattgtttgtttgttttgatacagtctcgctctgtcgcccaggctggagtgcggtggtgcaatctcgtctcactgcaacttccgcctcctgggttcaaacaattctcctgcctcagcctcctgagttgctgggactacaggcgcacaccaccacacccagctaatgtttgtacttttagtagagttggaatttcaccgtgttggccaggctggtcttgaactcctgacctcaagcaatccgcccacctcagcctcccaaaatgctgggattacaggcgtgagccaccatgcctggccacatgagccactgcgcccagcccagaagttttaataattctacttaaatttaaataataagggctggttaattgtattttataatgatatctagtattttcctccaataaaaatattatgttcaattattagttattccaataacagactgaaagaccttgacttgtaaaatagagactcttccttttgttttctgtatagctctgtatttctcactattttccccatgattattcagcatttaaaatgctaaataagtatttaaaacattttttaaatgactgcttgttttctaagcctttaaaaaatgactagttgaaaactacttgagaaagaatactgttcacatcataaagtcttgtaaagctaacatacacaaacattgtaggaagtggctgaacagtaagtaatataaattgattttttaagccatgaatagtgcatgaactttaacagttatttccattgaaataagactaacaatatttgaactttatccaagcaggtcaataattgttatttcatgtgttgactaatttgattacaaaatttaatgtcattttgtcctataagacagaattttaagattctgttgagttacctactaaaagatgttattacattttaagaaaaattgtattggaaaataacttgaatgtagatcaaatttttgcattcaattattggtttaatttcattgttagccatacatttctgctgagtttatccaaaatacatatttagagagaatttttcaaaacttctcatttgattaaaattgtgttgcagtctaatacatccatgagaaatggacatacttaggcctagtatatgtaatgaagcctccttgatgaggcctgaaggatagtttgtttttaaaaaaaaaaaaaaaaaaaaaaaacggaattacccattcttgctaaattgaaagataggtaggatatgagtagcaccttaagagcaaattcatatggtaggtaaatatttaatgtccagtggttacagggcagtatttattcctgaagaaatgggagagatctggaatctctatttccatttgaacctctgctctgtttctcaaacttttgttcaatttttgcatctctctcttcctaattctcagtctacctttccctttttaattctgtctgtctcagtagtgataagctgaacttcactgtacatcttcactttccatttattcattttccaatttggttagaagtgggtagtttccccaaggatgaccacagaagcatttgccattgctacaccaactgttccattgggaaccagcttgaagagaactggatctcttcttgacagaattacagatctagaagtcagaaagcaattattaggttaattttgaaaggtacatattacagattttcacgtttttaaattccaaaaataaaaacgtttaaataaatttttaaaaattagatgacatttttgtaaatcttataaaccccaccttctattaaaagataattcattgccagctgggcacagtggctcacacctgtaatcccagcactttgggagtccgaggcgggcagatcgcttgacgtcaggagtttgagaccagcctggccaacgtggagaaaccccatctctactaaaaatacaaaaattaaccgggtgcggtggcacgtgcctgtagtctcatctactagggaggctgaggcaggagaatcacttgaacccaggaggtggaggtagcagtgagccgagatcgcaccactgcactccagactgagcgacagagcgacagtctgtctcaaaaaatatatatatatatcattgcaaatataattagccatctggtttccttcaatctcataacaaatttttaaaaatcagccatttatgccagtgagtaaaattaattgtttacagtaagaaaagttgtaatttgtttttaaaacttgttttgtttttaaaatattttcaaaaaatgtggaaaatatttaacatgaaagttacccataatgtgatcaccacaaaacaggtattttaattttgtatgttcctttccaggtatatccttattattacataattgcaatcatgtatacaatccacttactaatctgccttttcacttaaaatgttaagagcattttttcgtattcctatgtagtcttcttataagtcaaatgtgtcaatgtacaaatagtaaaacctcattttcaaacatgaaaaatgaactaatacttaaaatttactatgtgcaggtcatctttggaattacttcatataactcatttaattttcacaataactctctaaggtgtacccttttgttcttgccattttatagatcaggaaactaagtcaaagaagggttaaactactttcccaatcacaagaataagaagtaggatttgagtacaggtagtcgggctccggagtccatgcttttatttggtaataatgcaaagattaacttttttctaaccgattccacatacattaagcaatctattgaaaactgcttgtcactgttgtaatatgacagtgcagagtttgcattttcctccttctcttgcaaatctccaactgaaaccccaaccacaaatgtggaagggctataaaaaataatggtaatccaaaatggatattagtgcaggaattaatgtaagagaagatgctgcacatacaactctcaaaaacagctgatagacttctggctatgctaatatgaagaaattgattaatcttctaaaaaaatactaaaaagcaaatgcaattgtcaaaaacaatcatttcagaagtcttggagttaaccagaggaagatgacagctacagaatactgctaagataaattaaggactatctgaacaaatggagagataaactatgttaatggattggaagactcaatattgttgggatagcaattctccccaaattgatctataggttttgggacatccctatcaaaattctggtaggctttttgttggaattcacaagcttacccttaaacttatagaggaatagaaaagaccaagaatagttcagatattttgagtaaagttagaagtcggaggattaacactatgtaattttaatacttgctataaaaatgcagtaatcaaaaacatgtagtactggcataatgaaacgaagagtccaaaaataagttcttacatttatggtcagttgattttctgcataagtgccaaggcaattcaatggaaaaaggataatcttttcatatagtactggaacaattggatatccatatgtgagaaaaaatgaacttggatccttacctcataccttatacaaaaattaactcaaagtggatcacaatctgaaatataaaaggtaagcataggagaaagtctttgtgattcagggttaaaaatgtcaagataatgacattaaaagcacagtgcatgagagaagagtaatgataaattgagcatcaaaatttaaaaagaacattaagaaaatgaaaagacgtgcacagatggggaggaaatatttccaaatcatttatctgaaaaaagacttgtattcataatatgtaaagaactcttaaggtggacgtggtggttcatacctataatcccagcactttgggagtctaaggcatgaggatcacttaagcccaggagttcaaaaccaatctgggaaatatggtgagaccttatctctacacaaaatcttttttaaatattagctgggtgaggtggtgcatgcctgtagtcccagttacctggaaggctaaaacgggaggatttatgtgagtccaggaagtcaaggctgcagtgagtggagatgacaccactacccagagtttgaccctgtctcaaaaaaaaaaaaaggaaaaaaaaacctcttaaaatataaacaactcagtgttttaatgggtaacaaagccgaatagacatttcatgaaagatgatacatgaataacaaataagcacatgaaaagatgatcgtcattaggagaatgccacttaaaaccacagcaagatactgctgtataccctcgagaatggctgtaatcaattggcgtgaccgtatcaactattgatgatgatatggaggaactagaacttacacactgctcataggagtataaaatggcatagcacttgtagaaaatagttccaaaaattctcaaaaagttaaacatatacttaccatacaacctggcaattctcctatttactgaaaagaattgaaagcatagtccccttaagacttacatatgaattttcatagcataatattctcataatagtaaacaactggaaacagtacaaatgtttatcaatggtgcatgataaacaaagcatatcatacccatatactagaataccactcagcagtaaaaaggagtgaaattctgatgcatgcaacagtattgaggttcaacttcaataatctaagtgaaagaagtccaatacaaaagactgcatattctgttatttcattgatagaagatttcagaaaatgtttctacagaaacagaaagcaggtcagtgatgcctagagaaatcagagtgcggaccaagatcaattataaataggcatggggatatttcttgagtattagaagtgttccaaaactggattgtagcaatcactgtacaactgttgaagtttgctaaaaatcattcaagtatacacttataatgggtgaattttatgttatataaattatacctcagtaaaagtgtgaaaaaaaactggtaaactatattttcagaggcaaatggcacaccctaaggtacaaacttaaatctcttgtttgcaataggcaaatcagtgtgtgccagcagtgagtgatagcttccctggatctcatttccttttgggaagacaaggaggttggaggtaggattaaatggggtattacagacaaactctatatgcataaaacaatttgttgttgttgttttgccagaggggaagaaatgaaactttgctttgtgatttgtgccaaaattgcctatctctgcacagaaatacaggttcaaaatgcacaccaataaaatcctgtgtcatcagtagaattcctaatagcttagaattgagagttggcaaactatggcctctggccaaatctagctcccagattgtttttgtctgacccacagaataaaaatgatctttacatttttaaatggctatttttaaaaagaagatgacgatgatgtgagattttatgtggcccacagaggtgaaaatacttgcatctggttctttactggaaaagtttgcagacccttgacttagaacatggttgtggcctgtattagttagggttccacagagaaacagaaccaatagagtgagtgtatgtggggggtgggaggtggtatatgtatgtgtgttgggagcaggggagattataaggaattggctcaagtgattatataggctgacaagtcccgagatctgcattgggcaagctggagacccaggagagtatattttgtagttccagtcccaaagcttggcaagcttaacattcaggaaaagcttctgcctcgtttcaggtctgaaggcaggagaagctgatgtcacagctgatgttcccccctactattggtgcattcagcctttttgttctgttcaggcctttagttgatcacatggggctcacatacattagggagggggttcttctctcactctcccaattcaagtgttacgcagagacaccctcacagacctacccagaataatgtttgacccaatgtctaggcaccttgtggaccagtcaagttgacaatcacatggcccttttatccctaaaaacctgtaaatagatcctctaggagcaactcaccttcatcaaagttgagtaatcaagaagaaactagcacggtatctctacaaacatacaaaaaaggaagaaaggagtggtaataaatagcaggtgagaccatttatcagaaaaaaatgtagctctgaaataaagtagtatgcaaatattttttcatgaaaaaaaaattttttttttttttttttgagatgaagtctcactctgctgcccaggctggagtgcagtggcactatctctgctcgttgcaacctccgcctcctgagttcaagcgattttcctgcctcagcctcccaagtagctgggattaaaggcatgtgccaccacacccatctaatttttttatttttagtagagatggggttttaccatgttggccaggctggtctcaaactcctaacctcaggtgatcctcccaccttggcctcccaaagtgttgggattgcaggcgtgagccaccacacccagcctttttcatgaattttctaaaaacttaaagcaagaactttttgcttctgtgacagattagcttacatcctaccacctcaccaagaagagctataaagctggattttaaaaataatactatatgaataccacttacagtattcatctgtaagaagtcattggagtgacaacaaggaaaccaggactttactgaccaagatcctaaagagaagaatagtacagagcagtgagcccaacatttagtgccacttttcctctttaggcatttgcagatatgaaagcagaaaaacctcagaatctaggaagttgaacatggtattccacagttttacaaggctggagagagaaaaatggaagtgcattgcctatcaagttgcaggatctttagtaaataattcaaactttcagttgaacccattgaaagcctacattttaggagtaagggtgagtaagaaacatgagtcctcagtgactgaaacccagtctccaagtatttcaatctttgatctatctttactctgattgcctaccaaaagtaaaagtaaatactctgtggaggaagatattatccagagtcttaaaattatctaaagtttgtatacacgatatgtggcatgcagtaaaaaattaccaggcatatcagcaaacacaaccaaatcattgaaaaccaagagaaaaattcaacagcaaaaacaaaatcaaaaaagggaaaataaaaaccaggcagtcagtagaaacagacccgcaggagttcgcagtatgaaatttttatgaatggactttaatcgtgtgatttgttcaagaaagtagacatatgaaggatttcagcaaacaactggaatctatacaaaactgtcaaatagaatttccaggagcaaaaaattaaataactaaaagactcaatagaacattttaaaaacagattggagagaaacaaagaaaaggactgcatatgttaaaaaaaaattttttagactaaagtgtagtcagggattaaaaagaatagaaaatatagaaaggaggatctaagacatagaggatgtgatgaaaagttctaacatacaaataattggtttcccaaaaggcaaggagagagatggtggcagtgcaatatttgaagagtgtttatggcccagaatttttccaaacctatgagaaacatttagccacaaattcaagaaataccacaaaccctaaaagtgaaataattaatagaaatcagaccccacttagacaaatcctagaaaagcggccagaaaccaaccaacataaaattctaaaagcaaccagagaagaaagacacattacgttcaaaggcatgaaacttcaactgaaaactgacctcccaacagaaaaattaaaaacggaattcagaagaaaaagaatgtcctaaaagtgctatagtaaaataactgccaacttacagtgttatttacagcaaaaaatgccttccagaaatgaaggcaaaaattcagaatgtggaaaactgcaggacaacctacattctttttttttttttttttttttttttttgagacagagtctcattctgtcacccaggctgcagtgcagtgacgcaatctcagctcactgcaaactccacctaccgggttcaagcaattatcctgcctcagcctcctgagtagctgggactacaggcacatgccaccacgtctggctaatttttttttatttttagtagagacggggtttcactgtgttacctaggatggcctcgatctcctgacctcgtgatccacccgtctcagcctcccaaagtgctgggattacaggtgtgagccaccgtgcccagccaggacaacctgcattcttcaagtcaaaagaaaaataaaggtgttgcaggggaacctataaataaaatagacttaaaagatgtatcgggccaggcatgctggtgcatgcctgtaatcacagtaatttgggaggccacagcgggcagatggcttgagcccaggaatcttgagaccagcttgggcaacatgccaagaccccatctgtacaaaaaaatttaaaaaataaaaaaataaaaaattagctggatactaattttttttagctgtaatcccagctactagggaggctgaagtgggaggattgcttgagcctaggaggtggaggttgtaataagctgagatcacaccactgcactccagcctgggtgacagagtgaaaccctgtctcaaaaaaaacatatatccagccattaagctgggttttcttattggtatcatgattcagtttaataaacaagttttgtgatatgttgaagtaactggaaacttgaactattactatttatgtgatattaggaaatttgtgaaatttgtagtatgatgctatcgtggttatattttaaaagagagatccttattctttagagatacatacagtgatatgtatggataacattgtatgatgtctagtatttgttcccgaatagtacaggaggaggggataagagaacaggcgtataggccaggcgtggtggctcacacctgtaatcctagcactttgggaggccgaggtgggcttatcatctgaggtcaggagtttgagaccagcctgaccaacatggtgaaaccccatctctactaaaaagacaaaaaattagccgggcgtgatggcgcacatctgtaatcccagctactggggaggctgagacaggagaatcgcttgaacccgggaggcagaagttgcagtgagttgagaatgtgccattgtactctagcctgggcaacaagtgcaaaactctgtctgaaaaaaaaaaaaagagagagagaacaggcgtacaagtgaaacaagattgatgttgaagtaatcattgttgaaattaggtagtggggctcatgggaattcatttttattttccttttctgtatatgcttgaaattacatgctattttaaagaaaaaatgacataaagacatttttggagaaaaaaaaaagctattaccaacagaaatgggcaattcttaagccaagtagagaatgttcacagaaccaagtcactgtaggttgtaagggaaaagcaaaggtagcaggagaattcagagtacttgatatccaaattcagtgagcaaaagggattattataataagacaggcatttttgggtagatgatgttgagtaatcaaatttgacaatacctgtctgaacacctcgaattcttggtcctaaaagtcatgcatgtcttaaaactatctttcagcttactactttgtatgagaacttaagtatacacaaccagcagttagaagaagaggttaaagatctagcagacaagaaagaatcagttgcacattgggaagcccaaatcacagaaataattcagtggtgagtgctcttttaaacgtttttttgtggatgattgtgagtatgtggccaagttggtatgaattccaggtggctactaataatggtttttatctcatttgtcagatgtgataaataagttactctgaaaagcacagttttattactgatctgttgtgttctactgtgttttctgttacattcctctgttccctaactctaacaaatgtcccataccagcatttaacacagcttcattgaaatctgattattattactttctaagaaaatgttaccaccttcagagtcaaagttggaattcatctgctacctatggatgtttctttctaagaccaaaagtcctgtatttgtgagtattttaagaaatggaaggcctgcaaaaaaaacttagaagctaaagatactgtactgttatcttgtatcatgattataccagattaattcacacatggcatttttaaaaccttaaatggttacattttagttttatcagctctttcttaagctcttgggatttagtttggaatattcatcttagtaaccttcatattcatttattaaacgattattctggtgctggtaaaaaaatttcatattttaataatacatggggaaagtagaatctaatgaagactgtatttccaagtaaaaataggtaacttaactttttatatttatttaacttttgaaatccattttggcaaatggtaggtgtttaatttatatcaaaacaaatacaggttgagcattcctaatctgaaaatctgaaatctgaaatgcttcaaaacgtgaaactttatgagtgctgacgtgacaccacaagtagaaaattttagacatgactttgtgatgggtcacagtcaaaatgttgtttcatacacaagaaattattataaaacattgtaaaaagttaaccttcaggctatgtttataagatgtatataaaacacaaattttgtgttttgtcttgggtcccatccccaagataatctcattatgtatattcaggtattccaaaatttaaaaaaaaaacctgaaatccaaaatacttttggtctcaagcatttcatgtaaaggatacccagcctatagtttcatcatatatttatagatcagtcatttgtagggaattttaattcctgtatgcatattttggttcaaatgtttttccattaagagctcttaatgcttataatgtttctattcagtgcatataaagggaatatgcagattgtggaaatttatttgggttctagacagtacagttattggttcattaatttatatctatatcatcaagtctgcatttctgaagcaaaatccattttaatgtttaaccaagtttataatatcaaaaattatgacttgatatttgtgattccatttttatgttatcaaatatatatgtaaggaggagctgaaaatgacttcagaagacagagtcaaaacctgtgatactagactactgattttttcaagtgtctggcatgatgagttcagctggaatgggaagtggtgctagtaatggaaggaagctttcaatgtgggctttgtagaaagggttaatagaaagggtgaagatgaaagttttatatgatgccacaaaacactcactatacacttttcacattcaaacgaaatatgcagaaatcagaaatacgaggaagtcactttgcatgaaagctgttattaaccctactttttatttagaaatggagtaatagatagcagattggcaaatacccaaagggaaaaagtaaaatatatattccctgttcaactttcttaccacttcaaagttaactctgtgagatacaatatccaagtttataaaggtcagaagactgagttattttcattttttgagtttagtttacagattgagtattccttattcaaaatgcttgggaccggaagtattttggatttcttttggattttgggaagtttgcgttatacttaacagttcagcatccctaatccaaaaatttaagcatcttgtcagtactcaaaaagttccagatttggaggcatttcagattttggattttcagattaggaatactcaaccttcttttgaaaaatgaggtaatgctcaaacaagattataggacctcatgacatatagcactttaaatgtttcctgggacaaatgaacagttttaatacaaaacaaacactgcagtatataaaaccttttacgaagtcacttctaatggctcttgaactccacctcctctctcttttgctatgaaatatccctttcatcagaaactcttttagagcaaggacatcttctcaccgccgttagagtaggaaccttccttctcgccattggctcatcagaggacttcacgttttctctttgaaataatattacaaagagaggttagattaataggctagtccataagatttattttttaaatgtgttttcctcacataaggcattcttctggtacaataagagatacagagatctataaatgtagtacttttctttaagtaacttgtaactaaacatttaaagtttaaaaactattttgaccagagctggagataacttatgagacttaaatataaatgccttacatattgaatagatactgactttttaaaaataagaatgtagtgttgagaaaattatctcagactagttgctcaagaagggtgggaataatcagttaaactagactgtgtgttctgaaaaccctgagtttagtaaaatatcctacacctagtttgaccaaattggagaatttttgtaaaagaatagtaggaaataagagtaataaagttactgcaacacagttgtcatgaatactaggtaagaattttaccttcacttatttgtaagatggagaaggtttttcaaaggtaatggtgttaattaaaatgatgattaggcaaatagctcttaacagtaatgttcagaatgaagtagaaggtaatgttggaaataaagtgaacaaatgcaggagacattgtgaaagaaaactctataggacttaatactatttacaaatgaagggcaagagatgaggagaaattagtattcctgaattgtgagttaaggaggttaagaaaatgatggcatcattgaagtaggaaagttaagaggggtaaccacccttggggaagatgatacaatcaattttagctgttattttattttgtttgttggtaagactgaggtgatcctgagacatcttagtagagatttctcatgcttttgaaaaactaacataaagattaggattagaaatgtaaatttgggaattaaattccttgtgaataaggccagtgaagtggttgagatctttttaaggagacaagaaagaaggaggatggtaagggctatattataaaagctagatgaaacagctctgtagaggagaaccaggagaagggtttaataattacaaagcgtttcagtaatgaaacctttgtctctctttatttaaatccactcacatatttgaaacattcctcattcagtaatgctcatttgtgtatagtaatagcttctattgattaaaacataagagtgttctggtcattaggctggaaattcacatgtattcttatttagttattacaccggtcctgtgagatagatatttttactatccccattttataagtgggataacaaagagaagtaatttgcccaaagttacacagctggtaagcaccagagctaggatttgaaaccaggtctatatgacttaagaatcaaagttcctaattactatatatgccccaacttttcaggaactgtcccttatttgtcttctcaatatgcccaatgcaatagtatttaataagtattaactaattgatcatttgagagaacttggaagggaaggattaaatgtgccaagagaacacatagatctaagttggccttctgtagttgagttttaacagattagcttcagcaaaatagttgaggcaggaattagacttcgggaagtatagagtagtgaatggagggtttaatactagagcaattacacgtatggagtgtaacaatgaaagagggaaaatgggatgtttggggatttgtcagtgaggaggacagggaacttttggatttggtagagtttgtacatgtttaaaggaaccaatggaaataatgaaattgaaaatatgaggtgtagtagggagggtgattatgtatagtaataataactgttattaagaaatatttgaatgatttagccaaataaaagataagacacctacctctaaaactggttttaaaagttaagagaatgaatatgaataaacttaaccaaatggcctacaagcaaggagcaagagatagtgttggggccaggtgcggtggctcacgcctgtaatcccagcactttgggaggctgaggcgggtggatcacctgaggtcaggagttcaagaccagcctggccaacgtggctaagcctcatctctactaaaaatacaaaaattagccaggcgtggtggcatgtgccagtaatcccagctactagggaggctgaggtaggagaattgcttgaacccaggagacggaagttgcagtgagctgagattgtgccactgtactttagcatgggcaacggagcaagactctctcaaaaaaataaataaataagagagaaagatagtggtggggttggagaaagtaagatttttttttaatgaggtggaaaaatagacaaatagcaatgattatgagaaggagttgtgtgagacttagagtacagtggaacttaaatggcatgagttgccctccaaaccagtaattctctatagccaagaaaaagagaaataggtttaatcaaaagttaggaattagtggaagactgcagttgtaaggtgttcaacatgtaaataaatgtgttcaacatgtaatgtgttcaacatgtaaataaaaagcaaagttagaaaaaagagattgtcatataaaattccaaataacttaaagtcagtttacaagaggttgatttccaaagttaattaaacacattggacttcacagtttcttggaaatgtgcataaactaagatctctgagccatggtagatactaaaccagcactaggtgagacctgttagcctgggcacttaaaggataatacagttttctttattgttactatataagtatcttttttgtattctaaaaaagataatcttccttcatcccaatttattctctacactatagatcaggtaattaaatgaaaagattacagtcacttgtagtcaaagaattttagaaggacacaacccttgctacacaaacattcttaaaataatttccaaaaccatttttctttaacaggcaataaaaatgtgtacatgtagatagagcctaggaatgtgtaactgtcccttaccatggttttattgcatctccatattttcttttgcttatactccaaagacaatctcccatctaagaggagagagcaacaagcctcttttaaagggcctctttaagatatatataaatttgactcctcaggagtttacattctaagagatactaaagcagagctcaggagttaaacatgtctgctgtatgcatcggatacatgctgatttacctgaaatatactttcctcatagcttcagtgacctggattttatctgaagacaaccagcctgcacaaagacaaattgtcttccccaaagtgtgtttagaatacacttgtgagcattgcaaatttcaactccattttttttgtttgtgcagtatggctttctgtataccagtggttttcattcttcctgagaataggaccttcttttttagattcttgtagatatgctggactcctcccctcaccttctccccacttgagggaagtgtaagaaatgcagacgttttcttgagaaattctaaaatgtggaatttgtcttactaaatataatttgaaaactttctgtctaaaattataattgtatcgttagctagatagccttaagacagtaagtagaaattaggttttggtagactttaatcttccctctttgttattttattgatcatttcagaaaacagaagagcttaattacaatataaccctgatttttgcagaatatcctacattaaactttctaaatttaatatacacttcagttttaagaatggtatgttgtttttatgatataaaatggcagaatccaattgagaaatcttattatttagaaaacctcacacatttgtgcatctgtgttaattgttagatttaaagagtgttaattctgtgtttcaagggtgaagttttaataatgtatcagctatgagtaacttggacttttgtaaacatcacctgctctaccatgtacataaaagaacagttccataaacctcttcccagttgttgacaggtagtatactatggtagaccttttcaaagaaattatttaagactatctttgaatttcctaccacttatttctttaggaagctttaaaataacatatattgcactgaagcttttttgttttacttttgtactttgtctttatatattctagggtcagcgatgaaaaggatgcacgagggtatcttcaggccttagcttctaaaatgactgaagaattggaggcattaagaaattccagcttgggtacacgagcaacagtaagcttctatgattttgcatggaggcttatcatattagaaaaaagagatttaaaaaacactataataaatccaattacttatatcagtttgtttagactttgagcctactaaagagttttttatgagaaaactattagtttgggtcttttccagtttagaaaaacataacacacagctggttaactataataatttaaatgttaaaaataggatggaactaaaaacacagtcattatttcataggatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatggtaagattgaatcatatagtcccactagaataatttctaagtttgtcataattatttggagagaagttacatgtttagtttccattgcttgcttttagaaaaatgatggccaaatatgttacaaagatttgaaaataactagatgcttttaagccttgtagatagtgatgaggttttaatatagccttgttttcctctggcttgtccataaagtagaattaatagtattaaataatattccattatttaattttcctcataaaatttagttgactctcaaattttattaaacctaaaattctctcatgtttaggaatattatatttgtataataatacaacatatggtgagaacaaaatataatcatttgaaaattgtggcctctaccataggtcttttataaatgaaaattctattgatggcaaatttcataatgatataatatcttttaagtataattattgtttttcatgtttctttatgtatttagaaaaagtgtatcccacagtctctgaagcagttagctaatgaacacatttcgtcaattctggtcacaacactagagtgaatcatactctgaatacataaatgattcacagttagactgattataaacatggttcaaaataagccagtttaagtgacatagaggaacaatagaaacttcacatcacaagtgaaactacaaatacgaaaatccattgactgctgagaataccaaaagttccaaaagcctgaaaagaaatgcaggcccatgaattcagtttttaatggtgtgtagtcatagtccttaaactgcaattgtttatctttttaatcaaatcaaaggccagatacatgatacttctgttggattataaacttttggtttataagctttttgctataaataatgcagacattgtatgttttacttaaatgtgcttatgtggcattgaggaggggaaaactttttctggagaaagtgaattgatcccagcataaagagctaatgaatatcattctctgtgttgtaatttgaaataagtaatatcttttctccttatgcctaggacagatgagtttacatattgttcataagtcaggaagatgagccagtttgaaaaattataaacttactcctgtatgtgctccactttcatggttgcctgtaatggtataatatctaacaaagtctaacagaattctaaaattaacctttgattttgtaacatttttaaatttaataatttagttcagggtccacaaatgttttctgtaaaggttcatttagtaaatattttaggctttgattagcttccatcacagcttctcatctctgctattgtagtgtaaaagcagccatagtcaatacttaaatgaatgagattggctgtgttctagtaaaactgttaatctacatgaaagtaggtagcaagctgtatttgttcttcccgcagtaatttatagtcccctaatttaccatgcctgacatttaaaccaagtaagtttggctacatccaagatggctcactaaccagcaataaaaattaatgacatttttccttttttctccttatttaagtaaactaaaagattcagagaagaagaacttggaactactctcagaaatcgaacagctgataaaggacactgaagagcttagatctgaaaagggtatgggagtgtgtgtttgcctcactcaggacttactgttatgttataaatatattttattacagaagaatcaattcattgcataggtgggagaattgttgacataagcaattctggcactcatttatgaatatacgtgtgtatatatgatgcatgtgcatacacacacatttggaagactgacctctgagtcattttgttttacttaatatgcattgtttaatgatttcatagtaacagaaaaagacactttgccataaatttgacgttttttttcagtgcagtggactacttcatgaataacatttttgtgattggaaaaaaattttattttataatgtactttataatattctcaaatgctatgatatgaggttatcactctgacagtggcaatgtgtgttaacatccagaacttggtaagggtacttgaacaagtatttcctagcactttttatgtgcctagaatgtataaaaattgggggggggggggtgggattcactttcagggtagttgaggaaacaatgtatgaaatagctgaagattaatttagtattaatggagcaattcagtaaggaaaattttggggggcattttaatgtcttcttccagtttgacacttaaattgcttgtcctgtaggatatcccggatttattaccattttcttgaaaactttacttgaacatttttccattcatgtgaaagcttagtcagagtgcttcatagctgtattacatgaacttcttaaactttccttaatgtggatgttaagaaagtgaagatttaataaaaagaaattcagatatttttaaaataaagggatatcttatatacatttatttgaaattgattttcctgacaaaggccatcactgaatactgaactcgttaatgggctttttattaggtctaagtgctttcctatcatttctcagccatgcaacacagtgagataaaactggtggagtctctgcatctgcatgtaaaatgatagagaacagagagtaatcacataaagaagctaacaagaaaaagcctttacaaatagtcgatgctcaataaattcttgtggattgaatttcttaattaacaacaaaaggaaggagcccagaaaaagtgaatagtaattcagattaggagcacaagccatcatgccaaaatgaaaatcaagctaggttttaattaatggaaatttgaaagaagatacattatttagtgaggaaaagaaaaagaattcgtaagacatggacaactcgtggccctaatggcaaataggagagagactagtgcagaatatgacttgcacgccagatgacattgattgcatcatttttagaatagacctaaacttgaaagagacttaagtttatcactgaaggcatgtttaccacagctttttaatttggattttgaatattgcagaacaaaattttattgtataacataatgtatactactacttcagtaatataatgtgatatttacagtatgagggcaaggatgtttttaatgcttcatttactattatttccccaagtctctaggacagtgtctggcacactctcaatatttgaatgaatttctgaacatactgccttacctgataactgtgttatattattagatagtaatatgaaaaacacaaatcagctgatgtcaattcctaaggatatggaagtgaaaaatgtgggattggctgttttctggtttttttctacctagtatttttatttgtatgttgtaagaattacttgggaaattgtgcatttaaagttaatgccatagtcaagagatatgtatgaatttttaaaaattcatctgagaaaaactggggtttggagtcttcatcctgtcaataaaaaaatacctgaaatcagattggcagtttttttgtaattaagtgtatttgtttcatcactgcattaatttcttataaaggattattcttattagtgcatactctgtgctttgataagagtatttcaaaacataagcctgtttggtgttgaattagcttagaaaaatcagatataaacagactcctatttttaaattctctcaagcctaccaaaagatttaatgtggttttttattatttactatacacaaaaagaaagaaactcagtaacataaataagcatttcatggaaactgatgtaattgaactattaagtgatattctaggaaacactagtgtattttagttttgtttaaatgtagagttaattatagtgatcaactttgaaatacagtagtttgtgaactgcttttagtagattcagacagggaaggttatccattaaaatcaattttaattgttgtagccttaaaaaaagttgctgctgtcttctaggtatagagcaccaagactcacagcattctttcttggcatttttgaatacgcctaccgatgctctggatcaatttgaagtaagtattaaacatgtcacatatcctctggggtcaatttaaaattcactttgtaatttaaagttcacttataataaaaccattttattgcttcccacatcagaggacctagaatcttaaataaacaaaaacatattagcagaggaatatgttctgcattcttatggagactataatcccacctctgtttaacaaaacatctaagaaagatttaatcatgagagtcattataagatttaaaagcaatttcatctcccttaagaaacattaagagcagaacaaatcccaacttttgaaataatttgacaatttttttattctccaaagcatagtgccacaataaaaagtgagaaaatgtcaaagctgacaataaggtattgctggttcttatttcaaatcaattcatcttttaaaaactatacagtaagaagtgcttttgttaaaaggtgttacatagactctgttaggcatatcacacagtaatgaaattgtgattatgtaactcttgatcattcgttggtatttaaattctttgctttaaaaaaatcaacttactgttatcaagtatatttttgtctcagtaaatttaagtgtgattatatctttattgaacaaataataatcatgtagctttgtgcaaggcactgttgtaagtgctggagatatagtagtgaccaaaatagacaaagtccttcccactagaacttacattccagtgggaagaattagaagcctcaggaattccattgcttacttttagttgttacttcaaaagtacttacatttaatttgattattaattatttgtcatgagcttcattttattacattttgggcacagtatgtgaattgtgtttcgttcctttaggaaaaggaaaaataatcactctttaaaaagtaattaatgaatctcttaagtttctcaagaacaatgatagtgactgcttttctcatttatttatttgaattaatgtcatttgcctttcaattgttttacaaagtttttgatttattattcttattaaattgcttcatccatattttctatttttttattgctgtattcgttaaataggattccttttcttcttcctcatcttcactgattgattttttggatgacgtaagtctttgattttcaaaccaatgcatccttcagtaaaaaagatcagtgaattgatttgaagaatttgcctagtaatgcagtcagttttagaaataccacatttgaaaatttatgtgagccaaaatatgcttctttcttatcttaaatataatgaaggatttatcagtattaaacataatgaagtaaaaatttactttcaaaaatgctttgactgttgtagaatcccagtattttcagtctttgtaagaattctaaaactagaatgcttatttaattattttttatatatatataaataattgcttatttttatttttcctggcgatttctattttacttttcccttttcttttcagcactttactgtttaatttctatgttggttaaaaataaacctctggtggtataataaaaaaaaattacttttaattaatttctccagtaggttttattgtatgacaataatagagtactgattttaaaataaatcaatgtttaattgatttatttctaatgctgacagaatttctcttctaatgtgcaaagtgattttagttaacatattcactatatgcactataaattgactgcattatcactttctctcctgaattctatcaatttaataatttagaagttcctgttaaatgtgtatcattcattctctttactacctggcataacattctctctattccacattaaatgcacagtaattcttgtcctaaagcatttattatcctgttgaatagtctttacagaaatggggaaataaaatggattcaaatgcaaatattgtgcatagaattgttttttaaatcgggagattttttaatgttttattctttctgttttgttaggatacttatagtcagaagagtagttagcataatgttctgctaaaggaacttcttgatctagatgtttaaaaattattgaacaaaaaagtgattttgaatatgcttggaatatttatactgaagtttgcacattttcattctaaacaaagtgttttgctattctcaaaacaaataattactctggttaactctatagtgtgataaaaagagaactctcctcgtgtacagtggtattgcatgttataatctgctgctcaggatgttaaaatattcaatatgatatttccatacagatattattcaccttaaaaaagaaagggaaggaagtttgagtaaattattttggttgttctttccactagaaaacctttttatttctaacaaacttctctccatcccttttcctgtcacaaaaaaaaaatgtacatatatttgattgtaaaacctaagagcagtatgtattttggcaaatacatgaggtcttctcagcagacctttcaggaatgcacaccccagccaggtcctcagcttgtttctgctctcacaggcactctgccactgctgccacccacctgtaatgcctgagcaccccgcagccatttcccagtgttacttttcctccaggaatatcctttctcatcttctaccctctattaatgcaacatgagctcagtataaatataaaagtaaattttattgcactgcaagggaactcctagtatgaagtaaaaaggaactgagttcacaagagctgccaaatcttttatttatattccacctcctaaaaggcatgatttcccactcatgtgctttctaagctccattctcccaatttattggttaagtgcataagcaggcacaaatcctgcctgtacaactttctaggtgtatggtttggaagaaattaacctttctacaccctaaatttgctcatcaggcaaatagtaataataatataactaatctcataatgttgtttgaagatttaaggaaacagtgtatgtaatgccgtcagtaataatgcccttattacttttaataagctggttccctccctttctgtattctctttagcttcttttctcatccatcagttcagtttcacttaaatgctttcttagctcttcatcactcagtcatctatccaccaccaatattttatggcacaaactttgtgtttctctttagagtttgtacctatgatctcccttcccagagttatcattcattcatttgatcctcaaagtcatagcagaatgatgttttgaacagcagtattcaatctttgacatacttgagttcagcatccaagatatttcgcataacgctcaagttcttctgtagctctttttctgctaggaacttggattctttttttgtttttgtttttgtttttttttttgagacagagtttcaccctgtcaccaggctggagtgcggtgacacgatctcagctcactgcaacctctgcgtcccaggttcaagcgattctcctgcctcagcctcccaagtagctgggactacaggtgcatgccccccgtgcctagctaatttttgtatttttagtagagacgggctttcaccatgttggccaggctgctcttgaactcctgacctcatgatccgcccgtctcaacctctcaaagtgctgggattacaggcgtgagccaccacgcccggctgcacttggattcttaaggagcaaatcaggtctctgttgttctctgtgccaaatctagttatattgtgcttgatgcttatatgcctgccctttgcggtaaggctctaatgagtagtacacatccttctggacattcttttttgttttctgtctcgttgctatagaggagattatgttgaagacctaaagtttgaattgcagctggaacttgtacgtatagaagggaataagactagtattgactagaattgcaggaatcaagtcctttggtatcaacatattatcattcttctccctctgtctctgggaacccagtgttctcatgctgccctctgatttgttggagctttaccaccagtgcctctcctcctccaaagttaccttctttactcctacttttacccttccacacaggcctctaagtgtagttactttatttaaaacagtacggttttaagttaaaatgttcccatccctattttttcctccacatgttttgcctgttaactcaaaattcaaatgaatgctggaatttttggcacaatgggaagatgttcggagcaacatgctttcctttttaagtcacattgtttggccaatacttgtatgtgtaagagtagctttgaagagaagaaatatatgtaataccagtcattcccttccctctgggaaaatgaaaggaggcaaccaggcagagcagagcatattctcaacactctctgcttctctaacttgggggaatgtaggcatttgggcttttctacatgtagaatcatagagttttgaaggagaaaaccttagaaagtatttaatccagttgttttaaccattacagcactcttctgttattaagagtggataggttactctcccatttttaagagtgacttttttaaagttctcaatctttggggattaggacagtgtggtgatacattgttatgtaaaatattctttaggacagataaagaagggtttgagttaatttatttatttatttatttatttattttgagatggagtctcgctctctcacacaggctggagtgcagtggcgcgatctcagctcactgcaagctccgcctcccgggttcacgccattctcctgcctcagcctcccgagtagctgggaccacaggtgcccaccaccacgcccggctaattttttgtatttttagtagagatggggtttcaccgtgttagccaggatggtcttgatctcctgacttcgtgatctgcccacctcggcctcccaaagtgctgggattacaggcatgagccaccatgcctgactgggtttgagttaattttaaaagaaattgaaactactttgataagtggtctcttgagaaaggcatttccattcaacctattaagaaagcagtagaacagagataccaagatcccttctgctgtagaaattattcccacttctaccctcatcttttccttcaaccgtgcatgcccagtcttggactgtctagtccatgttagccccagcctctttctctaggtaataaacagggtgaggagcaaatggagctcagctgcttagattttcccatttctttcccccatctattcccttcatcccaatagtaacagatccagggatcatcacaccaagcttgtagcaacttcctatactctcttcagttcattttcttttcagccgaacctgaaaaagcttggcttgagagtattatagataatactaattacaatcatataaattagctgcttgctctttatatttgagaaacgtattgtcatatattaaatatgtgctaagtaagttttgaatttgattaaattacaattctacactttgttcatttagtcccagttcacaaaaatagaaattgcccatttgcctggaaaatgagaatgtactcaacttggtttttcagagttttcttactctgatatactgatgaaagagtaaatcaaggattaagctcgggaatataaaggtcagacacagagaaacagagatagtatctatagcccaacagtctggtccccctaatattgttttccattcttatattctggcatataagaaaagcaagtagtctgacaacattggcaggctgagttctggacttgattttaaccttgtataacatcttactaagatgcttcaaaatatttaatttcagtcatggcttctaacttctttaatttatctcttgatttcacatggttttatctcccagcttcttttacattctgttacaatcagttacagaaatccgaggcttttacagaaatctgaggcttggcagcatagtttcagcgatacttgggggaatggtcaattgtatgtgagaattggtaggaaatagagttttaaaacatacattttaaagatttttagtcctatgaccaaaatcagacctagcttctttggcattcctgaaatttgctcattcaattcttgtttttacaatttctatccacatattcaccacaaccctacctgaagattgcatatttcagaaagttacatgcattttttcctcaacttaggcaatatattatgttgaatataattgtatatattacgtattttatcgcatatataatataataatatatttagacaatctaaagagaaagaaccatgattacatagtccatttcttctttggtattttattaaataagacctctaggattaattgaaccttaaaaactattagccaaattatgtactcctgagattatttcttttggtttctgcttgtgtgcataccttcatattcagtcttaaagttttgttggcatgtcatggacctatatatgaaatacatgttttaaagtggtatttggttgcacattaagacaaggtgctggtttatagtgtttgccatgaattcaatttcagtgtttataaaaaccacagtgtgtgtaggtatatatgagagagaaagtgtgtgggtgtgttttcctctaactcaccttttctgttgaaaacataaaaatagttgaaaacgtaacaatattgaaaacataaaaattagacaatttctaagtaaacactttggtaagaaatcattgctgtggtgatagtatcattattagctttaaatggtattggcttagaaaatgtattgtccttcattttcaaagatagtttcgggagacattttaacttgtttttagtatagtgataatatatttattttgagatattcatgctcttttccatggttttagcatactccagactctagtctagaagtagagatagccaaaaaagttttttttttttttatgttaaacattttagcactttttacatgggtggtaatatactgggcataatggatacaaagacaaagcagatgtggaaatggacctcaaagtacttattttataattagaaaaataattatatagttacacactatgcaatgtggaaagcaataaatgccatgagaaatacctaggctaagtactatggacattcagaaggattcattcaatatttattgagaatatttaagtttgaagtcttatgctaagcaaaatacaatacttcctgcccttaagcgtaatatttcctgcccttaagcataatacaatatttcctgccctgacagtctaattggaaagacaaatatataaccagataactataacaccatgtgggaaatatagtaataaaagataaagatcgtatatcatgggaatacaaagaagagagatttctgattgaaccaggaggatccagaaaagcttattaaaggaaataatgcctgagctgggtcttcacagatgagtatgttcagcaaaatcataaaacaactacataagaggagtatattctagacaggcagagcgaacttgcggggggagggagcagggagttacgggattgtggacagagggagatttcaatttagttagaattgtcccttgcttggcaaacaaaaagggtgaggaagggattgagaaatgagtatgaagacatgggcaaaggccagaataagggtctatgtttctcaactttatacttcatattacagagcttaggtttaatcagtcccatatgtaataattattaaaagatttaacagaagagaaaggtgacagcttcattttggacaagttaagtttgagattcctaagggacatccagttggagatgtccagcagacagtcagatatttaatatatgcgtcaggagtttaaggaagaggagtggactggcaacagagatttggaaataatcagagttgaaagtggatgagattccccaaggggcagattgtagcagtgagccaaggacagaaacctggaatctccattgaagaaagggtgaaggaataggactccacaaaagctaagaaagcaatcgttgagaagtatgtggttacttaggaaagtacctgtcagaaaaactagaagagcagataattttaaggaggggaatggtcagtgtgatggtatggcagaggtggttggtcagataggacaaaccagaaatactgacctgagtatcagatcaaagcagaatctgaattgcactgtattagaagttaattgggagtttagaaaatacagacggcatttgtataccatttttcagaaatctggctgaggaagttttgaatcctggctctaccacttaatagttttataaccttaggcaagttgatccatcttctacatctttaaaatgaggatcataattcctaccttatagggtttctgtgagaattaaaataattcatatatgtaaagcactttggaaaacgatctgcatatactctgcacataataaatgttattatgattattaaggaagaagggagatagatgatagctagaggaagagttggagttgatttgtttattgtttggttgtttggttttgggggcaagaaggaatgagagaggttcttcccattaataactgaggaaaagtaactaggtttgaacctgagactttagcctccataatggaaaaacttctttagaactctccgggccttctaatcctggtttactattaactctgcaggacacagtgttcaagttatcttccattccatttcctatggaaagaaagaatatttctggccaggcgcggtggttcacacctgtaatcccagcactttgggaggccgaggcaggcggatcacttaggtcaggagttcgagaccagcctggccaacatggtgaaaccccatctctactaaaaatacaaaaattagccgggcatggtggcgcgcacttgtaatcacagctactcgggagtctgagggaggagaatcacttgaacctgggaggtagaggttgcagtgagccgagatcgcaccactgcatccacctgggtgacagagcaagactctgtctcaaaaaaaaaaaaaaaaaaaaaaaagtacctatttacttacctgccagagttattgtaacactaatactgaatttttggtagtgtttctcattcttgaacttttccttttttcttaaatcttctataactcctgtagacctagtctataagttccctcctctaggtccccaagaaaatcttctctgtccctcctctaggttcccatacaaaccttgtacatatctcagtgatagcatttgtcacattgttgctggcatgatgtcttctctaccagtctgtgaacttccatgtcttgtttatctttcaatcccttgcaaagtcggcttagtatccaacgtattgtgagctcacaacaaatgttaggttgcactgaatgttagaaattgccgaagtagatatggttcatattagtgaagctctactgctggagcatcacaaaaatattttgattgggaggccaaggtgggtggatcacgaggtcaggagatcgagaccatcctggctaacatggtgaaaccccgtctctattaaaaatacaaaaaattagccgggcgtggtggtgggcacctgtaatcccagctactcaggaggctgaggtaggagaatggcatgaacccaggaggtggagcttgcagtgagccaagattgcgccactgcactccagcctgggcgacagagcgagactcccgtctcaaaaaaaaaaaaaaaaaacaaaaaaaaactttttgagataattgttccttttttcctaattacttaattctttaatgttagaaaggtgaaagtccctcttttgactatggctgaagttgagtcaggatggagtattgttcaaataacttttaattttaatttattatcattaattctgaaatcctaacttagcccttgtcatttaaaagaatcatttttgaaaagagtaaaaatttactaggtaaatgtctaacgccaggctagttcattattttattgaatgtttgccagcactaaatcagaaatatctagatcctttttgttctcatttgttccagtctgctactgccaacctttccagaaaagaaattgtctatcacttgatgaaggcttattttgtgggtcactgtacatgggccagtgaaaagtttgtcaaccttagacgtagtccaaacaactgtttctttaccatcctatcctccagtttttcctaaaaatacatgtacattcaacctatccaaaactgtggctttatatgtatgtttatatactttgtctgttaatacaatagtagtccttgagagtcttatgtgtgtaaatatttgtaacatgtcctattctcctttctctgttgaagcgctctccatcctgtactccagctagcaaaggcagacgtgtaagagacttttgcactttatgtacccatcctgaggccttttacccctctctcatccttttgcctgtgattgcggaacctgttaatgtttttgtggtatattattacatctattgcatgctttgtgctgctgctcctgctgttgctgtgctgcttttatgtttttgtttatgttttttttttggctttggccgcaaagctttaggaatgttcatataaatcactataaccaaactactaaaatgatatcttttttagtttgatcaaggggaaaagtgatcctaaagtatgccttctaagtagtcaaagtacatgagctcctaagaatcttttgtaagcaagtatgtagattgtttcttagagattttaattatgtagaaagaaaacttgatcattcatgttgtacaacattcaaaaatgatttggaacaaattatacatcttattgactataatttatgtaaatcagttctagagaaatcttgtttttttttttttaatgtagttcagaggaatctcccaaactaattatctagatctgaggaaataatgttaataataaagcctttctattctaagataattccaagatttaaaaaatatcagtaacattatttatatatgtattattaacaaactgtaaatatcttcctatactaatcctagctctgtgtttctcaacttgaaatgagtcagccactacctctgtgctacaagattctgacatgcccagagatggaatttttctaaaccagccacatcccaacactagtcataaacacacatacatactccctatttgaaaagcgacagggtagctgacagtgttgggattttcatatactatgtaaaatagtaacattcaaaaggaaagtcagtgatggatacaaattcgtaatgttcaccagtcatctccgtggagactgatcaacactttacattccgaattcttagactcggaaagttctagatgagggaattctgtggtttgtggtaggcatgggaagcagtaggggtggcctgctgcttcctgtggtcctgtctttctggtatgttggagggttggttgtaaaataaacatgaataactctaatatagcatatataatattttcggattacagcttaataatgaataagcatttcagatacctgtactatggccagtagaactgcattcaagtgatatctcattaattattgtgtttatgaaagattactagttcaactgattgcttgattattttgaaacttgtagagacttaaaaccattagatatttggatttatcaaatgaatctgaatatatgttgattacattacataacctctagaagggaaaaccaatatgttgtgtgcccagttatattagggtcaaatcaccagcccgtgaattgactaaatttttaactacttgctgttttttcaataaggttataatttaggatttgtttctctcattttattatggattaattatgtctcacttgccttgcagactttctggggccttggacacctagaacattttttgtgaatcttgaaataagaaaaaaattttggagggaaatagctgttataaggtctctccttaattctatgtctttattctatgagatatgaataaactataattaaccataatctattgacttattattacatatgattattttaaacgtagatataataggcttggttatctgctttcctggcctccttcaatttttctttggttaagtatctcacaaaaaaagtcagccactgaaaagtaatagtgcctgtgaagatgcttgaagaattacaaattactcagctgttaaatagaagcatctcagtggtatagtgtagaacctcagtgttccctgggacatcagtgtatttcagtaggacacatgcagttaccattcttaacaatggcctctgttgtaacagtagcataagattttatgttatataccatgtttttagacaagaaaatatgcagtattttaataaatttaaaattaactatgaaatgtcatatgaatgaggtagtattacaaaataatgtttcttgcattcttgtttctagtatgctattaaacctcatttacagtttgaatgattttctttataaatagtattaagtatagtagaagaaaaagtttttattgatagtattgttaatgtccaaatacaaatgatgagagagatttccacagtgctttcattaatagtgagaaacactgaatgtattatttcagattgttcatttagagtttggagcagagattttatagcccacgtatggcttaactttctcttatgttttcttagaatatgtgtaaattctccagactagatattccaatcagtatattgaaaataacttgagaataaattttcttaaagggaaacaaggtgcattatgtataactagtaagcttacccttactggtcacaacctttagtcatttgttaggatttgttctagcgcaataaaatgtatttactgttttccaaatgatatagtacttctgtaatactgtttttgtatcataagttcaattaacagaaataaatatatcactaaaagatttgagtttatacttgttctcaatacaaaatattaaattaccttctactttgttttcaaaatacttctagctagaggataaagaaaattgatagaaactggattttggccaggcatggtagctcacgcctgtaatcccagcactttgggaggccaaggcgggagaatcgcttgagcccagggtttgagaccatcctgggcaacatagggagaccctgcctctacaaaaaaattttttaaaaattagccaggcatagtggcacatgcctgtgttcacagctactctagaggctgaggtaggaggatcagttcggctcaagaattcaaggctgtagtgacccgtgattgtgccactgccctacatcccagggcaagagagaaagaccttgtctcaaaaaaaaaaaagaaaagaaaagaaaagaaactgggactttttaacttacagtttatgtttaccaataacaaacaacttgttagatgcaagctagtttttagtaggttgaccatatataatccatatcacatcttggtgttttttactttgaagcaaggtttcttatgagaggggttgttacttgtgcaaatctgtaattatttaggcagtagaaaaggcctgttgatacatattcaagatgagtggttttagttatttttattatttataggaaaaccatgctgtccataatttgaggaattcttgataagtgggtcatctaaaaaccagttctgtgatcctgggcggcggggggacctttttaaatgtactactgtaaaaatacatttgaggatcttttagtagaaaaatcctaacagcttcagggaccattatgaacattttgcattaaaatgttttgcagtatggacagtaccactaatattcagcttttcctctttttttttttaacagagcattaagtaaaatgatactgaaatatagtagatgtttctaatgactgttcgtcagagtaacaccttaaagtatgtttacttaggaaaagaaaattagctaacaaaaaaaaattgcatttacttaaagatatttcttatattgaatttataatatctctgctacttatgtatgtttattagcttttgctgcattattatacttaatgctatagtattttagcacataaaaaatgacaaaaagaatattttaacttccatggctaaaatattaataatgattatgtttgtttttaaggttttaaaatactttgtaataaaataactaatggtattaatcagttgctttgctgctatactatatcagagtcattgccaattcataattaaactgaatcataggctgtctttaaatgccagcatgtattcattgaatattctgaaagtttaatagaattaattgctttttagtggatagaataagccattaattataaatgcattggtaggcatttaattgtggttaaaattagtaacttcctgaaaattccagtctggttggcgataattaaaacttgaataaagaaaataagtgatttgtggtgtaacacttttgagatattgtttacactggcggtaaccgagaaatgaaatacttaaatctattaatgttattagcattagtttcatttaaaaggcctggacatttttttttatatttgaaatggtttttgccctgagtttattcacctttaccaagctttgtcctttgtctttaaaagaaacacactttgaaagtaaagtggtaatttttaaattttaattattatattcataggtttttaaaattaaagatatgactatcactataaatggcatagttcaactttttaatatgcctaataccatctcaaaatatttcagtattttcacttatttttaatattttttataggaaaaattacttgattttgtttaaactctgaaattgatttttatttaagagtatatagttctaaaaagctagtatggtaaatttcattattctactttattacaattaaatattttcatttaaattaaatattttctatttctgaataaccaccttttacctcattcagcaaagaaaatcacttttaaatttgtccatatccatattctctttcatttttattgttggagaaaaactagttaggagaataagacttgacagaggagccaagaggtgtgtgttaaaagcctcaagaaaagagttactaatttgtgtagttgcaaattaaattgatagtgtatttttcctttctccaatatcccactgtcataataccacattttcataggatcagcaaacatgctggtaaatgttttaacaaccagctctgggactagagaaagccctgctttttaggttcactgatttcatgatataaccttccattagtccatatactgacaaaatggcttaaggcagtattttctaattttaatgcgagaaagtagaagacagtatgcccaacttctgtcagcatgtgtttaaacagctcaaagagcagacctgctgtaaaatttcaaccagtgctattgcaaacagcaaatacttggcctttcccatttttaaagagtttttgaaataatcaaacccagataatacaaagccgttatatcagctattcacatatacacagcattacctttcacacaggaacttcgcattttgtgtctttctgtcaagctgtggggctaaataaagccttttgcaacaggtcagaaactttacaattttcttaagatggctcagtttcttacacatagaaagtcccctacttagataccttaaaacttcttgagatgacatttcagtcagttttaagttcttactggtataaaatgtatcaattctgctttgcttctcagttccattttaactaaagcccctctccatggacacctaattcttgcaatgtgtataatcttatgaaaactaggaggaggagatttttagaaactaaaagacatttctgccatattcccaactcagagtcatatttcatatttataatctaaactgattactttctccatggctgtccctgaataaaattgtaaactgggccaaaatgtgtcttgagtcccattttcttctactttttcttttcctggtcaaaatttactatcaggaaaggaaataatataacttagcctccttgattattaaattactttgagtaaattactctgctgtggagatgcctctggtaggacaaaaatagtgctgaatttggacttgagttgggatacaggcctggctctccaacttcacaaggcatactagtttcatgaaatcagccacatcacatgtacagagctgatattcagctggtaagctttagttcagtggcccagttttttaaatattgagtatcctagcagttggtaagtggttgctgctccaagacccctaatgccttcacccttcttctccctactcctcccaaatccagtagctgaaagtttatggcctggtggtggctttgtggttaccagaatacctttccatgcccaccacccaggaaggccgtaggtgggcaccaatggagggcacgatagtgtttcccagcctgctagcctattcttcccatacacttgccagatgttttaaattctccacattgaacagaagttgactgtttttaacatatgcaacatatcatacattgctgatagtattctacattaattatcaataggaaaatatccccaacttgagaaaacaatttgtgcccttagagattgaagccacatgcccagagttctgttgagctaaaaacaaatctatgaagttaatttctaggggaaccttcttttccaagtgtttctactctcaattatttatcattcattcaaagtgaaattttgcttttcacttagttttgagtacaagggcattgtattttaattcattgttttaatagttctactttgccagcagtctcaactgcacctgactctttcagcagtggcatttctaagggatacgttatcatcatgtcttccctctaaaatatagccatagtaagaacaaaggaaaataattataagttcatgtttaaattcttaaactgatggtgtttttatgatttgtgatttctgatctaaacattgttttgctgtacaacatattcaaagtaagttcctgaaccacttttccaaattaccttcattgtcctttcattttaaaaactcaatcctagtaactctgaaacttgccatacagactagtatggttcaatcagtatggttcataagatcttttatgctaaattttaacccaaagcatttttaatttctaaaaatacttggtgtaaaaggatgcgactgaatataagtgctggtttttctactgatgcaaaataaagggaagacttactttagtgtcctgcacaaaactgataggttaggttttttttactttcagttaatgagtagtaaaagaccaaacttcattcttatcaaggacaaagttatctttaatctgccgtatgtatctctattaagtacccggcatttatttcacatgtatgattccttttgtgaaataaaaagttccatgtggaataccaacatagaatgtgcagtaggaccagggctcaaagtaacagatcaacagtgaagatcagggaggagcctttggttaactattctgtcaatccttgtttacattaaaggtagtggttatgcttttgtataatgatgtatccctaacgtgaatattcaaactaaagtttgttatcctcctttctcaagaaatgttgtcataatcatgccttacagaaatttgctaagcctgcacattgttgaaaagtgattttttgggtttttatttttcccgacttattttcctagactgatcccgttgagaacacatatgtatggaacccgagcgtcaagtttcacatccagtcacggtccacatctccttccacatctagtgaagctgagccagttaaggtgccttattggagcatccctgctccccaacttttcacttgtgtcagaaaagagggaattgaataaaacaagtctgtctctctcctcttaaccaaatatgtaataagttacagtctattggagatcattacatttaactgataatgtaggtagaagtaaaaaactaaagagcacattgtcctcaaatagtcaatctgaaatagacaaaactaactagaaagatagtctttattttaattagagaaccatgtagaacagaagattaattatgtaaatttttgaattattagaaactctaggcaaatggcagtgcaggtgccattctcatattttaattcttctaataaatgtaataggtcatgatataactaacctgttacatcataaatagagctgaaaaataaaatagccacttctggcaactgaatagttcattctaactgctaaattggtaacagtcaactaaatcctgacatttaatagtgcaaaaaaaactgtgttgtgtttacacttcatgtcaatcaatggttttaaatagccaataggccaattttcttaacagagatcatttcttccacaagtcaaaagaatgctgtacctcagtccataccatcctaccttaagatcagctctggttcttcattcagcatcaggattcagacaaagctcctttgctttccttttcttaaatctccagagctgtgtctagcattccaatagaagcagatagtccaatctgaagagttgtctgaagtgaagtgtgaggttgtagtcaggttctgacttgatttttccaactctgtgacagactcccccaaattgtttaagttaatgagaccctcttgtgtttttagttataattgttttaatattttgagattatacatttttgttttaatgataaaatatttcaagcattcagagaatataaacacccatgtaaatatcacccacagattaaacagatacgaaaattttgcttgtttttcaggtttttattcaaaaatatttcagaaacagttgaaacatcctcgtgtataccgttccccactcttctttcccagacatatctaaatatcctgaagctgatgtgcatcttccctttcttggttttagatgttcatttcatttgtatccacaaatgatacatagtagtgcttattatgtgtttataatttacataaatattacctgtatccttctgtaatttttttcattcagaagtctgcttttcaggtttattcctacagatatgtgttcatttagttcattcattataactgtggcatataccacaactacttatccattctcctgcagttggatatttaggttgtttccaatttttcattattatcagtgctgaaattaatatcctaatatctgtttttgcaaatgtacagagtttgtttggcatgtatacttagtggaattactgagttgtatgttatatgcattttcaagtttaactggatcttgccaaattgttttccacagtggttggaccaattttcactcccccagcagtgtgtgtgagttccccatttccccacatcctcacctcacagtcacacattaacttttgccagcttgatgggtattaagtgtcatttttgtattacatctgttttctagtgttattcagcatctttttgtatgtttattgaccattgatgatttgcctgtttgtgtcctttgttgttctattgaatcatttttcttatagctttttgtgttcattatatactctagatactaattctttgctagctatatgcattgcaaatattttctcccagtctgtggcttattttaaaattttatttgtggtgtctttttgtcttgcaaaagttttgattttaaaatagtcagatttatcagtctttttctttatgacttctgctttttatgtctttttaaaacagttctctatgcagagattataaagattttcttctatattttcttctaaaagtttttaaattttgcttttacttgtttaggaccttaatcaaactgatatatattgttatgtataatgggaaatgggcttctaatgtctttttcccatgtgaacaagtgaccctgctatatttccccccatcgatttgtaatggctatttctgctttatatgcatggatctgtttggatactctcaattcttttccattgttcttttggtttttcctgcattggcagtaaattgtcttaattacaattactttcactctaaaataattcctgatacctggtatggtgagccatcccacataccttcttccttttcttcttgaccttttagtttttcatattacttttaaggtcagcttgtcaaatttcacatggggcttttgattggaattgcattaatgtatagatctatttgaggagaattgacatctttcatgatactgggtattccatctatgaacatggtatacatattagggattctcttatatccttcaataaagtttcattattttcagtgtatttcatattgcttgttagatttgttcctaggtaccttaaattttttgttgctgtggtgactgggattctttttaaatacattttcttactgtgcattgccttgtctttataaactctagatcttgtatccagcacccttgcttaattttttttaattctaataacctttggactttctatgtaaatttgacgactttgtttcctattgttttttattaacttttgtatagattttcagtgttcctctcttttatctttcatatgtatcttttcaaatgttaaattataagtttggtttaaaactttttcaagctatttaaaagtaaataaaatctaaattagagctaaactcacaaacagaaaactctgagaaactcaactgaattttgttttaaggctgtagtgcttataaaatattctgtttttggaggttgtatggtaacaaagatagattgttgtatagtaacaacaaagatgaggttgtataataacagcaaagaaaggaccatccatttttcttataatattttaaaatattctgttctttatacaaagactagcgttttccttttatttttttgcttggcatcctgaaaggaagttactttccatgtcttttttttttttttttttctcactactttgctgattaagcagtggctcttttttccccataataacatccagtggaatgattggttctttgcattcaaagaaataatattacaataaaaccccataaaagaagaccatattttacatagctacctaagaaagatatggtatgtgactaaatttgtattaaagtcagaattccaataatattaaataattacaataaaattaaataattcccttctttggaaattaatttctgcacaaaaatcccagtgtcagtctctgtctatgtattcacatccagagctgtgttctatatatgtaatatatgttctatgtatgaaagttgagtagttaaaagaatcttctaaatattttattataaatcattttgagatactttttagaatatggcaaattcagatgaatgtaaaaattaatatcctcatatttatgtaggccacatgctatggctttttttatttgaatcatttgatccaaatgatttatttttatatttccagactaaagtaacttactaattgaacaaatatttcattcgtagatattgcaggcagagatttaaattatcaacactatgagaattttagctttattgaggttttctttattattaattagtagaactttttgccttattgatgttttgttttatttattttggcttctttctagttatatttgaaattaatggagtgtttcatgacatttatttccttttttgctcctgggttcagactgtagactccactccactttcagttcacacaccaaccttaaggaaaaaaggatgtcctggttcaactggctttccacctaaggtactcaatctagttataagcatagtgtgttccaaaaaaaatgaattttatctgctctatgcatttgctgtgatttttttgatattatttcttcaaatttacaaacagaaaaacttataaaataaattatgtgtgaatgcaaataatcaccaataggaaaggtagggagagcgtacagcactttttcatcttcttaaattcaatgttttgaagtctgttataataagaagtagcacttcctctaagcagtatatgcctcagtaaggcattaagttgaggccacttgtggaagaatctgagactgaaatcaataaaccagtgagaaagaaaaacgtttagtgaaaaattcaggtggacttttttttcccattctatttgacataaatatgactgaagtattacatatggtagaatgagaagatttagttgcttgtctcaagctcccacaaagaaattccagaaattggaaaactgaatgatctgcctctccagaacataaaccttggataaaccacaaaatgagagagagaggtcaatagacctgaaaaaatatacaaaaaatataactgatatagaagaaagacaaactgaaataacctgtgcccagataaagcaaaattttaaggccagatagaacatgaatttaaaataaacataaaaaatatccttaaagagataagaagtatgttggtaacatgaggcaggataaggtagttaggaagaaaaataaattgggaatacttgacatgaaaacataactgctgaaataactaaatagatgactttaatagtagaaggggtaaaatggatatcacagaaaaacaagttagtaggagggaagataagatgaaaaacaggaaagttaagatatatgacaacccaaccaaaagaaaacactctagtaaactaaaggtttataaataaaaggaaaaatattgggcattcaggcaaaaaatatgtcacttaaaggggaaagaaaatgagattatcatcagattttttcatagtaacagtatgctaaaaacaacagcagtgaaataacacatttaagatacccaaggaaagtacaagtgaaagatttttaaggatttaatattttaaggatagtaaagcatactccaaaaatgaaggccacagaaaactattaagaacatgcaagagctcaggaaatactgttcccataccccttctcaagcaatgtgctagagaacaagcttcagacaaccaaaatgataagacaccaagtactttgagaggcaagagtgaagcaggagtctagagtaaattagagaattgattcaaagtccacataaagtgttataccagttctgaaaaccagacaactaccccaactcagcaatacgttaattttgtgaagtaattaaaccaaagagatcacaaatttaagggcaccaaccaggctcactggttggtgagagaaagaagtgcaaaaccacaaatagttgagatttggcaaaagtccatgtactgaatggcgagacttcaaatcctttcctctgcttagctcccagaatactgactcttgggactgtagcctcctcctccccactctgcttggagaggatatcagtggatcctcgggtccactgaatggcccagaaaagacctatcgataatgtcatttggggctccctaatgagatggctaggtcctttcttaacaagcacatcatatgtttgctctcatgtggacacatagatagacacaaaatctctttagcttttttactgactcttaaaaatgttaagattcccaacagtcagtagacatttcaaaattatctaacaaaggaaaaagatcagggatacgtggtggctcacacctgtaatgccagcattttgggaggcttaggcgggctgattgcttgagcccaggagttcgagacctacctgggcagcatggcaaaaccctgtctatatgaaaaatacaaaaattagccaggcgtggtgatgtgcacctatagtgccagctacttgggggttgaggagggaggatcacttgagcctgggaggtcaaggctgcagtgagctgagatcgcaccactaaactccagcctcagtgacatggtgagaccctgtctcaaagaaaaagataaatatttcctgtttttgttgaaggaaaaagggacaatgcaaaaagcagaaagaaacagagcaatatgagaacaagaagtctcaagttaaagaaaatatgataaatattttttaaattcagtagatgagtcacaagataaatttgagaattctcttagaaaatattgcaaaaaatcaggtagaaattaggaaaagaaaatatgagaaatccatatccaacaagtagaagttcctgaaagggaagacagaaaaaagaaaaggaaggaaattatcaagtaagtaaaagactttttcctgtaactaaaagacatgtttccagattgcacagttccatcagtgcctactagcactagtggatgacaaatacctgtccccagtcacatcattgtgtgagttttcaagataccaaagatagaactttttaaacctttaaggagatttaaaaaagatcacatccacatattcaggaattgaaatgacatacttacccaaggcaaaatgaaaagaatagttagaaggtaaaatgatttcaagctagaatttttgattccctgtcaaatgtcccatcgagttgcaggggggaaaaaattgcattttgagaaattccagatctcaaagaaatttttatcacccatgtgctactttctaaggaaacttaattagttctaccagaacaaggaaggggacaaggaaagagagacatgaggtctatagaagaaggaattgtacacagaccggttaagagaaagactggaataggaaaccagagggcttcagcagggttgtcttcaggtcaatagaaaggggtaagggggctgaaaggcttccagtgtgtttgaccatgtggtaaatagattccaggggattttacagttccttagaagagtctggaagatttagtgatagagatacagaaaggtaaaagtcgagggtgggaggggaactattaattttagaaaaatcatgaggttatacaagtaagatgataaccatagtgtacttcttattagtgaataatgattctctagtcataataacttagacattacatataaattttaagctaaaactactataacaatattgggaaaaatgaaaaaagggagtagatagtgtaaaagggccatatccttctctaccatagcaggaagtgaacagataacgtctcaaatcaaaaaactgtagtataggctttccaccccagctctgccccgcccatatagatacctattacagaaggagggaaatagcttttaaaaaaggagagttaaatgaaattgcctgtaggaagtaggaggaatacttctgattttgtcataagcattgtaataccattttactttttcaaccatgtgtatgtattaatttgattttaaaaatttaaaacagaaaatgtagaaaaattttttgtgactgggaataaatataagatctcaaatcacaagcataaggtgaaaatattcgtgggctttatatcaaaattaaaaatgcttttacagtgaaagcattgttaacagatgatgacagactagtggaagatatctgcaatgtttaccactaataagaggcttatttctaaaatacataagaaactcctgcaactccatatgaaaaagactagaaatcccattgaaagattggcaagtgatataaataattcccagaagacgaaatcctgatggtcaacaagcatgtgaagaaatgtccaacttcattaatcattggagaaatttttaaaatttaattttagaattactatcactttctattcaaaatcaagataaaattaagtaagatgacgtcatggatgtggagaaacaggcagcttcacacgtggatactggaagtataaacgggtacagccattctggagagaacctagacagtgtagagtcatacgtaagctgtatgactcagcaatctcatttcatcagaaaaatctctttcctttacaaaaacctccatacagattcattaggcaacatgatgaagatgtttattactgtattttttatggcagtagggagttggaaataggggaaagattcctaaaatgtaattgatatataacagaaacacatttatataaattaaaaacacatactcagactatctaatttataaagatatatacatgtccaaggtattggatcatcaaggatgaaaaggcaaaataagacaaaataaaactagagtgaggcttctatcaagctgatattattttatgaattaaatattaacttagtttgttgcacctaatatttctccccaagaaataaaatttatttcatgttttttaaaagatagagaagtgaatctataattatctcaaaatagaaattttaaaagggaagaaaaaatatttttaaaaagaaaattaaatttttttttttttttttttgagacgaagtctcgttttgtcgccaggccggagtgcagtggcgtgatctcagctcgctgcagcctctgcctaccaggtttaagcagttctcctgcctcagcctcccgagtagctgggactataggcgcatgccaccatgcccagctaatttttgtatttttaatagagacggggtttcaccatgttggctgggatggtctcgatctctggacctcgtgatccgccctccttggcctcccaaagtgcttgggattacgggcataaggtaccgtgcctggccagaaaatttaatttctttaaaacattttaaaattttttgtaaaaaagaaagggttgtgtgagatactctttgacttgtcatttattagtggtaaaagtttaattatctacagtaaatttttaagctttcaccaagagttgtacttggttctacttggctcttacatcttctattaaaaacattttactttctccaatgtgtagcttaaaatctacaacacagaaaaaatcagagtagaaaagaactctttctaatcaccactttgaaatttgaggttatggttaattctttctactccaaatgatcacataatctaaaattctaattttagtccatactttaatacctttcttactagatttttttcttttcatttttttctcttcttccagctgtccacaaagggaagtattagatatcaaatattgaccaggaggcaggaaacagggatattagaagccaaggaatctagactctaagatcgatcattcctgtgtctttctttatacattttcacaccaaaacaaaaacaaaatcctattgtgtattacctaaagattgatggcctcagaataacgatctttaattatgttatgttatactatccttagtggagattagtgaaatataaacccgttaatctttagtagtggattacacaacctctcctataatttaaccagcacctaccagttggatgatttattacctaaaattaatgctcagccaaaacactgggttgttatatttttccctgctgtcatactcagaattgtgacatcctgaatagatctcttgctggagaggaagtgtatgatatatatatatatatatcatatatgtatatgtgcaattcgggaggtattatggagaattactaataaatttgtcaaccctagagttgtttcattgctactgtttcaggtatgtcttgttactgtttagaagaagaaaaacatgaacctacttagagcagttgattaatttttccttctttgtattcaaagcctctaggactaaccagtaaaataacttcacgtcttttgcattaatgcattttgaacaattgaaaaagttagcactagaaaatttactcataatagtttctcaaagagccaaaaattaaaaagtagtatacaggagaaagagcaaaattttatgattttaatagattccttcatataaggaaataatatctatctttccaaggtggttatttgcatgaaataagatgaattatgtaaagtactggtacagtgtctgtaccctgactgggactcagaagctataggagcagttgcagagttagtaataagatagactgtgttctacttagagtcaaatcctagtgctgctttgaaactgaccaaaagatcgtgaggaacttctagaacacaatgctttgaggttggaccagagctcatgaccactctaaatttgagactctcaccccattctctgactaatgctggtagtcaggtttttctatgtaaaaagataatctacttctatttttttaatttcttttgtagtgtacaaatcatatatcccagttgaaaagaacaagatttatttttaacttgaattttaaagcttcaaatattccctttagttttttgttcatatgttagtgtctactgaaataaatgctacttgataaccttttaaaatcagtattcataatttattagaatatggagtagagttcttagtagtttaaatcaatcacacatttacaagagaaaaaaatagcaaaattcaaataacattgggtacccatggacataaagatggcaacaaaagactctggggactactagagaaggggaaggagggaggggtgccagggctaaaaaattgggtactgtgctcagtacctgggtaatatggatcggtcatgccctaaacttcagcatcatataatatactcaggtaacaaacctgcacgtgtacccacaaatctaaaataagagttgaaattatttttttttgagtacttagtatgtaccaggtactgtttgaaaggctttgtttatattaatactcatttaaccactccgttaggtagatactattatttatcctgttttgtagataaggaaagtgagacagagaggaatttagtaattttttcctaagttcacacaacagaatgaaaggttatttattatacatcatttattgttaaaacatgctaagagaattaatttggaaaacaaaggaatattccaaagagataaaatctacatttgcttaccaccatgtaaatcaggtaagactaagatacctttaactatggtgtattcaataagaaatttcaatctgccatctgtctctggaataatatttgtgtattcttatctgctcaagtgttatactgcctctttccataggaggaaactgattcgtgaagcatattatttgtccttggtcccagaaagagaaatgcatgatttacagtagaaacaataattttaaataactctttttcctaagaaggtataaagcatattaaaatcctatatttgtatcagtataaatatgcaatattttacttaactatttgctgaacaataatttggataatttattaaaattctgaagctaagatttatgagccccccaaaaaagctattgtttattttatatacttttaaaatggcattgaagagcaattatcatttaacttcttaattattttagcttagtccagttcaaattacctaataaaaatgtttaaagaccataaactataagaagatgtaatgagaaatggaaataattcattctattcctatttagaaaacattctagaaagtggtatggggcataaggactcacattatggaaatcttttaaacaatctgtgtgtttttttatcaatttgttttgcagcgcaagactcaccagttttttgtaaaatcttttactactcctaccaagtgtcatcagtgtacctccttgatggtgggtttaataagacagggctgttcatgtgaaggtaagaacacaaaggaaagaaaatgtgacttcactatctaaattgtaatcaaataagttgattctctttcaaaggtgtataaatgtttgttttacttaatcatttgcttttttgcataacaggaatggaaataatctgtgttgtctgttgaatgttcgagaaactagacatatttttcaggggcaatatatttaaatatggttcatttgtctttgttttgttattaaatttgtagtccctgccaaaaaacattaacctgacagaagaaaattcattgaattttaaccttgtttaatttattagagaaattgttattaaaaagtagacagtgtgggaaccttttcagaaatattaaatgtctgccactatgtctgaaagatattttattcctgtattaatagcagaggtttttttttttcccctaacatccatgatttattcatcacatgtttatggaacacccactgtacttctaggcactggggacataatagtggataggggaaaggcatagatcctaccctcatagagcgcacattctgagtgatgaaggagagagggtcaggggtcatgtgaacagaaaagaaagtatatttgtttgggtattcctttatttttcctaggacctctgaagtgaaaatggtttaaattataatggaacatatatttttttaaatgtttcagaagaatacttttttaaaaaatcaaatgaaatttgtcattacaacactaccttatatgaggggacttcaaaaagcttgtggaaaagtagaatttaaaaataaaaataaacaatataaactttttttttagcataagctccattaagttcaagacaactttgtaagcaattataccacccatttagtccatccctgaagaacagagggtcctgagaatgtaaccatgtcagtctagtctcctttacattattaactgaagaaagatgggtgcccttaaagactttttgaaattcagaaacaaaaaagtcagaaggaaccaaatcaggactgtaaggtggatgcctaatgatttcccatggaaacactcacaaaattgctgttgtctgatgagaggactgagcaggaggagcattgtcatggtgaagaaggactctggtgaagcttttcccaggcgtttttctgctaaagctttggctatatttctcaaaacactctcattataaacaggtgctatcatcgtttggctctctagaaagccaacaagcaaaatgcctcaagcatcccaaaaaactattgccatgacctttgctcttgactggtccacttttgctgtgactggaccacttccacctcttggtagccattgctttgattgtgctttgtcttcaggatcatactggtaaagccatgttgcatctcctgctgctgttcttcaaagaaatccttcaggatcttgatcccacttgtttaaaatttccgttgaacattctgtagctgatctgggtgcagtggttttggcacccaacaagtaggaagtttgctcagcattcatttttggtcagaattgtgtaagctgaaccaattgagatgtctgtggtattggctgttgtttgtgctgttattcatcagtcctcttcagacagagcatgaacaagattaattttttccctggcaaattaatgtggaaggtttgctactgcaggtttcatctttgacatcatcttatcccttcttaaaatgagttatccatttgtaaactgctgatttctttaaggcattgtatttgtctcttctcacattgctaataaagatatacccaagactgcataatttataaaggaaagaggtttaattgactcagttccacatgactggggaggcctcacaatcatggtggaaggtgaaagaggagcaaagtcacgtcttacatgtcggcaggcaagagagcatgtgcaggggaactcccctttataaaaccatcagatttcacgagacttaatcactatcaccagagcagcacagagagacctgcccccatgattcaattacctcccactgtgtccctcccatgacacatgggaattatgggagctacaattcaagatgagatttgggtaggaacacagccaaaccatatcaggcattgtccccataaactttttgtaaagcatcaatgatttcacccaagcttcattgtaaattttatatttgttcttacttaattttagcagaattcatgttgttctgataggggctcttttcaaattgatgtctcattcttcttagtgcctcaaactagatccttttcagacatattataacaagttagtatgcatttattttggtgcaaaagaaaattttaaatccatgcatagtttttccataatatgcattttccatgaacattctgaagatctctcatattgatgtatcttatgaaaaagacaagaaaatagttgctaactcaaattctaatactagttgccatttcctgtctcttctgctgttagaatgggaagggaccttaaaggaaatgtagcccatccccatcagatgcatgtgtttcctttataatagacttgtagttagcctgtatctgagtactttgagtaagagggaaattaataacatcttaaggcagtgcattctgtttggttagttctcacagctaaagtgaaagatccagattgcagtattttaactaatccattagatatgtgtgtttaaagccaaataaaatgttcagggttaagaaagcagagatttaagagctaggagtgtattaagttataaacatgaatgacatccaggaagtacatgtagattgagaagagagcaagtacatgagtctcttacatagttaagggaaggcaacaggaaaagatagccaagttaacctgagaaggaatcgcctgtattgttgactaggaaggtgtgactgaaggcaaagaaggagaaaatttgtagttttcaagctttgtttcattttggaacttagccagtaatggtatgtcattttaaaatttgtttatcagaaagaatcctggccagctacctggctttaagtcccatgtcattttttatgcaccacaattacttgcaattcatagtaggaatttttgaggtcttctcagactctcttcccttctagagtcttttgctgtgaaattgtgcctatcttttcttcagaccctttgaagcctactttatgaagctatggggactcatgagactgttcctagcctttgtctgccaggcttttgtaaatgttgtaataatgtggttccagcttctaaagattcctgtcatgttcctttccttgtggttggttggaattagatccagtataggatacttattttgttgcttccactgccctttgcttgtaagtaaaacaaatcataacttgctagatactccacttaaaactgaattgaaggccgggcgcggtggctcaacgcctgtaatctcagcactttgggaggcccaggcgggcggatcacgaggtcaggagatcgagaccatcctggctaacacggtgaaaccccgtctctactaaaaatacagaaaattagccgggcaaggtggcgggcgcctgtagtcccagctgcttgggaggctgaggcaggagaatggcgtgaaccccggggggcggagcctgcagtgagccgagattgcaccaccgcactccagcctgggcgacagagcgagactccgtctcaaaaaaaaaaaaaaaaaaaaaaaaagtgaattgaagttgtgtgtgatgactcatgcctatagtcccaactactcaggaggctaagacaggaggatcattttgaggccagcctgggcaacatagcaagaccttctctttaataaataaataaagtgcattgagatgtttggatgatttttgtcatcttgcctctctgctggtttcacagtatccatcagtgatatgtagtccatttatagagatggtaactgtacctctcttagattgttatagaaaaataaaaagcactccataaagttaactattgttattttagtagtagtttaagtatatgtaataataactcctaaaatttacctttaacttgtacttttttagtcattgaaaaactccattttcaaggattggtagagtttgccaaaccgaagatgtcaggtagcttaatgcccactagtgacccttgcaacagaaatttcaaggcagataccaagttgcagtgggatgaagagcaaaaaactctagaaaccactcttttagaaaatctaaatcaatcattttattcacaaggttagatgcttcgtctgttgcttctttttttgatcactaatgtcaatacagaacagcagtaatacaagtaattttttaaatatttactatgtctcattaaaattgtcattggtaagcaaatgaatcagctacccaaatgataaaacagttatttaaaataaaattggagataagcattcatctaacatagcatcttgtatgcagtgagtgttacgaattttctttttgttaaaatgaatttttatcaaacgtttcttttttccctctaaaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcagggtaagtatgattaagttgggtttagattaatcctttaagatttattaatgaattaaaatcaaatccagttagtttaagaggatagttcttgatggaaaattaaatgaataaaattcatctaataattttatttcatctagaataatgatttgcaaacaaaaacctagcttttacatggaaataagttataaaatgtctcaagtttttccatattgttcctatcttgtgatgaaatcttcataaaggagtttgtggcccctgctcttgcaagagaggtggcatatggttatgaattatgagctattaaggcatagtcttgttatcttgggtagtatttacaatgtaagctgaacttcatcttacaccaagtttgacttttatgctatttagaaagaaacccatgagtgttattttaatgaaatatgagtgaaagttaaaatggtaccattaaaatgtttctcagaataaaaagtcattctgtatttgaagaatgtgttctcacattttctcatagcttaatgatatgtgtctcatctgctactttaccaaccagaatggcagacttataaaacgtgtacattatctgtaggtcttcaccatgcaattacatatgtaatttaagggatattttcatttgagttgttttggctgtttgtctgtctaaaacaaaactaagattcctaagccagctggagtgaagaaagggtggcagagagcactggctatagtgtgtgacttcaaactctttctgtacgatattgctgaaggaaaagcatctcagcccagtgttgtcattagtcaagtgattgacatgaggtaagagtttgaaggtaaaattatttgtatcattgcaacataggaattttaaagtttctgattttcaaaaattgtgttgccatggtttatttaaatgaactaatttcgtattttctaatttgctaatattgctatagaaacagaattgaaaataggaagtaaggtgtatttataggacaggttggtatgtgtgttgagtgtgaggggctaggagttaaggaaaaagaagttggtgtcccaaagacctgtgtaaatggggtaatggaggcctaccatgtgaagtttatattatcacatcacctaaaggcttagagtataatttcaatgtgaggaaagaaaataaaaatcagaaaggcttctggaaaacataatcagtaaacatttaagtaagtacagcccttgaacacttctggtctcatttttcagattcttcctgtgttccttagttctctctcctttaccttttctcctaactccaggcactatccttgagtgatcatatttactcacagcttcagccatctcctctgcattgatgactcccagacttgtatctccagttcagatatatccatccattgctcaaaaccggaatttctagctgtgactcaaattggcacttcacattggcatctcaaacgcattatcttcccctacaaatatggaacatgacaggatagatgcaagaaatattggcaagaaaaatctgatagaacctactaagggactgaatatagatagggaaaagaatcacaaataggactaaggtgtcaagcctgtaagactaagggagtcatggtaccaacaacaaaattaagggaatcacaagaaattattgtggaggaaatacgttgtagatgttgaaggaacaataaaatataacatgagctgggttgagggtacttaagatttattatgggaggcaagagggtccactggaggctccagagacctaccagggttcaaatcccagttctacgtgtatacttaactggccttgtgactgtgggtaagccagcaatgatttctagctcttgtataatgtgccactaggaagttattcttgataaattatttggggcactattaattacaatgggggaaaattaatttttttaaaaaattaaatttgggtgtttggtgcagttaagctttgggtatgtgttatttggatacacaccccaaaccacacacacatagccacatatagtaacttttaatgctttgcttttcgttcagggatgaagaattttctgtgagttcagtcttggcttctgatgttatccatgcaagtcggaaagatataccctgtatatttagggtaagtgtgtatgctgtaatttgatcactgaattatgtgtttttaatgagtatattttgcctccctatataaatcataaattcactataagtaaaaccaaatcttatattcttttatatattccatatcatccagtacttgaaggtatagaaaattggtgctaagtatttaattagtgaaagacctggagaaagcatcaatatatggcttataaaatatgcttcctggtagataatattttttagttccaattcaatttttaaataaatactaccacatggaaaattagataagtgtgaggtttctcaagtttttaaaaaaataaaaatgtctgtcttgaaaaattaatgcgtttgttacttactgctttgtaacagccattccaaaacttagtagcttaaaccaacagtgatttactatttttcactattctgtggaccagctgtacagttcttgtggtgtccgctagtgtcactgatgtgactgcattcagctcatttgggaccagaacatctaatgaccttgctcttacatctgggtgctggctgttagctgggtgatctcagttctcctctttgtgaactccctccatgtggtctctggtcgtcaggtaggctggctgagctcccagtggctggcttctaagagagcaaaataagctgccaggccctttgaggactaggcccaaaacaggtataataacccttctgcattctgttggtcaaagcaagtcatgaggtcagcccagatttaaggggaggggaaatagactccacctcttgatgagaagaatggaattccttaggaggacttgttggtaggcgtctttggaggcccttgccacgatgcaatcttgagtgggtaaattaagacaatagaggttaaaaaaaaaaactactgcccaattgttatgcctatctccctatatttgtctatgaatcttgtatctaaggaaggtcaggcaaagattatacttagtctcttagttcccagactgacaactatttattttcctcccagccaccaagggagcctacagaggcccacttatctataactgattttcatagtgtgagtttattgtcactgctacttaataaggaattctttacttatgataaggaattcatataggtaaaatttaaaactgctctgatagtgttgtttgtataatgataaaccttcatttaaatattaatttaaatggtcaaatcttaatgataatgcgagttattgttgtgaagtaacagagaatatatttctgagcacttctgaccttaaaacaagtcacaagtcagtatggtgtggcgcttaagagcatgggcacaagatcccagacttgtagttgtatgtccttggagaaatgatttaatttctttgcatcaccatttttttcatatataaaataaggatataatgacagtacatcctaaatcatgacgatgttaacagagttaaatgagttaatacttgtaaagtgcttagatctacctggtgctcagtatttactcaataaatgtcagttgttgttgttgttgttatatatttaatgcctctttagtgatagtgttctggcacttttacagaaggaaaatgaaaatgatactaacatttcaaatggtgtctgccacctttgctttgtcatgtattctagtgctaaaggtagttattctgattaggaatagctgaactccagtaatggtatcatttaatgaatgcttattttattggtgagtgctaagcaaactaacataatcatgaaactagcataaagggtgtctgttttctaatatcatgaatattgattaaattgttctaggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcataggtatgaatttataacatttatcatattattatcattgtttactaatctaccttgagaacagggattggctttcatctaggaatccccagtgtccaacatactgtgcatcatatcataaatgctcagtacatgtttactgaatgaatgagacctatatcagatctttgtttttcagtaaacaggagtataaatacactttcaaagtgccttttttttcctgaaaaaacaacagtgctaagcattagcctactaatctattttctgcttgtgtgatttagaacaagttagtttcttagagtttaatatataaaatacagatggtaattaccttgctgaggttattgggaagtttaaataagatggaatacataacacagagtgccctgcataagaaagaaatccccttaacaaatggcagtttctgtgtctggaggtttaaatttttgctgtattcctgtgtatgcatctaactcttttgttactttccataaatactgaaaagttcaatgagtatggttcaaatgccattcacaatttttacctcccaaaacaataagtgtagaacaacttaggtttttcattttgtttcatcatttattaaacatttacttctttttgtaagtattgatatggattattctttaataattgttctattttagaagacatgagagatttaccagtataatctgaaaggaaatagtgtaaactgttattgtaattcattttatttccattttttgcaccaaatgttcttatcatctggtttattagcattacatggtttttttcctaataaaaatctttcacattcatgtcttacatagatcatgaaagaattgctttgggaaacgaagaagggttatttgttgtacatgtcaccaaagatggtaagagaaaactttttttttttggagtaattttaaatcgtgttaaaaaaatttaaactgtagattctaaattctacaaagagcaggatttgctcttatttatcctgcgactaaaattttccagacctaatttgacgtttataaattaaaagattatttttaaatttctataatccccctgaggtttaaaacttcaaatatgtattgtctttcttgtatcattttatttaacagttctgtacgaactcagattgcatttctttttttttttttggagacagagtttcactcttgctgcccaggctggagtgcagtggcacgaactcggctcattgcagcctccgcctcctgggttcaagagattctcctgcctcagcctcccagtagctgggattacaggcatgcaccaccacgcccggctaattttgtatttttagtagagatgaggtttctccatgttggccaggttggtctcgaactcccaacctcaggtgatccacccgccttggcctcccaaagtgctgagattataagcatgagccactgcgcccagcccagattgcatttctaaagatggaacatgaaaaaaaatatatacaacttgattttcacattgttctattagtaccagaagaggcaacagctattaaaatgtgtttgtttggaggtttttcttctagggaaaaactaaatgctgggtgaaataaagagaaaccaatataacttggtattcataaatacagtattctaagttttatctttatgtcaacttagatcatgggaaaacaatgcattgttagccatataaaaacttctgaaaaataagttctctgtttttaaaaatgggaatcctatggtgacgttccctagaatttagtgccagtagaaaagtttccttgaagatttggcatacttttacacaagaatcctttggggtttgccttggctgccagaaatctcaggactcaaatttaatacgtactataggtgagttaaattatcttatgatgggttggataatctttttttcctgtgacttctgatgtcttattcttccgtatgtgcatctgtaagttgacttacatccttttgagtataattgggatatgattaatcaataaaactatattttgatttattattctttctgtgtttagaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgtaagattctctttcttacggctgtcttatctttatatctcttcttccttttcccttctacttcgtctcccaaatgttgtcattgttgataacagttttttaaaaaagtcattcttaatgcttttcctcagtattgattatgttgttgatgtaaaaaccatatgtagttaggcctgggcaaacagggccagcattagcatgcacgtaatttaaacaaaacatctttctgtggaatatttcactaagatggattttttaccccacatcatattttgaaataacccagaattgttatctcatggtcccccaaaatatggtgcttgtaagcatcagtgtttcacagaacttattctggagaagtagttactaagtgagttatttaatcaggtatgtaaaggtataatgtaacatctataagaggtgttttttcagttttccacttttatctagatgggtagatatttataattgcttattttaccccttcaagaaatattaagacataataaattattgaatacttttttttttttttgagagatggagtcttgctctgtcacccaggatagagtacagtggtatcgtcacagcccactgcagcctccaactcttacactgaagcagtcctcctacttcagcctcccgagtagctgggacagcaggtgcacaccaccacacccagcttatgtttttattttttgtttttgtagagatggtctcattagttgttcaggctggtctcaaattcttgtcctcaagcaatcctcccaacttggcttcccaaagcactgagattataggcttgactcaccacacccagactcattgaatacttttaattatagaatactttggttattgaaaataatccaattattattgaatatgtgccattgaatatgagttaacagcaatgagtaaaatagatacagtcttaaccccacagagcatggggtgcagtggaaaagattcgtgataaagcaagtagttgcagtagagtgtaagtgctatgatagcagaagtagagagttctgtagaagcacatagaagtatttcatccaaactgttttgtttttaatgaaaaatacttgagcatgttaaaatgctgaagggaaaaaaaaccctagggaactacatggaaaagttgtctatatgggaaatagagtaagaccgccaagaaggccagagaggacaaaattcagaagacaggtgcaagaattacttgggggcaggaggagtaaaacctcttcatttgtaacaaggtaggaggaggagtgatgggtatgggtctagtcaagtttaaaggttcagtgcgagaaagtttgggagggcaacccatgctcattacagaaaaatcagaaagtctgcgtgaacaggacaaaagaaaaatacctctagttctacccatccagacttttttttcccccaccctccatcctgggatgaacgacttaactattttttgttgttattgttgttgttttttgtctttccagcttttcaactgcagatcttgggaattaactatttttaatattttgtttcttctgaaaaatatggtcttaggtgggcacagtggcttacacctgtaatcccagcacttcaggaggctgaggcaggaggatcgcttgaggccagaagttcgaggccaacttgggcaacatagcgagaacctgtctctataaaaaattttctttaattagccaggtgtagtggttgcatgcctgttgtcccaactacccaagaggctgaggtaggaggatcacttgagctatgatcatgccattgcactccagcctaggcaatacagtgagaccttatctctaaaaacacaaacccacacacactctcatactcatcagtggaataaatgctgtcttgtaactgaatcagataataattatgattattctaatgtagagtcagagttggaatgtctgacttttttgtgtagctctttcaataattccctttgtaaccttagtttaagtaaaccattgaatctttctttgcttgtgtcaccatttgttgatattcattctttcaacaagtgtatattgagcatctaccctattcatgtaactgtgctacagtgctttattatacattcttaacagggactagaacacttacctgaagatttctctgctttctaagtttgattcactgtcaataacttaactacttttaggaatcaaatagttcaaatataatgaaattcctttatagaactcatgttgggcaaagaaatagtatacccctggtgtttacagaatccgtctatattataacggctatataatctgaatcatggtataccagttcctcatttacgatatatgttctgtttgcttcaaaaatgttttgatttggctactatatgatagccccataggatttgggtgggattccactctacagttatttagtgtagacctttcaaaatatttggggtttaatagttaaaagtaatccgcaagctgcccccccttcccttctcccaggttacaatgcaccatatctctcggtgtacagtgaaaatgcagttgatatctttgatgtgaactccatggaatggattcagactcttcctctcaaaaaggtaatttaacattaaaatgtgggctaagccaactgagtataagtgaaaacactaaattactacatagtaattttttttttattaattcaacattttctggaatgtgtaattggcagtttgggacttagctaagagtgagaaaatagaaacagaaataaagttggttaatttccttatgcctcactaaaaccatactaattttactatatttggtttatgcaaagtatgattgttattattatgaacaactagaatatatcctacaacttaaaatgtcagtgttatcttctacttttggattaaggagctctgagagagtacatgattattatgaattataactgtcattcacccagtgtttaatcctgtgaggacagatttaaaaggctagaaaagtaattaaacttagaaccaaaactgtttaagtgtccataattgaaaaataaatatttcatatattcctaataaaacataatatttttcttaatatataatcctgtttccataacaaagagaatttttacaattatagaactgctagtttgcaaaaatgaagagcaatagtttcatatagatagatgtgatatatatatagcatgtatgattagttgggggacagggtttagagaatatgtgaaagtagcttagatcatatttcaaaattagcacccatttaaaatcataatagcagtttaaaaagctcttgtaaatactgccagattatctaaagcaactaaaatatactctagtttgtaaatttggattggtcattattacttttctgtggatttttttgttttgtttttgtttttgagacagggtctcgctctgtcatccaacctggagtgcagtgacatgatatcagctcactgcagcctccatctcctgggttcaagcaattctcccacctctgcctccagagtagctgggactacaggtgtacaccaccatgccctgctaatttttgtgtttttagtagagacagggtttcaccatgttggccaggctggcctcgaacttcttacctcaagtgatctgcccgcctcggcctcccacggtgctggaattacaggcatgatccactgcactcagccctatttgatttttatcatgtaatttttgcaatgtatgtgaaagaatagatatatggcctttgtgaaagataataataaactgatcactcatgaacctacctcctaacctgagaatcagaacatcactcatataactgcaaactgcgtcatgttgtgcttatcattcctttgcttttcttaaaatacagaatttttgcatatttaagtatccctaaataatatatctttcagttttgcttggttttgagctttatgaaaatgttataatatatagtcattttctatcttgctttctttactcatccactgagtctcattcgttcatgttgttatatataccatatagtttattgctttcagtactataaaatattctgttgggtgaacttagcactactgtctgttccctgactgggggacattgaattatttactagctttttgcaattgtgatgttgctgcatctgttttttggaatagttttcaggagtttgagtcatatacctaggagcagaattgatgggacatagggagttcagtcagctttatgagatagtgtcatattattttccaaagtaattgtaccaaccaatactcccatcaacagcataaaggaattcttatcaacatcctagtactttccattgtcaggattcataggttttgtaaatggttacaaagtagtatttcattgaagtttcagtttgcatgttgctaattaactgtgtagttgaaagtcttttgtgtgtttattcatcattcatatttcctcttccataaaatgcctggtcatgctttttgctcattttgctattggattggccatatttttcttatttattgaaattctttatacattgtggatactggctaataatggatatgtaaatctttttcttctttgtgacctattcattcatttgtatttggctgaacagaagttactaattttaatgtagttaaatgtatctttcttttcctttatgtttgtcttttttctcttgtttaagaaactctttcctaccttaaggtcataagatacattctattctcctccaaacattttaccttttttaaaaaatcttttttaaatgtatatacccagcctccaaacattgtaaagcttagcctattacgtttatgtttttaatccaactggaattcatgcttggttccgtataaccagttgctcaatcactatttattgacagtccctcctttccccagtgatctacccttccatctccatcatatgtatgcatttagtttttgatagtaagaattcataaatcagctgtgttgatatctgcttagtataactgttgggtcattaatggctttaaaaagtctaaggtttaaatgtatttctacttatttgttcatttgcttaggatagccttcctttaaaatattatcattgcaagtttgtttgttcaaattagatagtattatacctttccagtcagaattattgttgatttttctgagagggctgcattttgaagtagataaatgagaagtcttaataaggtgtgctttataagcaggacaaaagttttataatttaatttttaaaggttttgttgaaatactaattttgtcttttattttaggttcgacccttaaacaatgaaggatcattaaatcttttagggttggagaccattagattaatatatttcaaaaataagatggcaggtaagaaaatacatatattcatagggatagcttcattggaaatattatttctaagctaactgcccaaggtcacattaataataagtgccagagtccagatttcaacacaggtgtatcttactccaagtctatgatgttggccactatcacattcttaatatattagaataaattactgggcaaaaagtcgttctgtttaagctcacttaagtatttgattctgatgtaccttgttatttttctgtggagtacctgagtaagtagagaaagtgtagctgattatgtcttctgtattttcaatattgtagaacctaaccaaaatttgtaacattaaaattataaacactcatctagagttgaggaatatgtcttcaggaacatatcttctgccagtgtacagggcctagcacttcgaaagtggtgatgtcagcataggaagaagcaggaaagagaggagagtcatgggagtgcctggaatcaggagagggagtagagacccagagtgttacagacaggaggggaggatatttggtcagtgaccaaaatattgaggtcacacatgtcattacataccacacataaaatgccagggagactgttcacatagaattaaatgttgtttgcctgtcagggtgtccaaacagttaaagtctcacttttaacgaacattattatagtgccctcttctatataataaagtcatttttgtgtcatagcagcaaatttctatataatagaagtatttgtaaatttctgatctgttatggcaagtctgttagcgaggatgtatttacagtacattatgtattttaaataattttttttttttgagacgggagtctcactctgttgcccaggctatagtgcagtggcacaatcttggctcactgcatcctccttctcctgggttcaagtgatccttgcacctcagcttgctgagtagctaggattataggtatgcaccaccacacccagctaattttttgtatttttagtagagatggagtttcaccatgttggccaggctggtcttgaactcctgacctcaaatgatccacctgcctcagcctcccaaagtactgggattataggcctgagccatcacgcctggccagtatttaaaataattttaagtagacaaatataagtaaaaatactggcttcaagaaaacacattaaaatgtttagacccattattttggggtagttaatttttatttttattttattttttttttgcgggggagacggagtctcgctctgttgcgaggctggagtgcagtggcaccatctcagctcactgcaacctctgcctcctgggttcaagcgattctcctgcctcagcctcctgagtagctgggattacaggcacgcaccaccatgcccagctaatttttttgtatttttagtagagacggggtttcaccatgttggccaggatgatctccatctcctgacctcgtgtcccacccaccttggcctctcaaagtgctgggattacaggcgtgagccaccgcgcctggccatgaaattattatcttaatggttttctcccacctaccccatattcctctaataaatttgtgttttctactatcaaaaaaaaaatccatcagaagtttttctgtgattatttttgttggttttgttttattttgttggtgtgtttttgtgttattaagtactggaatacacaaaattgcttgatttctggttcagtgcattggtacattgtcttggaaccagaggtttcttggtgaacaggctggtgaatatagcagaagtctatggtaagactccattatgacttaagaaagtatattcaggttttagaagtgattctcatttagagatggataccccgtgaagttaatgaaatgtaagctttagatgcttcacttccaagacccatacttagttttatacaggcatacccccattttattgtgtgccactttatcgtgctccacagatactacattgtttacaagtcgcaggtttatggtaaccctgcctctagtaagtctcagtgccattttcccaacagcgcgtgttgacttcatgtctctgtttcacattttggtaattcttgcaatatttcaaactttttcactgttattctgtctgttacggtgatctgtgatcagtgatccaaatttgaggttattgtaattgttttggggtgccacaaaccatgcccatataagatgccaaacttaattgataaatgtgtgtgttctgactgttccaccaagcagctgttccctggtctccctccctctcattgggcctctctattctctgagaaccaacaatagtgaaatagcccaattaatagccctgcaatagactcttaagtgttcaactgaagagtcgcacatctcttactttaaatcaaaagctagaaatgattaaacttaatgaggaaggcatattgaaagtcgagataggctgcaagctaggcctcttgcaacagttagccaagtcatgagtgcaaaggaaaagttcttgaaagaaataaagtgctgttacagagaacacatgaatgataagaaagtgaaacaaccttattgctgttacaaagaaagttttagtgatctggagagactgtcagccgcaacattcccttaagccaaagcctaatccagagcaaagctttctcttcaattctgtaaaagctgagagctatcaggaacctgcagaagaaaagaagctagcagagtttggcttatgagatttaaggaaggaagccatctccataacataaaaatgcaaggtgaaacagcaagtattgatgtacaagctcagcaatttatccagaagacatagccaagataattgatgaaggtggctacactgaacaatacgaaattcagtttagctaaaacagacttctgtaggaagaagatgtcatctaggactttcatagctagagagaagtcaatgtctggcttcaaaggacaggctgactcttgttaggaattaatgcagcttgtggctttacgttgaagccagtactcatttaccatttgaaaaaatcctaggcccttaagagttacagtaactcggttgggcatggtggctcacacctgtaatcccagcactttgggaggctgaggcaggcagatcacctgaggtcaggagttcgagaccagcctggccaacatggagaaactctgtctctattaaaaatacaaaattagccagctgtggtggcacatgcctgtaatcccagctacttgggaggctgaggcaggagaatcgcttgaacctgggaggtggaggttgcggtgagctgagattgtgcagttgcactccagcctgggcaacaagggcgaaactccatctcaaaaaaaaaaaagaattatggtaactctactctgcctgtattttataagcagaacaacaaagtctggatggcaacacatctgtttacaggatgtcactgaaaattttaagcccactgttgagatctactgctcagaaaagtaatacttctttcaaaatattactgctcattgacaatgcacctaagtcacccaaaatctctgatggagatgtacaaggagattgatgatattttcacgtctgctaacacagcatccattctgtagcccatggataaaggagtaattttgactttcaagtctgatcatttaagaaacacatttcataaggccatagctgccacagatagttattcctctgatgaatctgggcaaaatagattgaaaaccttctgaaaaggattcaccattctagatgccattaagaacgtatgtgattcatgggaggaggtcaaaataccatcattcacaggagtttggaagaagcagattccagccctcatagatgacttttagaggttccagaaatcagtgaaggaaataactacagatgtggtgaaaagagcaagagaactactagaattagaagtggagactgaattgctgcaatcgcatgataaatttgattggatgaggtgttgtatctcatgggtaagcaaaaaaaaatggtttcttgaaatggaatctactcatggtgaagatgttaagaacattgttgaaaaaacaagaaaatatttacaatattacatacactaaggtgatagggcagaggcagggtttgagaggattcactccagttttgaaaggaattctactgtgggtaaaatgttaccaaacagcatcattatgctatggagaaccatcttttgtgaaaggaggagttagtgtggcaaactttattgatgtctcactttaagaaattgccacagccattccagccttcagcagccaccaccctgctcagtcagcagcttatccacatcgaggtaagaccctccaactatcaacaagaatatgactcatgaaggtgaagatgattgttagcatttttggcaataaagcatttttaaattatggtatgtattttttttagacacgtactgttgcacacttaacagactacagtataatgtaaacataatgtatatgcactggaagaccaaaaaaatagtgtgacttgctttattttgatatttgttttattatgtggtctcaaattgaacctgcactttttccaaggtatgcctgtattctgtttcttagaggaactccacatatttgtataagattggctccaccttattctcactgtgtgtgactatgctggtcataaatgtgttcatacccactatgtgtctataagacaaaacctattctgacttgtcttttcccatgctttttcatctttctactctaggctaagagtagaggtagatcttggagaagagggacctgacaaaattttaatgtagttgtctttttctttgacaaaggaaggaaagcccatctcaagaggtcctttctttttctgtgttttgctttctccatcatttcttaagaggtcaaagtgttcctgcaaccctctgcctgtccaaaatctcccattgccaccctgagtctccaagacctgctttaccctcataattctcaaattccaaatttgtgtcccacattctcattcacttcaaaaattctgttctttggctgggcatggtggcgcatgtgcctgtaatcccagctctttgggaggccaagacaggaggatcacttgagcccaggaggtcgaggctgcagtgagctatcatggtgccactacacttcagcctgggcaacagagcaagaccctgcctcaaataaataataataataataataataataattctatttttaaaatatttactgttaggaaagcagtctgcctaagccatatgattatgccacgaggatcatgttgcatttctgctaattatcacctttgttttcttctaggctcgtttggcttcttctcacctcctccttctcacttcagctttttgggtgttgaaaatttctaaactttgctctttttccttatcttatttagataatgacaccatttgttgtgttatatggatacagttgtctatttttttcttattttcacacagcccagcatgttttgggagtccctggcagacagttttgtttacttctagatattaaaactgacatcggataagactatcactgggttgctaggtgtatatgattaaacatcatctacccccaagatcagaagaggaaaaatagcgacagattcttaccttttataaaggaagggtagtggaagcacagctccttctttttactccgtatctcatagactgaaccttgcaaaggaaatttttttattatgtaaagatagttgtaattgttatttaccacttatggtaaatcaggcttaccatttatgcctgattactgttcagggtaacagtagtagctctttaacaacaccctaagccattgaaatcaatacctggagggagagaaaatatagtattgagatactggggtggggtggctgattagtgacagaacaccaaggcaactgcagttttcttctagtaaaattatgtcctactgtgtttataatcaagtaaaagtgaaagtatattttgtaagctatgtttactttcagcatattatctgtttacataggttctgttaaatattatttactgggttatcaacacaacatttaaaaaccagaattgcatgtacttgtactatcaatgtttgtactgtcttggaggttaatagataaaaagcattttaacagtttaaagaacatcattatcgtttgtatttttattttaacagaaggggacgaactggtagtacctgaaacatcagataatagtcggaaacaaatggttagaaacattaacaataagcggcgttattccttcagagtcccagaagaggaaaggatgcagcagaggaggtagatacttaacctgtagtatcatccatgcttgcttgtaccatcaaggactactcggtgatgatactatatttgatttggaaggaaaattgggtatctgaaaatctcattgatctgtggtgtcaaaaactgcaataatgaatgtaacttctcagtgtcattttaattaatattctcaaaattgtgagtatgcactggattaaagtaccatatttttattcacttcattcacttctctatgtatatggaatagtcatatttttggattgtgtacctttctacagtataagcataggacatagctgtgcatacagtaaacctgtatatgtctaagaagttcagactaactactctcttcatgagcaaacagaagtaggactgtagtatttacagttatatataagaccgtttctaaagtgttaccaatcatttttaaagagatacataaaatgttcagaattatatgtaaaacaaagtagagcttctttgatgtcttaagtatttaaaaagatcctctactattccacctaaaatcgtaagatcttttaaaatttaaaacaaaatattctaaggaagtacatttttaattgagtatattctgttactctatattcttattaatgtgatttaacagttgtatttttattaagaaaattaagcttaatttttttcataagctacataaattaactgtggaaaaagtatctaaacagatgccttgtcttacagggaaatgctacgagatccagaaatgagaaataaattaatttctaatccaactaattttaatcacatagcacacatgggtcctggagatggaatacagatcctgaaagatctgcccatggtaagaggaattaagagtgagtgtaaaaaagggcgggtgtggggggagtataaatacataggcttaaatacatgggtagacttcaaaggatatgtgaaagtaatgaggaaatgtttctctcagtataccacaatatgtctaagatacatgatgacatacctgatgaacaaaacataaaatttagacatctgtcaaaagccaaacaaatcaggttcttacttagttccatattggagaatttctcccatgcctaggtttactattggtggtggaagaaactaccaaattcggagaggttctataccacatttggaatgtggttaccaaatcactaaaatttcactacgtgttagcaaatcaatacagatatttggcctactctttttttttccttcttcccagagaaccacattagcttggttattaatggtcacatctctccgacagttgtgaaattaaatcgttttcctttgcccatttacaaacatgttacctggtcagttgtacgtgaaaaagtataacataggccaggtgtagtggctcatgcctgtaatcccagcactttgtgaggccaaggcatgaggattgctgaggccaggagttcaagaccagcccaggcaacataagcaagaccccatttcttttttttctttttttgagatggagtctcattctatcacccaggctggagtgcaatggtgtgatctcggctcactgcaacctttgcctcccaggttcaagtgattctcctgcttcagcctcctgagtagctgggattacaggcacccaccaccatgcccagctaattttgtatttttagtagagatggggtttcaccatgttggtcaggctggtctcgaaccctgaccttgcggtccacccaccttggcctctgaaagtgctgggattacaggcgtgagccaccaagactgaccaagaccccatttctataaaaacattgctggtcatggtaatgtgtgcctgtagtcctggttactcgggaggctaaggtgggagggttacttgagcccaggagtttgaggctgcggggagctatgattgccgttgcattgggcaactgagcaagaccctatctcaaaaaaagaaaaaaaagtacaacattggagaactattctgttttaacaatatgaagattaggctctcagaccggtcatgtttaaattaagaatattagtggaattagccaggctctgtacatttcagtaccatagttctctcagcatactattaaaactttaaaaatgacccttttgattggtagtgatagctgctaaattttgcgcagaattttaagtataattcatatttcatggccatttgggagatgatttgtgaatcttgacccaaattgctctctaaggaaatctgtcttaattaaccacattatcaacactacagtgatagaagatataaacatctatcactgacagagaaattgattgataatataattcggtgtgcagtcaagtttctttaaattaaaaaaaacgccttttaaagggaggtttgcatttatttcatgggaagaaaacatatctgcattcaagtctgagttcttcattgtaaatatctcagttcatcagttggctctgcttgcttatgaatgaatgtgacattcttattaccattaccaataatatcaaaatattattatatattcatagtaatatacttttctttgtggagttcaaaccagcctcattaatcacttatgtttttggaatagggttggctgtgctgagtaaatatttaaaaagtgcaaaaactagattacagcttatcttgatatagtacttttaaaaattttcaggtcaagcacattaaatattaaaactattatacttttctatcatgtttaaaagctatactatttttttttcaacctttttctgggagtgagatctcagatttctctccatccttttcccattaggaacatttgcttaaagtcctgagtctggttttcctttaacctcagaagtaaacatagcataactatagagtccaaagcatgttgtttttccttatggaaggtgggatgtcaggcacaaaataccgtaaagaattttttaaattgtgataaacaattgaaatgtgaatatatttatgacttatatttgataagtcaagtgctgtgtagtattttaattaaactttttaaattgagttagtagttttttcaatacataatatgtagttagaattatgtaggggtagcaggatacaaatttcaaatatgtaagttgcaaagcaaaacatcagcaaatataaaattatttcagtagttacaaggttttaatagatagtcttttaaaatttaaattttttacacttttgtttcattttacacagaaaagaatgtttttatctcatacattccaacaatgtagctagaagtagtatagaaaatgtttgtagacattctattctagcccgcatactacagtgtttaacagaatgttactctgcttagtatccttctgccatcaggtgaaaaatcagtttgctaatgttccagagttctttcagaccttcatatccaataagactatgcaccttgatgccaaaatgtcagatttcaaacattataagaactttttttatcagagatccctcctctacattttcttccctcttccttccaccactttaagaaaaaaaaagagataaaaagaaaaaatctgtatcttattttttgttcaaaataaggtctatattgataagcaaaacaagtgaagatagcattttccacagaatcattagactgcttggtttttagtgtttgttgtcacctgattttgttaacacatgataatcgttctttttggcattaacacaagtgactttttgccctctcattgcatttcagtttttaatgtacctttcattgctttaatgttttcttatcacgtaagtgcttttgtatttccaggacaagaagttggtgtaaatttttgaaacctgtttcttcacctgtacatgtagtatgcatcaaagattttatctgtctgaattcctcttcttcacaaccagattttattgtcacatgacttttttctatttcactaccaaaggacatataacctggggcttttttataggcatccatttaatcatctaacaaatatttattgagcacttactttgtgcccggaaccatctttatctcagagtagacactagtaaatacaataatatgcatgtctgaaaataataataatatgcatgcctgtacttgtgtatgtatctattgaaaagcttgtgatattttaatgtattctcagttgttaatatgttctttccattgaaatggaattattacaaactgtctcataaaataaagatgaattaaatttatctaaagttaacatatatgtttttaaataccaaagccacatgttgtcatctattcagagagcatgtgtcccagacatttttatattttaatttattcaaatcagtattgctttcctgtgaaatacttataagcttagaaagtttattgtatgtctttagaaatttaattctgttgcttttgtgcaagatgttcttgaaacagaattgtttgctttttgaatgtggaaggagaagtgaggctaagggagtcatattcctctatcagatgcaaacctttatttgtatctaagtgagccaagacaatataagcattaatataagatggtgtgtgtggcttataaatagatgctatattcattttcttgaatttttaaaataatttaccgttttaatacatggttgctatttgtgataaagaacaaatttttctctaatttggatgcaagaataatactttacctctagaagacttatttttagcacattacatttctcctagctttttatccattactaaaattgttaataaaagtatattttcgagcttagtgacatcctggagctttaagatgtaattttgcttcttaaagtcaaagtttcatgtacgtcagtacaacctcagagggtactgattttattcatatatctagaataaaaacaagaccttacagaagagcctttcttctaaggctaggtaatttatgcaatctttttacaaagcaggttcatctcagctcatgggaacgtgaattccatgctggattcagttagcactctctccaacacgccattcaccctctgcctctaatgaagggatcatgttttctggaaacataactgttcttcaagaactgaatcttgaaaattcccattagagaaggtgactggctactgagtgatagttcctgcgtaatcggaagtagttcttttatctctaaaaatagtccttggattcaaaagcttttttctatatctttgatattacattatttcatttttaaaaaatatacctgaacattgaagggaagatttttaccttgttaagaaaacaaacatgttctttttgggtgtctaaatggagataagcttgggctgcttaaaggtaaaccaataattagtatattccatggttaactgttataaggaaataaaatcagtaaaaacaaacacattatcagggaatgcttttacatggttttagatttctaaagaaacagtttcataacacgtctatttagaagctgttgtaggttcacttgttcatgttcttgcttgtttcttgctttttctatccttaatgtttttgatagatttttgccatattttgattgtgttattacataagaaaatactgaactaaactctgaaagtcttgtatctctgaaagtccaatttctccttacttattttaattaaagaataattttataaaaaagaatgatcttttgcaaatcaactatttaagtaactggcaagagtattacaaaatttaactttctaagacctaaaagtatttcattaaggattcagctctgatatcagatactattccatttgttctgtgtgcatgttttgtgaaatgtgaatccattttcatcaccttattgccttttttcatctttcttttgtttttgatagccaggtttcccttatccatcccctcatcatcactccggtctgatctcctctccgatcaactttgaacacatctatcacatgactgttaattctgctgaaaaatttctctctcctgattccataaaccctgaatattccccgtctctgcgctctgtccctggtacaccaagctttatgactctgagggtatgaacagctgagtcaggtgttaactttcactaaccatgtatggatttccttttgcctggcttaataagtaacaccgctgaaatggtgccatcttgtgaaccttttcctttggcctatttctcttctgccaaacttctcctcttcctcttcctccatgtatcttcctcttctttcccatttctattttgtttcttcttttgaggaagaagatggaggaatagggaagatttcaattttcatttttgaaacacagtattaaagatttatctatgtttaataaaagtttttcccattgtaagaaatagctctctattctgttaaaacaaacaggaaagggctcccagaatttctgaattttttagctccttaccctataaccagttcaattcagtgaaatgttttatatttagtgaggttaaagtctgtggtagaacccatccacagacctatctacaataaacccctttttgaaaagcttaaaaatctccaaagtgaaaagttaaaaaattaatattaatgagtaacaaaaattccaaaaataagttagattttactaatctttgagttactgaaatgcatgtaattccaaccaggatccaaggtaagaaaactaaagcaaagaaagaggaaaatttaaaaagcatgctgtattctgaaggattgtggcagctgctgttggtctcttccattcagcttgtatttttgctaccagtggctttgcagtagggtggagagctggtggccattaaagctgaatattcatatgtccatcaagtggtgtatgcttacagtaacttcaagggaacattttctgaagttagttttgcaggtaataaaatgtttatattgtatcatgcaaaccacttcccataatgtcccctaacttacaacaatagtagatcaatttttgtatttatatatgtagaaattttccaattagaaaattagctgtaggatgggaagtttattttttgttgtttgtattataaaattattctaaattataatgttttaaatgttactgacatttaaattattatatcacttaaatatcttatctgacaaaattaaattaaccacgataaaataagcctgagtttgcttagactgcagggagtggattccagaggaattttgtatatgttaatcaggaacttttcactgggcatgatggctcatacatgtaatcccagcactttgggaggctgaggcaggaggaccacttgagcctaggagtttgagacaagcctgggcaaccatagcgagaccccatttctacaaaaaataaaaataaaaaaattagttggatgtggtggcacatgcctgtggtcccagctacttgggaggctgaggggagaagatcacttgcgcctgggaggtcgaagttgcagagagccgtgattgcaccactgcactccagcttaggtgatagagaaaggctatgtctcaaaataataataataataacttttcatataaaagaccatggaaatgttgctttagttagtcatctataactagaaatactgtgccatcaaatgaaagtctcaccctaatcttatacatatttgtaccttgaaaggaccagaggcttaggttacttgtcactttataatgaagtttatttaactctagcggactgaatgataaactgttttttaacaaaacttttttttgtcattcctttattacttcagcctaagtaataaagctactaagttgttactaagtttcagatacagtttgtagccttaatttttgctatttattctaggataggtttgttttataggaaaggacaacatcaatgtatcttaaggtttacagaaaaacaataaaaaaatgtatagcctgaaacggatattcccatctcctttgagcttttctttgctgcattgttcacatgctgcttgcgtcttacagggttgctcttgtatatgtgtctgttgaattgctagcattgactatttccattttaatttttttattttcttagagaaaaaaaaagcatttgctttaaataacgcaccaagaattacatggactttgcaaatttggtagatgaaccaaattgatgtagatggcatgtagatggcagcagttaaatttggggccaactagttgccaactttcagtatgtgcgattcttcaaaatgtatgctttggagcttttcaagtggtattaatgcatgttttcctgagtgctggctttggcccttttttagttgttttgccataaccttttctcaggcatttcaggtgcatgtaggaaagctcagtgctgcaaactttctctgagctctaacctctccttggagtgagtttcacaattgcatggcaactgggaactcagtttccagttctagacttttattataacttaaaaatattttttagccacattagtacatttctttattgcttgtttcttttaacctcaaaagccttaagtatttgtgctgatttcattgtattctgtgttaaattatttaatctataccatattatagcaaagaagatagtcatcttttaagtgtttgcataaaatgttattttgtatctttaaaacacacacaggcctgtaacttcaaatcaatattaactaaacactgttttacagaaaggatcatattttgaaattacattgccaactgaattaatctcaatactcaaattagaaaattaggattgcagatataatctattcattttccatttatttattcagcaaatatctttcagcacctaactattttaggtgctggagagtttagtgttgttgtaataacagtcagtataagaaattataagatgactaaagaactgaggctagggaaccatatgcctgcttataaccaggacaaactgaactgtcagcccaaaagctgaggaccctgaggtggtgagtgtggaggagggtgtgcctaccaacagtgttcccctgggtttctatgtttaaagggcaagtatgaggacgtttagtaaaatatgtaaaatgtagtttaagcatttaggccttttctcttgctgaaacttgtaaaaccatttaggtaagatagatttctattaacgttaaatagcataagtcatgaataaacataagtcataccacaaagtttatcaatgtatggcaggtatgtggataaatttccctattgtattctctatgttaagctactagaagaaagagtaatattttctgagcccgaaatgatgagaaaagattgtgtttttgaaacagcaaaattaggcagacagttgtaacatttttttaaaaatacactagttagcttggtgttctgttgcatttgaaaatagcatgatacagtatcatcaactcttaaattatgttggaagaaaagataggaaacacatcaaattgttattagtatctggtgaattcacaggtgacttttttggtctcttataatttcattatatattctacagttcatgagtattacctttataatcagaaaaaaagcaaacaattttaatgaactagttagcactgagagaacaccaggttaataaatatatcttccagtcacatcttgttatgtcttagtggctattactatctgtgtgattttctgatgatgtagaaaagataaaggattaccctatagtaatggtagcctatagcattctatgaagagaacatctgttttcaaaggaaagttgcatgttatagtttaacttggaattaaactatttggctttacttaacaaattgatcctttggaaaagtcacaaaacttgaattttttactgcttttaatgtgtgattttttttcattgcatttccattatagagttaaggtattgtttaacacatgtaaaatttgtgatccccccaccaccaagcagaattgctggggggttgttgttgttgttgttgttgttgttgttgttgttgttgttgagacggagtctcactctgcagagtgagtgcacgcccaggccggagtgcagtggcgtgatcttggctcctccagcaacctccacctcccagattcaagtgattctcctgcctcagactcccgagtagctgggactacaggcatgtgccaccaaacccagctaatttttttgtatttatagtagagacggggtttcaccatattagccaggctggtctcgaattcctgacctcgtgatctgcccacctcagtctcccaaagtgctgggattacaggcctgagccaccgtgcctggccagaatggctgtttcgatgtgactaaaaggaggtttgaaagtgatactgcagatggctgtatgaggttgttactcatactcatgaggaaagaaaggcacatagtgggactgggctacatgcttgctttttgctagtgtaattagcttcatcctcagacaagccccaggaggcagttcttatcctcataatacagctgagggaactggggcacagagtttagcaaccccaagccctgctgtcagtcagctgtgcagcacagatgtgagtagtgggccaaatccctccatagcctgtgctcacagccaccatgctgcctttatggcacaccctcacaaacagccaatgaaggagaggctggctgacaataggctagtaagattaccatcatttttgtagctatgaaagaaaaatcaataaggagtagataaatcttctaagtaaatacatataaatctgtttataaattgtaagaaatcaaatccagaccatttgcatcagaagatgcttacatgaggctgggattatgtgaagaaatggagaaaagccttatgagtgttaaaagatgttaataacatggtatatgtaatttgtcttctccaggatttataaagaatattaaaatatttttccctcctctggacttgtgtcagccccaacatctcatcctcctggtctgaaaaagattggggcctttggggaggcagcatgctttctgttctcaaccgtaatcagacagctcaccctgcacaccacctatgtggctatcctttaggcgtgtgtgatttgcaaaacattctgtggcctattttcctacctcacacactaaaatcattcaataattaaatggaaatatcaataaggagtaggtaaatcttccaagtaaatgtatataaacctgtttataaactctttgaaatcaaatccagaccatttacatcagaaattagttttcaaactaatattcccaaattaactaacttcacctaggttgtgagtattgcagcgtcttatttctaatcccagtactactattggtgtgagtcagtaaagatgcctggtgactggggtgtgaacttataaatggcacatttggtatcacatcaataaaacattttcttgagaagaatataattttagtagaattttctccaaatggacgtatcagctgttaagcaaataaaaatgtcatacatagtaaaagctttcagttatcggcaaatgtccatgtaattctacaattcactgtcacatctaaccatatagcttttacttactgtgtttacaaacaaaaaaatgctgttttttactgataagtatttcagtaagtataagtacttattcctgattaggatgagatttacttcatgttagggttttattacttttgtgggtgggaaagactatataatctgccattccttactctgtgtcattctggtcaagatgattttatttcttggtaattatagtgaaaaatagacatctctgcagaaaaatcagtttctttctggctaaaggatgtctctctcgcttttgtttatagaaccctcggcctcaggaaagtcggacagtattcagtggctcagtcagtattccatctatcaccaaatcccgccctgagccaggccgctccatgagtgctagcagtggcttgtcagcaagtaagtgccggggctacaggaaggtgcctctgagacagggtgacccccagctccctcccctcctgtcccgtgggtgacatgtccttcacttacgtgtgcccattgcattctcaagtggctgcagtgtctcagaccctgctgggtaatgcctaataggcacaaatgcagttgttaagaaaatagtcccagagtccttctagagtgtacaggccatctgggagacagacaaatatgattacaaattgtgatgataaaggctctgaaggaagtaaacagcatacattaatagagaataacaaggggtagctgttagggatgaatccctacttggcagaataattaggaaaatcactccctagaggtggagtcatgtttgagtaatgtttggttaactgaaagaaggctagtatggctacatggtagtggtgaggaagtaacaaaaattagagcggggtagcaggtaagggtcagaccagcagggacttgaagaccaaggtaagacattttttactttattcaaaaggaaaaggaagacttttaagtagggaagaattttctttcaatttacattcttaaaacaatcctgcgggctgccaagtggagaatggactagaggcaggaagagtggaagccagcatccagataggagactcctagagtggtcccaatggaaaccaatgagggcttgggatgcagcaggggcagaaggagagaagatggtagattctccagatatattttcagagttaaaagcagtaagacttgatgatgaattagtcatggaaaagtaagggagagagttaaagatgactcccagacttcctgctagggccttagtatgataccatttactcccatttaccaccgtttaagaaggggctgaggcaggacattccacgcatgtccaaaggtcccgaggtagcaaaaaaaaaaaaaaaatgtatctgtttgattcactgaaagaaggccaggaatggattcaagaatataccctttactacaataaagataacattcatgcagtacacatgtttgaggttccattagataccaactcttctgctgaggtgctgggggtaaaaatacatacatgacctagtacctgctttcaggtgtctcacagtctttattagtctctctctccgttttttttgtttgtttgttttttgtttttaactgtactcggaactgcagcatctctttttttacactttaaaactagaaccttgagctaagggaccatagagagaaaaaactgtgctccatggtgcacttaggttcagctactgtcgcggagcagctttttggtgggggaggaaaggtgtgtaaaaagatattgtctgcctgaataaaattatacaaagatgctaaaggctacttacctcaaaatgagagaaatgtacagatgggacatctggctgatttaaaaaagtaaattttactcccgtcaaattcactgcgatctaagatatttcctggattataagcagtgcgattgtagattatcaagtgatcattgtagcttcacttggggaagaatgttcttggctgaaggttgcttttctgtaactttctcaagtgtgtgctttcccgggagcatggtacttgcttggagatcagagagagtgtcgatcgagtgtgccagcgtaagtgcagtccccaagtgtaccaggtgcaacttagtgaaaccttttttcacctccatgcaaatgaactttaagagaaagtaactgcactaaatccaatttcacatttaaaagtcattgagtcagaaaacttacttgttcccttctattctcgaatgttacatattttgaattcaagtcttctgatgcagattgagtttcctccattcatttgctcttcattcagcaaatactgattttggcacccaatttgtgcccaggtattttttttttagattctgacgacataaagatgaatgatgctgtattagttatctcttgctgcataagaaattatcccacaaattaggagctttaaaatagcaaacatttattatctcatagcttaaaatagcaaacatttattatctcacactgcctcagggtcaggaatctgggaacatcatagactggatggctctggttcagggtttctcatcagattgcagttgagctgtctgctggggccacagtcacctcaagactcagctgtgactagggaatcagtttcctggctcacccatgtggttgtggacacgtctgagttcctcactgactgttggttggaggcttcccgtttttgccaatgtgggcctctccatacccagtgcctgagtgtccttatggcctggctgcaggcttcctccagggcaagtgatcagagagacagaagcagcagtgttctacctaacctcaggagtgctgtatcaccacttcttcagtatgctgttgatcacacagaccagccctggtactgtgtgggaagggactacatacgagtgaatactagaagggacgatcatcttggagcctggctacagacatagagcatgctttcaaggagctttcaattgacaagaagatgttgaaatgtacagtttgcaactttcttgccattatctcctaacatcatctgtacccagtatgtagccctgaccacaatgaaaaaatcttgccaagtgggaaaatgacaaccacttttattaatctttttattagcgatagctagatttgatgattgatgtaagctgttactaactataagttatctagaagtcagttacaaaggttttacaactttaggaattaagtgatggtccataattccttacctgaaacccttgaggccagaatgtttttatgttttagaaagggatctaccatatattatgttatattcccagcaagatccatgacaaacaaacacattaagttcccacgaacacattaatacttacacagcaaaagttatgactgtttacactgtaaatataggaataaatgtagtctttataaataaagcctaaaatcggcctccaggatttttttgggttttgttgttgttttgttttttgttttggttttgcgtttttgttttttgttttttgtttttgttttttttgagacagagtctcactctgttggccaagctcgagtgcagtggcacgatcttggctcactgaaacctctgcctcccaggttcaagcaattctcctgcctcagcctcccgagtagctgggactacaggtgggtgccatcacacccagccaatttctgtatttttagtagagacggggtttcaccatgttggccaggctgctcttgaactcccgacctcaggtaatctgcccgcctcagcctcccaaagtgctgggattacaggcgtgacccaccgcgcccagcccagttcacattaggttttgtcatcacatgaatttgcatcaagcttgtgaaaaaacttttggttttcagcacttttggatttgtggaattgcagataaagataggccctaaactgcaaagatttaaagagccaagacagcccatctccttagaagtgctgaagtgaggctcccatatcactgctgatggcatgcaaacgacagactggagctggcctggcgttcttgtcaaggcccttaacgcattcattgagtttggccttttttatgtccctggttaccagctgcttgtccagtaaagatataagaggaaagaccctctcgggaatgccaaggggcatctggtgtttagagtgcctcctgctggcttcaagactagcccagctcatataaaatgtttccagaaggacagccagccaagagaggaacaggccaactatgttcagtctctacagcaagaagcacaggatcttccacagccagactcaacgatttcatgatgcaaagtcagattgaaacagcggtgctcaccatgcttccttccctccttcctagttcacctgaggaatgagacccgctcctgtcagcagtaggggctcactgggagcctcccagaccctcctggaagtcatgcagaggttggatattgctcatccccaagagatttagggcccagtccccagagtcaccacttaaaactctctggaaggggctgtatcctgagtacagtatgtggtctcaggccagagggtccccaggctccttttgctgttcaatcaaaacagccctgccttgatttttttttttttttaaaggttgtagtgtttgaatgtaacctttctttgaaaagaaaaattcctgaagtttaaaagtgaaaaaaacatactggaaatcactggggtgggattcagttcagttatctgctctataaatgatcactaggaaggagggaggcagtgaaaagaccagaagcacagtgtgggccagcacacaccttctgtcttgcatgttactctccatgcattgagtggtgagttgttcccacaaagtcctgtaaggtagaatttatttttttacctaaaggtgaagaaaatggaaactcaggaaggtaaaataacttgcttaaggtcacaccattagtaagcagagcagtggaagtctctggcagtttgactttctgtgcagaataacaaaatgttaaagtaattttttcattattttttgaactgagcactaaactagacaaggaattggaagaaaactcaaaaaatattttatggcgttcaattagctcgtaatctaaggagacacacgttccacatcaaaaaagtaaagagtatatttcccaagaaatatgtcaacaaatgaagaccagtgcatgtggagaaacccagtggtggggatggagtgttaggggaaacgtgtctcctgaggagtgaggttgtcagtgattctcagtccgaggggccttctggaatcatcaggagagcttattattattattattattattattattattattattattatactttaagttctgggatacatgtgtagaacatgcaggtttgttacataggtatacatgtgccatggtagtttgctgcacccatcaacccgtcatctacattaggtatttctcttaatgctatccctcccctaaccccccaccccccaacaggccccagtgtgtgatattcccctccctgtgtctgggtattctcattgttcaactcccacttatgaatgagaacatgcggtgtttggttttctgttcctgtgttagtttgctgagaatgattgtttccagcttcatccatgtccctgtaaaggacatgaactcatccttttttatggttgcatagtattccatggtgtatatgtgccacattttctttatccagtctatcattgatgggtatttgggttggttccaaatctttgctatggtgaatagtgctgcaataaacatacgtgtgcatgtgtctttatagtagaatgatttataatcctttgagtatatacccaataatgggattgctgggtcaaatggtatttctggttctagatccttgaggaatcgccacactgtcttccacaatggttgaactaacttatactcccaccaacagtgtaaaagcattcctaggctgggcgcggtggctcaggcctataatcccagcactttgggaggctgaggtgggtggatcacgaggtcaggagatcgagaccatccttgctaagatggtgaaaacctgtctctactaaaaattcaaaaaattagctgggcatggtggcgggcgcctgtagtcccagccactcgagaggctgaggcaggagaatggcgtgaatctgggaggcagagcttgcagtgagctgagatcacgccactgcactccagcctgggcaacagaacaaggctgtgtctcaaaaaaaaaaaaaaagtgttcctatttctccacatcctctccagaatctgttgtttcctgattttttaatgatcaccattctaactggcatgagatgctatctcattgtggttttgatttgcatttctctaatgaccagtgatgatgagcttttttttgtatgtttcttggccgcataaatgtcttcttttgagaagtgtctgttcatattcttcacccactttttgatggggttggttttttttcttgtaaatttgtttaagttccttgtagattctggatattagccctttgtcagatggatagatggcaaaacttttctcccattctgtaggttgcctgttctctctgatggtagtttcttttgctgtgcagaagctctttagtttaattagatcccatttgccaattttggcttttgttgccattgcttttggtgttgtagtcatgaagtccttgcccatgcctgtgtcctcgatggtattgcctaggttttcttctaggatttttatggttttagatcttatgtttaaatctttaatccatcttgagttaatttttgcataaggtgtaaggaaggggtccaatttcagttttctgcatatggctagccagttttcccaacaccatttattaaatagggaatcctttccccgttgcttgtttttgtcaggtttgtcaaagatcagatggttgtagatacgtggcattacttctgaggcctctattgtgttccattggtctatatctctgttttggtaccagtaccttgttgttttggttactgtagccttgtagtatagtttgaaatcaggtagtatcatgcctccagctttgttctttttgcttaggattgtcttggctatacaggctattttttggttccatatgaaatttaaagtagttttttctaattctgtgaagaaaatcattggtagcttgatggggataacattaaatctataaattactttgggcattatggccattttcatgatattgattcttcctatccataagcatggaatgtttttccatttgtttgtgtcctctcttgtttccttgaccagtggtttgtagttttccttgaagaggtccttcacatcccttgtaagttggattcctaggtattttattctgtttgtagcaattgtaatgggagttcactcatgatttggctctctattattggtgtgtaggaatgcttgtgatttttgcacactggttcaagcggacctaatacacacctacagaactctccaccccaaatccacggaatatacattcttctcagcaccacatcacacttattctaaaactgaccacataattggaagtaaaacactcctcaccaaatgcaaaggaatggaaattataagtctctcagaccacagtgcaatcaaattagaactcaggattaagaaactcactcaaaaccgcacaactacttggaaactgaacaacctgctcttgaatgactactgggtaaataacgaaatgaaggcagaaataaataagttctttaagaccaatgagaacaaagacacaacataccagaatctcttgagacacagctaaagcaatgtttagagggaaatttatagcactaaatgcccacaggagaaagcgggaaagatctaaaatcgacaccctaacatcacaattaaaagaactagagaagcaagagcaaacacattcaaaagctagcataagacaagaaataactaagatcagagcagaactgaaggagatagagacacgaaaaacccttcaaaaaatcagtgattccaggagctggttttttgaaaagattaacaaaataggccgctagccagactaataagaaaagagagaagaatcaaatagacataataaaaaaatgataaaggggagatcaccactgatcccacagaaatagaaactaccatcaaagaatactataaacacctctacagaaataaaatagaaaatctagaagaaatggataaattcctggacacatacaccttcccaagtctaaaccaggaagaagttgaatccctgaatataccaataacaagttctgaaattgaggcagtaattaatagcctaccagctaaaaaaaggcaggaccaggcagattcacagccgaattctaccagaggtacaaagaggagctgataccattccttctgaaactattccaaacaatagaaaaagagggactcctccctaactcattttatgaggccagcatcatcctgataccaaaacctagcaaagacacagcaaaaaaagaaaatttcaagccaatatccctgatgaacattgatgcgaaaatcctcaattaaatactagcaaacattccagcagcacatcaaaaagcttatccaccacgatcaagtcggcttcatccctgagatgcaagactggttccacatacgcaagtcaataaacgtaatccatcacataaacagaaccagtgacaaaaaccacatgattatctcaatagatgcagaaaaggcctttgataaaattcaacacctttatactaaaaactcaataaactaggtattgatggaacgtatctcaaaataatagctatttatgacaaacccacagccaatatcataccgaatgggcaaaagctggaagcattccctttgaaaactgcaaccagacaaggatgccctctctcaccactcctattcaacatagtattggaagttctggccagggcaaccagacaagagaaggaaataaagggtattcagataggaagagaggaagtcaaattgtctctgtctgcaggtgacatgattgtattagaaaaccccttcatctcagtccaaaatctccttaagctgacaagcaacttcagcaaagtctcaggttacaaaatcaatgtgcaaaaatgacaggaggacttttaaagttaagtcagaaactctgcaaattgttctgggatagggctgggcattggtgtttgtcaagctccatcatacgctaaacagtaaaccaccagtgttgctgatctgcagtcagtcagttccagtgtcgaggaaatgccagcgagcctgtgactgcagcccaggggcttcgcaaagaagctgaggaagggaggtggaagggggattaccaaggacagagtctgcccaggcaggctcttgttcagtttatttatgaacgcttgtgtattttggtggtcattagataaatgtgctgctttaaactatcattttttgacatttttcactgaattcttaatgtgaaaaacaattgagacatgttaaacccgcaaaaagttgaaacaagcacaacctgtaccttagagttgtgctaaaacctcaacacagtcttttggaccaatcatcctaatactgaaactcagcacgatgaaggcatgtttaagcaaaaaccttgtcatagtagggaatgctaagagctttaaataggtactgacaatagccccgagattccccagggtgttctgggtcttcccttttcttcctgtgaatgctgctggtccactgttacctaccccaactctgagaacaaaatagagagtgagtttgaagaaaacctcacttttattttacatctcaggctctttgccctgtgaagtaaaagtacttttatgttttctttatggttttatgaaaattttctagaagataagcgatatttcttcattgagtggcatggcctctctcgggatggtacaaccgagcttcctcatttagcgcatctgttttgagcctgccgtgtgccatgttctgtgctaggccctggagaggcaaagacacctcatctattgggagaatgacaggcacatgatgataacatgacttcataaatgccatgaaagagatgtgtgaaagatggctgggagccgtcagtggctgggaaagatgtgcaaggcagcaccaggcaggtggagacttgagggattctggggaattgttaacaagcagggcattggggcagatggcacagcctagagagtgctcgctcaccgggagtccccgtggctggggtggacaggaacagcgagtgagattgctggattcggggttgagctcagggcaaaggtactacagttggacttactgcgcttcaggggaggagtggtctggggcctgcaaaggatggcctgtcagctcagcagtctgtgtgctttctagagtattgtcccctctgcatatgtaaaattttgcctgcatgatgtactgtagggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggtgagtgggcagggttccggagacgtcatgtatcagaaagactagggcatcttcccaggcaatcccaccaccttgggattggcctcagctgcagcagggttcggggtcaggggccagcattcactcttggccagcgggcagctaggccagtcactcgggctgcaaactgcagttttcccagaggcattcagacttctggcttttgtgtgaaaataccatcatctgtaaaggcctacagaaaggacggagcttgtatgttccgtgcctcttcctcagctcatagaaggggctttataccgacagtgaggccgccccatggggttatttggtcagggtggctggagggggcggtggtaatctgagccccttctgcctccctttctccccctccttctcattaatgttttactttgggccttacaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtt

SEQ ID NO: 36486 - DNA, 12358 bp, Homo sapiens
gagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaaggtaagtattctctgtatatctttctgtctcttcagctctgtctcttttttttttttctctctctctgccagcctttttcccctctctctcagcttgttaaggttatccttaaattggattctcagtcatatcaaaagtagaaggacaaatgtataataacaaggtttcatctctgatcatatgaatgagtattgcagagccatgaatgaaatgtccttgtttgccttttttattttagcattttgtattatacatattttatcattagacttacaatgttaacaatgtatattttaaaataaaccttgaattcccatacctattagtaaattgtgtcaaaagtcttatgaaacctgtttcgttttctaatgaattttctgccagaaccaataaagagtctttagtcatttaaaaccttaagattggcatttcagattctgagtagtttatagcttattcacaaaaacaaaaagtagttttttgcctttcttatagcaaggctagtttagactgaacaagacagagttgtgactctcagaagcagaaggcgcaggcatttagcttctagttgtttttggcattctgcctggagaggaaagaattttcctgatgtcataaaataccagaacaagtttttagcttaattgtaaacaataattttgtgccaagaaaatgaaatctcagaaatacaatttttgacctaaaatggccacctagttagaataattactgatttacttttagataacattatttatttagaaattttactatctaggtatagagaaaaacatgacaacttccctttcctctccctgccatacttttgttttttgcattgtgagatcaaaaactagtgagcacagtaaaggaggataatttcagattatccttttctcattctgcattttaaatcaggtttgtccatcacttccatataaacggggctatgaagtaagactattttaaattgctaattgataacacaaaaaactttaacttgtactgttttggggattttcaacttttaacatcaggactaagttattttattattagtttttctcccaaaatactggctttcaaatcactgtagctatgaaaacttgttatccctttgattcctttattacatttaacatcaaattttcctaattagaaatatatccttaaaatatagtcaagcagtgactgcttattttgaatgaaacaaattaaatgtagacaagcagggtgattgtatatagagggttttttcctttttgttttgtttagcttttttggtctatgagttgcccaaaattgaagtttatgttgcaggttttggtgtggtgaggacctacagtgtcaggttcttacaaagtaaatattgaaaaaggcaaatactgggcagttcaatcttgcatgatacctatggccatattacccaaaatatcatgacttggtttatctcaaaagctaagcaggattctgagatactaccaataatgtactactatttctaaaggagtaattttgtaattttgtaaagaaattcacaaacatggaatgacactgtgaattcctgtgaaaaagcagatatccactgctttgtatttaaaatattttgcaacaattcactgatagctcaagtttgtggctaagccattggatccagggtttagtaaggatatttgtcttcagaattttcaagtcaccaaatgatacatttttcttgatttaacattatctcttaatagtgcttttctagagtgatttttctcatttaatttttattggtcattacacaatgagtgaattttttaaaaactaaatcaccctgaatctgtataccctgggtttttttttttaacttacataattgatataagtgatagaaggaaagagtgaggagagaatgccttttttaaaacatagaaatatattatgcagaaataccattctctagttataggttacttgaaaatacaattgaatgggccaggcgccgtggctcatgcctgtaattccaacactttgggaggccgagacaggcgatcacctgaggtcaggagttcgagaccagcctggccaacatggtgaaaccctgtctctactaaaaatacaaaaattagctaggtgtggtggcagacacctctaatcccagctacttggaagggtgaggtaggagaatcacttgaacccaagaggcagaggttgcagtgagccgagatcgagccactgcacttcagcctgggcgacagagcgagacctcatctcaaaaaaagaaaaggaaaaaaagaaaatacaattgaatgaaagttatttgaattattttttagaattattcttccttcacaggaaagtattatatttgtttgccgtttattcagaatatctcatttattctattaaaaaatcccatttagatacactgtgaaagtaggggaaaacattttttctctttgccttttatttatctccagacgtggttccataggtgtctccagtagtaacaaaacactgaactttaggactatggaaacactattaatttacctggtatccttcttcccgctccccccaagttattacagtcttgggacttagagctgggatggtgggaataaggaaccataaactgaaaagtatgtaagttgcatatgctaaatttatgtatttaggagtgaaagaaccagtaatccagaacacagtatatttgtgttctgaatattcacaatttaaaatgctttgttttaaaaacagttggctagctgggtgaggtggcatatgcctgtagtctcagctaatagggaggctgaggctgaaggattgcttgagcccaagagtttgagtccagcctttgcaacatagcaagaccctacctctagaaaaagcaaaggaaagaaaaaaaatacggataactcaaatttacttttaggaatctataaaagggaaacaaaaacatgtccacacaaagacatgtacctgaatgcttatagcagcattatttataatagccccaaactggaaacaatctgaaagcaccataaattggtgaattaaacaaaatgtgctatatacattcaatgaggaactatttagcaataaaaggaccaatttgtgaaacatgctacaccattgatgaacctcagaaactatgctaaattaaagaagccagatgtaaaagactatatattgtatgattttatttatgtgaaatgtctggaaaaggccagtatatagaaaaagaaagcagatctttcttgcctaggacttgaggtgggagcggggattagctacaaataagaactagagaattctttggaatgatggaaatgttctataactggattgtgatgatggttatacagctctatcaatttactataatcaattgaattgtatttgtacaataggttaattttatatatgtaataaatctttttaaaaataaaatttctctatagttgaatcatttgaaaacaaaaaccacagaactacagaaatttaaaattggattctgaaccactctctaaagttttaggtttagtcttgaatagtttagtggatgtcaacaaaaatttgtgttaagagatttaaaagaaaagattttcaataacacatcctcatttattctagttttctaatttttctttttttatgctttccttattttgttattgcatatgatttattcagtaacttcaaatattaaaaggtagtgtttaaatgataaaacttgtatttattaatctttatactagttctcttctgttctttaacttatatatttagctagctggattttttttaattcactgtgtgttctaaaaacatgtaagtaaatttgatttttgtgaattaaaactgtttaaaaaatctcagaatctcattatttgataactgaagtcttgctgtaaatctggatttttacatattagatctccttggatggagtaagagttattaaagtattatcatgtttttttctttgcaatctgaatttttctccagtgtttcttcttttggaaacttttagtcaaccttaactaattagtgggaatcattgttatagatagtattccaaacacatatttggtttgggactgcaaactggttgactggttagttgtaaaataatagcagtcttgctaaatcataggcaaatgttgcttctctggtgcgttttttgatcacacaaagtgatgacgatgtctagaaaacattttgaatagcagagggaatccaattggatattaaacatttccattagcgttcaaaatgtacatgattaagaactgaccatatagttaatgtgacattacttataattttatgtgctagacaatgcaagtgatacttgcataataatgtatattaaagtggcatgaattttggtaggatttttttcttttttttgttgtttttgagacagaatcagtctcctgagtagctgggattacaggcgtgcgccaccacgcctggctaatttttgtatttttagtagagacgaggtttcaccatgttggtcaggctgatctcgaactccagacctcatgctccacccaccttggcctcccaaagttctgggattataggtgtgagccactgtgcccagcctaggatttttttcattcattagagtagcttcgttctttgtctgagctgcatagttgactgtttaatagtgtctaggaaaacctcaaagctgcattggagtctttttatcagctttggtaagttacttcagactttgtatgaatcttctcagagactttgtaattatgaccgaattgccctttttggcagaggaggaagaggttttccagaaagccaaacccatgatgtaataaattaaaacattattctttcttttcatgaattcattatgggtgcaagtatttaaattttgtcttataagaggctagattgggcaggctgatttacccagtttacttaactcagttaaataattatactcccttaagtctatgggatgaaggataaaattatttaaataatttaagcattggttgagtcactttggtcatgaccttgagctacatattattctatcattaaaaaaaaaatctgccattacctttttaacatttggagttataattatactactaaaatttataaaagggaaatttggatgagctgcttatgaaaagatcttgtcctgcttatacttgtcattctacaaggaatttccctaactgctatttggatatattgttcaatacatattttggcaattttcagattattaggtctctcttgatctctccagatttctattcatggatgaaggtaaaaattttagatatcacttgagaccctgttagatgaaatagagtagatatataccttttaatggaagaagccaaatgcagaataagacgtaagcaaaactaagtttctttaaagtatgctgtgtgttagtggcattttaaattgttaaatctctcatatatgtatatgtgtgattatattttacattgtttttgcttctgcctttttctctgtaccgatactcaagacaccttttttagttttgatttagaaggactttaggaattagttcattcccttcattcactaagcatgaatacctaccattttcagccctgtatgcatgagcagtgcaaaataaatatatttcctgccttcaaatcactcactgtttggagatattagaatctcctagcttaatctgttggatttttcatagttttatgatttttagattcttttcctgcttgtttcttgatctgtattgaccccttaaaagatcaccatactgttgttttttgagttttagtagaacatttctttcatagtggaaaatgttgtttcaaatataatcttttgtgggttaaatattacttagtggaacccttaagcaaagggtcaaaaagtcactatattgttgcctgaggtggactgttcacaagagacagaaataacccatatagaggccttacgtgtcaaagtttacagctcttgatttcagtcttcttacaagcattgaaattaatgctaagatgtgatatgcctaaaaaatttggtatctagagtaggaatgacaatcgtagtgtctaaaaaaccatttttcatagaatgtcctcattattagaatttttttcactctctgacacagagttctattttaattcttttttttttttttttgagatggagttttgctcctgttgcccaggccggagtgcaatggtgcagtcttggctcactgtaacctctgcctcccaggttcaagcgattctcctgcctcagcctcccaagtagctgggattataggcatgtgccaccatgcccagctaattttgtatttatagtagagacggggtttcaccatgtagaccaggctggtctcgaactcctgatctcaagtgatccacccgactcggcctcccaaagtgctgggattacaggtgtgagccactgcacctggccctattttaattcctaaacagtaaaagatgatctgaaataaaactagttagaatgaatatggtatttttattacattatatttttacatatttctattttatttatatataaacagtatgaatatggtattttatattttgctatatattttattaatatatttatatttttaaatgttatatatattgtttgattgtaataaaaattaaagatttaagttctgcactttgtgttgattgctgaagaccttccaactgacatcttttaaaaacttatatatttataagtagatacttatataatttatatacttcagcatgccagatcagtagtttataaggagttcccagttttattttctttttcttttcttttctttttttttttttttttttttgagacagagtctcacactgttgcccgggctggtgtgcagtggtgcgatctcagctcgctgcaacttctgcctcccaggttcaagtgattctcctgcctcagcctcctgagtagctagtattacaggcacctgccaccacacctggctaattttttgtatttttagtggaggcggggtttcactgtgttggccaggctggtctcaaactcctgacctcatgatctgcttgcctcggcctcccaaagtgttgggattacaggcatgagcctctgcgcccggccttattttatttttcttacttacccgtggaacaaagaatcaggaataaatattagagatgctgatttggccggaagcagtggctcacacttgtaatttcagcactttgggaggccaaggcaggcagatcacctgaggttgggagttcgagaccagcctgaccaacatgaagaaacctcgtctctactaaaaatacaaaattagccgggcgtggtggcacatgcctgtaatcccagctactcgggaggctgaggcaggagaattgtttgaacctgggaggcggaggttgcggtgagccaagattgcgccattgcactccagcctgggcaaacaagagcgaaactctgtctcaaaaacacaaacaaacaaaaatgctgatttggaggaagaatttgaaaacttaacaatttaacttaggatgtaatcatcaagagttttatagctgttctgtatttagtaaagtggcatttctggccaatattaatacattttaatgtaagttagccaaaatttattagcaatacagtttttgaaagtttaacttttaagagttgcaagcttttttctaatcatgcttatctcttcaattagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaatagtattccagcagacattgtttttatcattaaagacaaagatcatccaaaatttaaaagggatggatcaaatataatttatactgctaaaattagtttacgagaggtaagttggtaggacctaaaatcctaagaccaaataattatgtagttgatcatagggagtgtatctagataatagctaacatttatttaatgcctattatacgttaaaaataattactataaaaatcctctaagatagtactagtattatacctcttttatggatgtgattatattttctaactttagttacttataattaaagtgtcaagtgttaactggattatgtactatgaggctgcttttacaaatgtggtttatgagatctgcattggtaatctcaacacattagtctttgtatatagggtttgttctaaatttgttaatatggagtaataattgcataccaaaaaagattagaagaaaataatttataattcactacaaatttgtatacatttatattaataaaaaatacatttataagtgcatataaatatatacatttataaattataatgctactatgttaatacaattattatttgagttcttatttgcactatttcttttttttttttgagacagagtcttgctctgtcacccacagcgcaatctcggctcactgcaacctctgcctccgggttcaagtgattctcttgcctcggcctcctaagtagctgggattacaggcgccccccaccacacctggctaatttttgtatttttagtagacacagggttttaccatgttggccaggctggtcttgaattcctgacctcaggtgatccacttgccttggcctcccaaagtgctaggattacaggcatgagccaccacgcctggcctatttgtactatttctcaaattggattgtaactttgcaaatatggtcatagcagttccctgcttcaaattcttaaattgctctatataacctctaccataaagtccaaactctttagcttaaaataagtcattttaaatctgatgtctacccataaaatgtatatgcacttccccaagtttgctctattattattattattatttttttgagatggagtctcgctctgtcacccatgctggagtgcagtggcacaatctcagctagtactgcagcctccacctcccaggttcaagtaattctcctgcctcaggttcctgagtagctgggattacaggtgcccgccaccatgcccagctgattttcatatttttagtagcgataggttttcaccatgttggccaggctcgtcttgaactcttgacctcaagtaatccgcccacctcggcctcccaaagtgctgggactataggcatgagccaccgcacctggcccagtttgctctattattatcttgtatacttgagctgtactctatggaacactattgtttcttaccctgctctaatacctacctgctactgcccaatgcttagttcaagcatcctctactcccggaatctaaggggttaagttgggtgctctttctcttacaaaagacctccatgcttacctctgttcttacactatacagtattataatggctagtttgcttctatgtttctgtgagttccttgtgcattccttgagctggggtctgtgttcatggtccctataaggctcaccatctagccagaatgtgtggcatatagtaaatgctcagtaaacatttgttatctaaaacaaatatatttcttgtcctaatactttccagagaaatagttgctcctatccagttctttctagtcctgaatttctccctcttctcccattccaatccctgcatcttgaatatattaatagcagcttcaaaataaccatgtcattccagggcaatgtggaatatatcctttacttctcttttaccttttcttttcttcttcttttttttttttttttgtaacatatctaataatgcatgtcctgaaggaattttcctttttttcttttcttttctttttctttttctttctttctttcttcttttttttttttttttttgagacagttttgctcttgttgcccaggctggagtgcaatggcacgatctcggctcactgcaacctccgcctgctgagttcaagtgattctcctgcctcagcttcccgagtagctgggattacaggcatgtgccaccacgctcgcctaattttgtatttttagtagagacaagatttctccatgttggtgaggctggtcttgaactcctgacctcaggtgatctgcccgccttggcctcccaaaatgttgagattacaggtgtgagccaccgtgcctgacctctgaaggaattttctaatgaggaaaaaaaatttataactattgttattcttttggaggttaaagttttaccttagtggtattatcctttaccatctggtaaaatttgtgcttagatttttgagttttgaagtgttttcattttattttatttggtccattttaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacgtggtgaccttctaatagaatttgaggtgtccttcccagatactatatcttcttcatccaaagaagtacttaggaaacatcttcctgcctcatagaatgaagaactttgttacacatattttgataaggcactgaaaatataaaaggactggtagtttactgatgtagatgtgaattctgtataaagatgtgtaaattcttttgagggttcattaaattgcatgaatagagacgggtcaaataaataggcaaaagggatttttacagttagagataaaagagaaaaccattcactgtattttatttcatttctcctgattcagatatttttagtaatttgcttatatgtaaaagttgtttttgtggagtcagtggatatatttctaatgaagtgctagactatccaattacttaatttcttatacctttagataatcagtatgaaaagttcccatttataatggaaatgaaaattcttaactaaactatacatgtaatatgtatttctagaagagaataaaaacccaagtcagttattagatttaaatcaccttctgaaatgctgctatagggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcattttgttctctgctagtttaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatggataatgttgcaactacttgttatgcatataaatattttactttttcacatgtatagattgcatttcttaggtgttttaattttttaaatatatttatgtttt

SEQ ID NO: 36487 - DNA, 12358 bp, Homo sapiens; identical to SEQ ID NO: 36486

SEQ ID NO: 36488 - DNA, 639231 bp, Homo sapiens
gcgctccgcacctgggcactcccagcgatgcgcagcggggcagcgccggccccgccgatggagctgctgttgctgccgccgccgccgcccggagcgccccgctccgcccgcgccccgtgcgcctgagcaccgagctcgcccctcctccgcgctaactccgccgcccgctccccaggccgcccgcgctccccgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgcctgtgagtacccctgccccaccccacgcgggccacccacctgggtcccaccgagggggccccaggcgccagatccgtcctttcccctcggcctccctggatgcagtctctattctcatcccttcctggatacgatccctcactctccgagctgggggtctgtaggcttggtcagatctggaaagagaggtctcgaaacccccagcgatgggcaaagagcagtgcctctccaggggtgagggttccagacgcagggcccgctgacagcttccaaggagtagctgaggagaggcgaggggaggcaagagcactgcagcctcaaggtcttagggtgagggtcaggggtctgcgctcgttaaaaaggggggcgggcgaaggagaaagctataggatgatgggccgtcaaggcgcggaggcgggagagagggcccgagactgttgacctgcttggagatcagaatgggccagccgctctctggctgcccttgcaaggaaagttgagagtgtgggtgaaggtttaacttctgaggaactggacagattcagagtgggtgctcgcaaaacccgctctgcctggagcgcagtctgggagatgccaagttgcagccccgggtgaattttttatggctcggttataaatgcctccccgaacgaaggggccggagaatggaaatgctgacagcccttcaaatgagaccgagcgttataatcttacaaaccgcactcagcctcagatcctgggcttggcagcgaatggagaggcgcttggagaatggggtggattgaccctagttttagccccaattgtgcaaccaaatatttacttttcatatgtcaacgttttggaaacatttatcattttgatcctcggaccagattcaaaacttggactccggggtgggctcctcttagtccgcagttggggtggggtaagggagtgggggagaaacgctggagtgggtgggaagccttactgggaacccagccgagaagtgggtgagggtttgctctagtgtggtagattccctccgtgtcttgctctccctcttctccccttcctcatgtgccttaggggtaggcgcctggatcttccactctgctttcttgacttcaggctggaagagagtagtgatgacaagcattgtcctagagtgtgttattcctgctagtcacctcctatcaccccacctcctcttctcttccacttctttgtgcatctctgggtggagactcagcagaactgtcttccttattcctggtgctctctttttcctttggctcagtacttttttgtttttccacaagtgcagtgattgttttgttgggttgaaccacagaatcctaaagggtgagagccgaatctttattaacacatgtcgaaaaccaggcttggaagtgtaaaatgacttgcccaagaaaacacagcaagttgacggcaataaaggggctagaatccaggttttcacaccttaattcagacattaagttagtccataggagtgaaaaacttgttttagtggtatttttagatacctataacttgtaaactaagttcccctcctcgtcacaccagtgctagccacatgagttagtgaaataataattatagctaatgtttgataaatgcttttcatgccttgatttgtgtatatgtattatctcattgaatcactccaacagtcctgttagttacataggcaatgcttattactccctttcacagttaagccatcttgtcatttactcaaggtcgtgcagctagtgaagtgtttggatccaagcctgactggttcctaagcccacaaccgttatcactctcctggtcatccttggaacaagggtcagtttgggccacgatctataaacagacagtcttgggagggttctggctgggcttggatcttagaataggctgctgttgcttctgcttctggtataccctgcaaatgttcagctcactttgatgttaggtctgctgcttggggtctcgcaactacatcttccgcatcttcaaaatcgtgctccatgtttgggaaaccaagaagagtaagtccctctcctcctggtgtgtaggaagttttccagagctgcaggaaccgcacccatgccagcatgccaccgagtcatcttccttaggggatctgtgcagctcagggcaacccatcagctctagaactggagaaacaggacagagactggagtcctggtcattcccagaggccccctgctgcagtcgttaataggcagtggcagagcaggagcttctttgatgtctctggtctcttctgcctcagttgtggtcactggtgccactttggccagggtgcatgggggtgccgcgatggtatctcattctagtctccttcctccctgggaatgggggacagtctgtaggagcaagctgggtcaggttcactgcagggtttcagggcaacccaccaacagtccttcaccaccaaagtcctgcaccacactctctctcagccaactcaaatgtaacatttcaattctgaaaactcttgggggatatttggcatttttactctctgccaaggatttcttcagaggaatcactcatttattcctgccttcattcattcaacaaacattacttgaagccgggcgcagtggctcatgcctgttatcccagcactttgggaggctgaggtgagaggatcgcttgagcctaggagtttgagaacaaacatgacttgaacctctactgcattccagaaactgtatatagaaccattgcaaatacagaagaaaaccagcacttcaatgtaaagaatgtaagcaaaagatagaaggaaacttgctttggtgagccttttgaacttcccagggttcatgttgccatggggcacgttttgtcagcactgtcatcagatgctcaggaccttcctaaaatccagttttctgatctcaaaggtttaaattgtgttttaaaacaaagaaactgcattttctccgttctccattcttggtactctgcctcccaaaaaggctttgatgaagggatttgtgtgtgtgtgtgtctgtgtatattgcttctctggatgtttttgacttctgaaaccttgtgttatgacattaaggaaaacctgagtggggataatgtgctcaccatttggactttgcttcaggcctggaatggggcctcaattgttcataattaagccagaatcagaattggggggtctgtgttccaagatcttccctataatgtcagaacatcacgcagaaaaagaaactctgtcttttataaactactgacaatttttccccctccatgaggaggtgacacccacaagaaagctaaataaatgcagagaagaattcagtgtaatttattatccgtgcagcaaagatagaggacgagaggagaggaagtggatggcggtgcctgaaaccaaacatttaccatggagcacagagtaaacagatgttgcacttacccttctgactacaaaaggagcccacagatgtaattcttctccaaccacaatctcagcctggaaaaagaggaggcagatgaaaatgaactctcacacggggccacttctccccatcttgccgtccttgtctagaggcaggcagaggcccacttctcactgcagtgaggggtggcctgaacggtggagtgggggcaagagtggacatctttggtttttcacttggctctggaacatgctggagactgctgtatttaaataaacatttcctgtttgcgaaggagaacgggcgaaaggctgaaacgtgagaatgtggtaacttaattttctccatcactccaaatgacggctagctttgccggtggttgggcccaataaaaactgacaccatgtcataggctttccctcacttgaccacagaggtcctgaggtcaagtgagagactttccaagatgctcaacagccaagtcctctgtccagccctcagggccagcttagaggacaggaacaagctagtgaatcatggggtctctctgggtcaaccacggtgatgtggccttttagggaaacacagtgccctcctggacagactaaggagcagctgagtggacccgcctccagtggaccggtatagcctccatggtgctgtgcaactctgaacggattacattacctctctgggcctcattttcatgaaagtagaattcttgtatagtcttagtggttttcttagtggttatagtccactgggggaactgtaagtatccgcctccctagtgtctagaacagtgcctggcacacagtaggtgttcagcagatgtgtatttaataaaggaataatgaacctcaaaactacaagtctgtctttagttcttaaaagtgaaagatgggccattatagatctgcattctggcatatgactaagggatcctcactagtaacctatgacatgagttattaagggtatctaaaatttggattttatgaactaatatttattgccttactagagttaccaaggactcctgttgagtgatctactctggagtctggttgccaggcattgcttagcaaccttgcaaaactcctactgtgcacatgcccatgaaaagaactggaaatcctgagcacttaaaccacagggctttctaatcaggaactcatcagcgtcatcctgagtgctctgtgggttttgattgctgctcttcttgtattaattgataagttctgcttttgttgatcatctggattttctattatttctgcatttttgccgttttgattgttatgttgttttctctccagtattgtttgttgtcacagagttctgtctcacctggaaagtgagaatgaacagtgggttgcagctgtagaacctcttgccttggcaatgtgggctatggcaagaaggttcccgacccctaagcatcgtggttagggcaggcgctccggagacagacgactgtgggtttgaattgcagctctgttacatcttgctgttgcactgtgggcatgttacactattgctgtggactgcagtgtgttaaattctttagtaccttatttccacacctgtgataccaggatgatgagcgcacggtcttcatggggatgctgtgaatgtagcctgaggcagtccctgtaatgtgctcagcacggtgcctaccatgttgttcactcattgctgtgattgtttatccctctatgatttcttaactgtaaaatatgtatgatgactctaccccattggggggattaaacaaaataatatacaggaaagtgcttaacacagtacagtcatgtgttacctaaaatgacattctggtcaacagtggacaacatagaggacggtggtctcataaggttaaaatggagctgaagaattcctatcgcctagtgacatcgtagcttttgtaatgtcatagtgccatcactttatttttaataaatttagtacagcctaagggtatagtgttgacaaagtctacagtagtgtacagtaatgtcctaggccttcacattcactcagcactcactcactgactcacccagagcaacttccagtcctgtaagctttattcctggtaaatgccctgtgcagatgtaccattttttatctttcataccatactttgatggtaccttttctatgtataggtatgttgagaaacacacatacttatgattgtgtcacagtggcttacggtattctgtagaggaacatgctatgcaggtttggagcttaggagcaataggctatcacatctagcctagacgtatagtaggctagaccatctgggctcgtgtgagtgcactctatgaggtttgcacaatgacgaaatcgcctaatggtgagtttcttagaacgtatccccatcattaagtgatgcatgaccccaccataggagccctccctgaactattcatgttagtggccatggctattacctttatatcttcatctcaggccctatccagctggaaggtttgagacgcccatcctaaacttgctccaacccagagccctgtggaagcgacttccttgcctgcctgtgggctatgcccaataccctcttggctaggcccctccttttctctctctgctcttggtcctgcccccacagcagagcccaggttggcttctgttccataaaaagggaattgtggtgaaagtggtttatatcttttccatgggtgtgttgctttgtggtatatttaaataaggaatgcattttatttatttatttttggggggtgggttttcatggggaatttttggccctgactttttttttttttttcaatgctcattccttctatttttccttaaatacctccttttactgacttcccatgtctgcctctattactgtgtttacttgaaacagctgtatttcctagcaggctccaccctcattatgtaaggtggtcttaaccctttttaggactgctgaaaagaaaggaaaaacaaggggtggaggcattcccagagagctcatctggaccactgctgatcacaagctagatggctgtagagggtgccctggcactgtgctgagctccccgtgctctccgttcttcattgttctccatccttgaattcaaatcagccttgccaaggttggatgctcatgttgggaatcctctacctctctgctctgcaggcctggacggtgatctgtaactactgtgactgctggcctgtcaagaggctaacctttcttccccactcactgtggtcttcatagttgtgttgtcagtaccatgtttgatacagtgaaaccctggaaaaaaattggccaaagcgtgcatgattagagccttctgtactgcgtggacagagaagataggaaaatgtggcactagagccagactctggggcccaaagcccggttctgtcacctactagctggatgggcctcagttttcccatttgcaaaatgggaataataataatactcccttcaaaggatgctgtattaatccacataggctgcctggaaccaagggcaccctccatcaatattcctattgttattatggtcaaaagtcttactgagtgtagacctcctatcagagcatgatcaggatgaagcttcattaagaaaaatacagatcgtcagcgttggaagaggtccatttgtccaagttccaaccacacgaaggttggtcttccatcagcatgatttaggggaaggtggtcagttagcctcctttgcttgatgatatctagtgatgaggagctcagttcttcctaaagcaatttattccattaaaaaaaccacaatcctaataagaaaatgttctttgtgtggggattggacttatctctcattgattgttgtaacccagagcatgtataatcttttttccaaatgacaggttttcaaaagtcttattgctgtggtgtttctcaccacccatttaccggagtctccttaattgcctcaactattctgtatgtggtacagtttgggcataggcctcgtactccatccatagttctcttcctctaaataggttccaatcttcttggactgtattagttagaaggagaccttccatgccttcactgttttatttgacttctatcagccagcgcattcaaaagaaccttttcactttggacagccacagccctgggtaggctcattttgaccaagctgcctgacatccccatatctccccagtcttccctgctgttagcttgttgtcccctcttctagacttgtgcagttgactttttggagtctaagtgcaacactttgcatttatcctaattaacttttggcaaatcatttcatttcatcagcttttcaggagcattttctatttcgatttcctcatctagcaattaactactcctttccccatctcccactatttatttcctctgcaattttaatgagcttgccctatggatctttatccaagttgtcaatataatcagcagagttctctgtgcatttttttcaaaatctttctacaatctggcatgtggattacataaatatattgccccgttctttccggctgggatggaaaaaaatgttgaggtcttcttggcttgtagcatcttctttccctggggttctgttggttcatattttctctggaataatttcctattaatgcttaattcttcagcttgctaaattttctctatactcttggtttctcatggaactttccataatgactttagcttcatttttgtcctattaggctagtaccacaagtctcaccaacacaggatatgacgcatgtatgtgtgtgtatgttgaatgtgtatgtatatgtgtgttattctctcctggtaaaaagttcagcctgagggattgagcctttctgccagtagcagagctcaggtagcttcaggtttttaaacacagtgatttcccttagcatcttgggtacacattggcatcgggcacattttctggagtagttctgggaacagacatgatgaagaatgaagcataggggaccagggcctacagggtccccaagcctctgtaaacgacaacaacaaccatcaccacaacaatagctggcatttattgagcctttctttgtgcctggcactgctcttacactttacatgcgtggagtcatttcctatttgaagagttatgtgaagtaggcaggactgtctgcattttatagatgtggcaactacgtcagagaggtgaaataacatccccagtaaggaacaggagaggcagggttcatccagccaggctggtctcagaggctgcactccaactcccagtcatgtcatcccttccagaatctttcaagtcagcctccttttctgtcttctaaactctattctcaagtaacaactagaagaagacaaacatgatgagttcaacttaaatcaaagagcccctgttcgaggcaaagcatcaagaagaatgtcaatgatgtgatctggacacctggtgaaacagagccatcatgtccaatttggggaaataggtggcctttgtattggagcgtgaagactaatgggatccctgtgcgtagaaatgggaacgtggtacagtcacagaaattcatgattagatgctcctgagcccaacttaaaatgatgggagctgcactttgggaagttttatctcatggggatgtttagaacagaatccaaatcttaggaaaatatctccatggtatgtgtccactaactgttttttaaatttctggtttgaggggatacaccctccaagagtagttctgatgaaccttgctgaataatattttccgcctcaagcatctactcaaatgtcggcaggagtcatcttcctttgcagttagatgcaccacttgctttctcttagccgggatctctgggctcctcccaccctggcatcaggtcttgttccaacaggatgtacataagatgtatcctggctggagtcgagtgtgactgcacttatcacggccatatcactgcttgtgtgggctcagactcctcttctcttgtcctaactgccaatctggttcctgacccctgattcattccgcactttggcagcagtgtatcctgtggctcctgaaagtctgccagcacacttaaccacccaccttgtctacctcttgggtttttctacctctctagctcctgtctgttaccagtcatatccattctttgccctagcacgtgccctagtgtattccctagtgtacaccctagcgtatgccctagcatgtgccctagcgtgtgccctagtgggtgccatagcatgtgccccagtgtatgccctagcgtgtgccctagtggttgccatagcatgtgccccagtgtatgccctagtgtgtgccttagcgtgtgccctagcatatgccctagtgcgtgccctagtgcgtgccccagcatgtgccctagcgtatgccctagtgcgtgccctagcatttgccctagcatatgccccgcacgtgccctagtatatgccctagtgtatgtcctagcatgtgccctagtgcgcaccctagtgtgtgccctagcgtatgccctagtatgcgccctagtatatgccctagcgcatgcactagtgcgtgccctagtatgtaccccagtgtatgtcctagcgtgtgccctagcatgtgccctagtgcgcaacctagtgtgtgccccagtgtatgccctagtgtgtgccctagtatatgccctagcgtgtgccctagcacatgtactagtgcgtgccctagcatatgccccagtgtatgccctagcgtgtgccttagcatgtgccctggtgcgcgccctagcgtgtgccctagcatatgccctaatatgtgtcccagcatgtgccctagcatgtgccctagtgcgcaccctagcgtgtgccctagcatatgtcctagtgcacaccctagcatatgccctagcatgtgccctagcatatttcctagtgtgtgccctggcgtatgccctagtgcatccccgagtgtgtgccctggcgtatgccctagtgtacgttctagcatatgtcctagtgtgtgccctggcgtatgccctaatgtacgttctagcatattccctagtgtgtgccctagtgtatgccctagtgtgtgccctagcatattccctagtgtgtgccttagcgtatgccctggtgtatgttctagcatatgccctagtatgtgccctagcatatgccctagtgtgtgccctagtgaatgccctaactcaggtatgtctgcatgctgtggagtccatgatcctcttctaatcggagttttatgacttgaccatagaattgtgcatgtttgcatctctccctgagctttagctactcctggctcctgccttaatccttctagcttggcttcttgccctctactgccctctatgtattctccatagccttagtattgaatttggactgtcaccatcagaaccccaggtcctgaaattggatttcatggcctggaccttcactggagactgcagacttgcaagaactcagagttctgccctggaaacaacctcagacttcgtctttatggccatctgaaatcttttatcatgtccagggtagcatgtaaaagtgccccagggctggactctataaatgatgaattacttagacatactcctgaactccctgtatcccaaataggacagatcattttgtaattaaaaagcgcagcagtgatgatctcattggagagctgtcctgttcaataatgtgttgcagaaatttctggactatctagtactttgctgacattctttctctcctcttcttctctctccagctctagaatgtaggtagaaagtgttctgagtatggggattctaagtggaattagtgagaagccaagggggagtacaatttggatgtaagccgaaatgagtagaaagacctaggctgaatcctggcttctgtcactttctaactgcccgacctgtctgagtacctttgcggtctccatagtctcatctataacctttggaatgggagaaataacactcatctcagggggctgatgcaaggtttaaatgagatcagatgtctccaaatgccttctaaatttagtgctatgcgaataccttaatgagtccacccacaatatctgaattgaaccactaaatcctgtatctggaagacgatcagggtatattttagaagctttcatttacagatgaagaaactcagggagctccaaagccttgctcagagtcacccatgtcttcaaactcttgttccagtttccttttcatttaacaagatgcatcttttacaaattaaaatataacctcataccagccatgtcagcagcttaaccaggtggagtttagaggactgggtaattaataagtgacagtgtccaagacagtaggaccaaataagggaatccatgaaggatggagtcatttaaaggggccatttattgagtgtctaccacaatgaataaagcaagtgaaatgttctggtaactagaacagttcaaactaacttcaaagttagtctggactgtctctccctctaaatgactgacaaggcaaaggctaccatgctaggttcagagcagggagatttatgggttgggagaaatgctagaaccatgaaggatgtagcaccaaaccctcaggaatcattgatgaaagcaagccccctcatcccttttagtgggtacaaatatgtagaaagcctcccacatcataaaaaaatagtacaagtggaattaaaaaaaaactcaagggggaaatattaatctgagaacaattgtatctgagaaagcattcaagtatgcctctgcagctagctggcaaacagcacaagttctgcattttattagagttctaactctgtgtagaacactgaccttatttgagaagcatttcataaacactgacacacagcacagcagcatttgaggccatgaggagatacagggccttctttagggggccagcttcccttcccctcctcggctgcaagggacccctaggacattgtttccctgagtggtaatatctttatttttctctcttaggtttaactcagcaggaggaattttcctaggggaaaatgagggagggggatttggaataaaatttgtactttgggcaagtttgcctaagcatggggtaggcgatggggaagaccctgctctgggagaaagggtctaagaaccttcacttggccagtggagtttctttttggagatctcacctggtgcctggagacctatgctgtggctgtgtcagaggcaggttctcaggcagcattcaccaggtcctttggaatgcaagacttgtggcttgcaaccgccctgagaaacgcgtccaccacatcccctcctgctagaagctggcacctccctttccatctgctgccagcgtacaagttctgaatttgtgccacagaacttggttctgttcctccccctcttgttggcttccctagccaagagattttcaggcttttgaggtatcactggagatcatctggtctactccctccccactgatctcaacccatctccaaagggaaatgcattagaaaggtcaccagagaggacctcagcttcctggtgtggtctgcccttatgaaaaggtgccttcatttctgcctcatcctgtgcaaagatcatgcagagccatgggaagcctctgccaatctgggaagctagggagacagaagagggaccacatctagtacaaaaaaaaatagggaatcatgtggaagcagaggggagaggcaccagatgggtgactcgggatggcagatcatatcctgagggctctcagcaccaagcctgcagcttatttcgagtctagagagggaagatcccagctgaagaaaacggcaagggaaggaacactgggaaccaggactggagcaggaatccaaaaatgggaaggccagttgcttcatgggagcttttaatgactctagttccctaccaacacccctccccttctaattgcttcatagcacaagatggtaaccaatctgctctgtttactctgtttaggcatacattttagtactttctgaaacatttcccataagcttccccctgccgtgtgccctccttgtacattctagaaattttgcaaagacctaagtctcctctgggttctttcctgactggagctgcatgctgattcaagccatattcagtcaggaagctctcttcccgtctttaaaacaagaaacatcttcttccaagaagactgcactacagttttctttgtctgtgttgctaacgaacaaagaggccccattgcaaaacagcatttcacgagcagagcagggctgatagcacctcttgccaaatgtgactgtgtgtagttgtgtggggggaaaatagctttgtcgagaggagggccgagggaggcggctctggggaatttttagcaactgcagcatggtgtagtggaaagaatgcttgcctgggaatttggcgacctggccgtacctctgacacaccatgtgaccttggacaagtcatttgacctccctgggcctcagtttcctgatctttaaaggggatgagggaagtagactggatgatctccaaggatcctttcagccctatgcatcctcacttctgggggctgggatttggggtttagacctgagccaatatccaattcaagagactttctagaggcaagagagaggccaggacagctgcttcgggaagtggctggtccttgattaaggctcaaataattagctcagctccacagtaagccttctgaaattaagaaaaaaaaagatgtttagtttaaaaaaatagcagtcggtgtttcttaaaactgattggcttggggctttgtaggttttattcagagacataattttgcttcctctatagtacagcagtttagattattgatgctttgatgctggagttagtgtgacctggttttgaatgccattagtagctaagtaatcttaggcatggtctttaatagtaacctgcttccctggcttactaggaagatcaaatgaggtaatacatgtcaagcttagaggacagtgtctggcattaaataatcactccaaaagccattattatggctatattttgctgcttaacaatccaccccaaaacttagtgttctaaagtgacaaccattttatcatgctcaatgattctctacgtcgtagtgcagtagagatggcttatttctgctccatacagtctgaggcatcatctgcagagtctggaatgaccaggagagacttgaatacctgggtgctagaatccccagcaggctgttcactcacatgtctggcacctaggctgggatgacttgaagtctgggctcagctgggactgttgagcagggtgtctacacatgtgacctctatgtggcttgagcttcctcacaacatggtggcctctgagtagtctaacttctcacatggttgctccacactctgagaagaggtgtgcagcaactcagaacaactcagaagtagcatggctttttatgaatggacttaaaagcaacatagtaccccttctgctctgctctgtggctctgaacagtacaagcttgcccacatgcaagggtaggggtcatctctccatgtaagaagtctcagaagttgcagctgtgttttaaaacctccacagctatatagttatgatcatcatttttctgtaccatataatctaatctcttaagtagacaaaaagttccttgaggacaggagctggcatttctctatagaagcttagtacaatgcttgtgaaaataagacaaaatcaacatattttcaaaaatcaaattgaattggataggcagcagatttggtggaaagaccaggagcttagcgccaaggagatctggattcaaaaatctgtattcaggcccaggtgcagtggctcacacctgtaatcccagcactttgggaggctgaggtgggaggatcagttgagcctatgagtttgacacctacctgagctacatagtgagaccccatctgtacaaaatataaagataacaaaattagcttggcatggtggtacacaactgtggtgctagctactcaggaggctgaggtgggaaggataacttgagcccaggaggtcaatctgcagtgagccatgattgcaccactgcactctatcctgggtgacagagtgtgaccctgtctccaagaaaaaaaaaatctgtgttcaaaatgtgccctttgaaaaattacttgtctttctcataaaaaaaagacataaagacaataatacttatctcaaggattgttgtaagaactaaggatagtaaatgcaaaatgcctaacacacattcaatgctctaactaaattacagatattgtgaggtagtgtagcattgtggcaagcacctggatactccactcagacaaacctggtttcaaattccatcacttctcattgtgtgaatgtagataagtcccttcatctctttgggtctcaggatcctcatctgtaaaatgggtactatagtaactgtcttgtagggttattgtgaagatgaggaatgcttctgtctcagaccctgacacatagtagggacttaaaatggtacctatattagccacagttaacaatttgtgttcttttgtttgtatattgatttgtccatgaatttatgcactgaacaatgactcatgcaatgctaataactcacaatggcttcatttttcaagtttctgcatggtagtgtctgctgatgcctagatctgggaagataccctcatgggatagagaactagccctttggaaaggagctcagggtcccaggtaagctgcccgggacagtacactattttgacacatccacagctgagttttaattgtccctgttggcttttgaccctagagatcccctggcttcctccagttataatcgttttgctcagaggttcacattttctttcctcaccggatagatcctgtcccttgctgctgtgcagccgtgggcaaacatgttagctcttaccttgtgtctgttttttgtcagtgccttttttttacagcattgttttattggctgaaattcagcaaactataccagccttgtctttgtggtgtcaagccaggtcacgggggttcactttcccgggtagttcctgggacctgaagctctcttaggaaccattgactacgagcttctccttttcttccctaagacctcccaggagccccaaccttaccttttctgttttttaagagtctaaataatcggataaaagacatttaccttgtctttagaaaaatgcacagacctcacaacatttcgcaaatgattttgaggccattcagtggccacttctccggtggcatatttcttctgaatgatccttgtctgtattagtgattttgattggatgaacctttggatttttgctgagtttgactttgggatcatcatgtggctgtgaaattgtcataagtccctcagtcccctccattgtagtagacatgcattgttttctggctgcctaagacccattcactctttcttcctagcagcagcctttctttcattattgggatgtcatcttctgcacccatgggatacagcctggtagatttttgatcagggctcttggcctctcctagtcaaaggctaagtttatgacccaagtcaggtcaattggatcctttctttctggaactggaatcttgaccagaggaacaaggagattggacataatggttttccatttcatctaagcactttcaaaagcatagaccagactatgcctgcttccctcccaccccgccaagacctgttcttaagatgctcattgaatccaggagttcttgatagctttctagagaattccctttcactcaagttcataagattgcaaccaaatttccaaatgagtgagaaagccacaaacaacaaacttctggggagaaaatggcacaatgagaaagattatgcgtggcctttggagaaaggcagaccaggtttgaatcacagttttaccattcaccagctgggtgcccttaggcaagttcatttttcccttaggatgtcagcatcattgtaaaataaggataatgagtcctgaagccctggttctcaaacttgcctgcatattgcaatcatctggggagacttaaaaaattactgatgcccgggccaatccccagagagtgtgatttaatgatttgggggtgctttttggatgttgggattttgtaaaccttgcaggtgtttctgatgtacagcagtgtttgagaaaattgacctcaagaaattcttcaaattatagggaagaataaatgaggtaagatatgtaaaacattcagcataatgtaaggatgataaaagtcactctgttctcctttcctgtcctttcttaaggtgaaccagaatcgcttgctgttgcttctagcacagttttctttgtttggagtagtcatagcaatgcatgacaaccacgatgcaatataacctcacttatttatcccattataggtgaaggacaatcataaatgtagccagaattatagaatatacaaaaatgtgattactttcacatccctggaataactagggcgagttcaacaatcctttgtgagaacgttctatggagtaactgctttaatggagagacataattgatttataattaccatggcaacagcaaaatggagtgatgtcttcctgagggacctggaccaggacccaggagaattctctcctaggtctgccctgcaacttgctgagtgaccttggctcagacggttcatctcataagtccacagtttccccagagcctattttctgacctgtgcatcttcaacagatttttttgagggaaatatattgaggtgacagttgctaagacaatgacgagaagaggctgtaggaggcagaatgaaagcaaggccttgagcctcatagaggagataattatagatgctggttctcccacctgccggcttctcccatatccaacaaaacctatccaagtctctatcttcaaaaagttctttctgtagagaggatgcaaggggaaacttccacgtagctcaggctttctcacttcagtactattgacatgttgggttggatatttttgttgtttggtgggctgtcctgttcattatatttagcaacatttctgacctcttcttcttagattccagctgtacccttgtttcataacaactcaaaaatgtttccagacattgccaaatgtcccctgggggggaaaattacctctggttaagaaacactggctagcccaatgtcaatgaagtatgcttaaattaataaagcaacataattgtgtgcacacagtgtttaatctctgtagtgccctcagaaatttttgcagatgtccatggagcagagatggttatcaggaatctttacatccattgtttcaggtgggggttctgagttacagagaagttaatagtaacagtaataacgactaatgctattggctcacataatttttttgtgtccatttccccccatcaattatttatgtatttatttacatacatatatgcatacaacacagtgtggttttaagaaaggaaccgcaaatacaatagcctagaggaactggacagatgagatcaatgagcaaagctgggtcgagttgagacagattcttgctctgttgccatgctggagtgcagtggcgccatctcggcctactgcaacctctgactccctggttcaagtgattcttctgcctcagcctcccaagtagctgggattacaggcacccgtcaccacgcccagctaattttgtatttttagtagagacggggtttcaccatgttggccaggatggtctcgatcacctgacctcatgatccgcccaccttggcctcccaaagtgctgggatgagccactgcgcccagcctccccctaccattttataataagattaggggaatacatatacaaatctatttctagtttcttttctaaaataaaatccagcaacagaagctcagcttggctctatggcagtaattgactggcttttatgtagatggggtgtgtctccatttcactgcagtccctaccactccctattgtgaccccaacactgagacagtacgtcagctgccatttgacattatgtttattgtcttttgcttgacccagctttgctcattgatctcatctgtccagttcctcttggctattgtatttgtggttcgtttcttaaaaccacactgtgttatatgtatgactgttctcgttttaaaaatagaaaaactgaggctcaacaaaagaaaagctattgcccaaagtcacacagcaagtcatcagcaaagctgggagggagacagacctgagcttcctacctggccagcaaagccctgcccagcatcacagaacagccactggtagagtctccctgcattccgagatgctccagccagatcttctgcaccttagagtttccttgaagaaccaaatctcagtgtcccttttgctcaccaggaaacccacatgtcaccagaatggcaagagtgtcctctgagtgtagcttcccagactacatttttcctgcgtctctgccactctttgggctgtgtccaagggctgctcacacactcccacatagccgaggggccagctggtgtgtgtgcttctgcctgagacgaggccgcttgcctgtggggaggatgtgattgctttaggaaattaagtgggagtgattaattaggaaatgtactgaggatgctggaaagaaatagcagaaaagaaaaaaaaaattggaaccctcaataccaaatgcttctggccacatggctaaggatactgcactcagtgggaccaaaagcatttgatcctgttatttctgatgctgctgctttgatagcacctccttgcatgaggattttggaaggaaccataaagtcagctggtccaacctctcctttcattgaatggcaaatgaaggcacaaggagacccccagcggaagctgggcagcttacaagaaacagcaggacttgggactcagaaagacctgagtttgaattcctgatgcatccttgctagatgtataatcctgggcaaatctccgagtctcaggcttctcactgtgaaatgaaggtagcattgatgattgccaaggatttttgcaaggaattagtgaacaaaagcaagcgtggtgactgctaataagtgacatgtgccaggcacagttttagcactttgtgatttcttaattcttacaaccattctgtgaggtgggtactattatgagttcattttatagatgaggaacaaaggcaccagaggggacattatttacttcatgtctggaagctcataagtggcagagtcaactttcccatgcaatccaattcaagaattcaccttgtcaaccactaagcattctgcctcttgtgcatattatataatttatggataacattataaaatgaataaaatatgaaatgtatgatatccttttatatagcttattaaattattatttacataatatgttatgttaggttgaaccctgtggaattggcacttttgttagaaaaggtggcatagtagtaatttcagagagttcatcctaatatggaatatatgtaagtcacagaaatttctctttctcttccttttctgtatgtatgcatacagattcagctagttcctaactcagaacctcaggtttcctcctccgtaaaatggggctaacactgcctaacataaggtgctgctcttccatgccagtgagacaggatgtggggaaagcacctagccccttgctcaataagtagcatctgttgttattctacacacacctgcaggggtctgctatttgatactccttccttcaccacccttcactcacactttgtttttggttagagagtctccatgtccaataaagcttttaagttacacacaggtaaagtattgggcccagaagctgtatttttatttcacgggactttgatattttcaatatgcttcagtgtaacacaaagcttcctgtcaggccaagctgaatgctgccgtcttccctacatgtaagaattacagtgctgccaacatgagataataccaccttacctagcctcatggctcattcctcctggattttctcccgggtcctcatggtacagcccccgtaccatgaattcttggcctgtccatcaaccttctctttggaaactttaaccaactccagtgtcatctgtggttttaatgcagtgaaagttctctgagaccccttgagctgtgggttctgggccttgcaggagaggctggtggtgatggccctgctctctccccaaaccccttgccaaaatgagctttgagggatgggtagcccatgtgaagaaacatggcggaggggttccttgtctcaaaccttggctctgtacctggaaaataatgaaggaaatgaagtctgccctctcattctggagccacttctgttttcccacagaccttggggggtcagaggaagtagcagaagcagggttttctttgggcctgcgcattaatactggagcgttacagtaacaataagagctaacttttactgagacctcacagtgtgccaggcactgtgctaagtgcctttattgattcattttagtgctcagaagaataggattaagtccaagttaacgcacagaggggatgaatagttttcccatgaatccccacatggcaagaggcagaactgtaattcaggccagtctgtttagcccactgctttggtttcttagtcacaacactctatagcttatcctacttttcaggtgttaccaagtgggcttcctgattctaaagcagcaggttttactgattttcaggcatggaaacaatgcagaaaggtggtacagatggtcgctggaggaaagccccctatttgtgatctcagttgctgcctgggtctcttctgtgtcgccaggcttctatatgggagttccagatcctgtcaacaggggagtcagggaaaagttgagcaggacatcacatccaaaggaatattacaatattgtaagcaggagagaccatttattcattcaacaaagctatagtccatgcacccatgtgcacctcgtgcagtggtgaacaagccacgtcttaccaatttgctcttacaaaaaacaggctcatcacacctactgtgaaggctatagtcaaagagaaaacataacccagaaaataataagtgtaattggaaattggaaccctcctacattgctggtgaaacgtaaaatggtgcagctgctgtggaaaacagtaaggcagtttcttaaaaatttaaacgtaggactaccatacgatctggcaattccagtcttaattatatacccaaaagaattgaaagcaggtactcaaacagatacttgtgtgccaactttcattgcagcattattctcaatagccaaaatatggaaaaaaaccccaagtgtctataaacagatgaatggataaacaaaatgtggtatatacatacaatggaatattattcaaccttaaaaaggaatggagttctgatacatgcaacaacatggatgaacattgaaaacattctgctggccactcgtggtgggtcacctctgtaatcccagcactttgggaggccaaggcaggcagatcgcttgaacccaggagttcaagaccagcctgggcaacatgggacctgcctgaaaccccatctgtaaaaaaatacaaaacttagctgggcatagtggtgcaaacctgtagttccagctacccagggtgctgaggtgggaggatcacctgagcccaggaggtagaggctatggtgagccatgatcatgccactgcattccagcctgggtgacagagcaagaccctgtctcaaaaaagaagaaaagaaaaaagaaagaaaagaaaagagagattatgctaagtaaaatcacccaaacacaaaaggatattacagattccacttacatgaagtgtccagcatatttccagaataggcaaatttataaagacataaagtagattaaaggttatgatgggctggggaggggagaaaggggagttagggctgaatgggtacagggttcctgtttggggcaatgaaaaagttttggaaatatgtaaatggtgatggttgcaccacattgtgaatgtacttagtgccactaaactgtgcgcttaaaaatagttaaaatggcaaaacttatatgatgtagattttacagttttaaaaaatctcatcacaagagaaacaaaaagcctgctttataaaggaggaaaattatagaaattcttttctcatccacctcagcccctagaccttatgtgtagcgcacagcccagcctatagtagatgcacatttctgtttttgtcaagccttactgggaacataatcattctatttgtagttgaaaatggcactgaggctgttgagtgtaaattttactaccatggcaactgtggaacacaaagatgataaatatgaacatgcagcaatatttttggcaggtagagtcagctggaggtaacatgtctccttgcaggtaagtgcaagatttgagggagggtaaattgttaggaattgttacaaactctcagaatcccaaccaggaaatatcctctttgttccaatgaagggcatcccggcgactctttggaccagttgaaccaaagaggatagaggatgaagtccaaattggtaatggactccaggaatctttgttagcagctcttggaagaagatgggaggccaaccacacttttctccgcttattgacgacacagttcaaatcatcaggaagagacattatgggtctacaggtctcctgggctgtgagcagagtcgcagctggcatctgggagaaaaaagaaagaagaccacaatttggcctttaaggaaatagacctgggaggagataaaagggagtcatctcactgtgttgtctgatgggccagaaaccctctttcagaagaaattggtttctgaaagctgatgtgaatttcgtgtagcgttcaattgctctctttctttgtttaggcttagctcaccatttttggattgaggaggcaagacttcgcgtcactcccccgacccatcctaccccacagcccacacactgacatacacacagacatgcacacagacacatgtacaccctttatcactggcaagagggaccagttttacaatccaaaagccttatctgctgcagggtccaccatcctgaccctagcccacccatgacttccctcttccaggctcagttctgagctccatccctgatatggtttggctgtgtccccattcaaatctcaacttcaattgtatctcccagaattcccacctgttgtggaagggacccaggtggaggtaattgaatcatgggggctggtctttcccatgctattctcatgatagtgaataagtctcatgagatctgggtttatcagggcattccactcttgcatcctcattcatttctctcttgctgctgtcatataagaagtgcctttcaccctccaccatgattatgagactgcccctaccgtgtggaagtccaattaaacctccttttcttcccagtcttgggtgtgtctttatcagcggcgtaaaaaaacagattaatacaatccttttccaatgctgtatgtgacacagcgacatcaggacaaagtctggccctctgacactgcagctaggtgaaccttgtttggaaaagtctttaggcagcctctgagggaaggctgggtgattttacagcagtagaaaggctatgggttttagaattagggctgaacttgaatctcattttgacacttgacagtcgtataactaactgatgggtcaccaaaccttagttacctcatctgtaaaatgggtgcagtgatacctgttgtcccagggttcatgtgttcagcacctatgcatgagaagtacttacacaccacctgtgtgtaagtaccaatctcagcagctactgctattatgaaggcacgtaacaaccattttgtgttaatggatctggcattcgagtgcactgacatttgttggcttgaaaaatctcagcccaggctaattctgcagaggttaaggcagcatcagctgtgtgccgtacaaagcgctaacgtttatagatcacttattatattcaaaggatcaaactgatttatacacattatcatgtttaattctcacaacaaccctatgaggttgaacctatttattacatcaaatttccagaagaaaaagctgaggcttaatggatttaaatgacccacacaagaccacccaactggtaagtatttgaatccagatggtctgactccagagcccaggtgcataaccaacaccctgggtgctatgagcaaggaaggaggctgagccaggaagatgccagtgtcaagattggagatgttttctcaccactcagtcttggaagcccttatcctatcatgaagatctccctgtttgcccagagattgttgcttttccaggcttgccaaatccagttcccatcagtcatgcctgaatcagttcattctttccttcattcattccatcaacattcatgtactgaacggctcccttgcaccatgactgctagtgttggagatcatttattggctactgactaggccccaggcactgtactagtgaattttatacattatcttatctgttttttatacaactctgcgtggttggcctctaaaacttaatgcttctttcgatttgacgaaatagatgcataaggaggttaaagtagttgcctttcattgtcccgaaatgtaagtgtcagagccaggattcaaatcctacaaggctttcatcagccctagcccaaggagatgtcttcctttttccaattcccacagcataaatcggtcttctagactagtggttcccaacttgagcaggcaccagaatcacctggagggcttgttaaaacacaaattgataggcccacctgcaaaggatctgactcagtaggttgggatgaggccctacaatgggcacttctagcaagttcccaggtgatgctgatactgctggtccgggaaccccatttgggggattatgatgctgtctgagctctttgaagatagggattctgcctttgttgttcccctagtattgtacagtgcctggtacaaggttgcttgattgttattttggattattttgaattgttcagctgcacattaacttatttatataccatattgtgtttttgtatcaatgtgaagattcttaggctttaccatttaggttttaagctccttggggtcaggaatttcacactaaggaccttctgcagaacattgcacacactagatatttggtaaatattagctggtccttgtggccaaagtcctgaaggtttaccttatcttaagcccaattcaagcttgtaaactcagcctcaaagcataagttggtggatggaattttccaagacttgccgttcacctccaacaatgattctcaaccctagctgcacattgaaatcacctggggcctttaaaatagtatgaatcctggtctctatccccagagattctggtttagttggtctgcagtgtggcctgggcagcaagtgttaaagctccctcaggtgattctaatttgcagccaagactgggaatcactgacctagagcatttggctgcatgactttctcctgggcaatttcagaggctgtgtatgtgcatacacatgtacatgtgtgcagagaagtgggaagctatgcacgcctcttgaatgtacagagtgatcatctctctctctgagatgaggatacaaaggcctggaagccaagcctcaggtagaaacttggcaaagccagaggtacttgagagcatcaagggtgcctgcctccctctcctgtggccacctttggccgagtgccggttgccacattccacggtgaggggactctgtttcaaggccagaggcagggggtggtgggctgaatgcaggtagtatggctgttgcaaggcctttttgttctctctcggttcagaaggggccgccttcccaagggctgaggtgtgggccttagcatttggcaccatgtgtgtcggtgctgagtttattcttgggtttcttggtggaaacacacacggctacttgagacccatgagctggctgagagcaacgggaaaggtcatgcctgggctcccaccccagcaggttgactgactcagcacaatcccagtgtaattaagcatgacaagaagagaaaggggaaagggctggtgcttgcgcgtgtgcactcagcccaggtcccgggggcccagaggattcagaagtgccagctgctctcaattttactggagccaatgtttggctcacctgcagccacctccatctctttttccctgggagctggggtcaacttcagtagacctgcaggatcaagtctggcagagggatgatggggtgagtgcttcttgttcccttcccttctcgtttctcttctcacatggtcttggaagctgtgaatgagagacacgatcacatcagtgcattcaaatcccccactgttgtttaagcagtagcctgggcaaggcactgtgctgggcaccagagtgaggactgattcatgggcttggtttctttcctagcagagcttttacgctaggttggaaaacatttcataattatgaagtctgcagttagatccaattacctacctgggccagacaggtaatataaatgggtgaattgggctgcttgtgaaatcttaggaagtaacagggaccttgatgaactagggactgcatgcccagctgcttgcagagccaacattgcgtaagcagccgagaacatctccagagtagaactaggcaaatcaaaacttaacctgggattgtgggtcagggtggaggtgtgtggtcaggttgcaaacggaacagggactctgccctccaaatgtgacatgaaggtccatttctctcctgtccttttacaagcaagggaactgagggatggagagaagggacgaagtcagatccccagcccccttacccatgggcctcctatagctcaggcactgcccaggcagagaatgttgacatggagagcttgatgggcttctgcccctgcacctgcccagtttcccctactctcctctgtacccacttgcctgcttttccccagcactgtgctcatttgcccattacgagtctatggacccagatgtcccttgggataccctggaagcctagtctgtggtctcagcctcagagctctaccccataatgatagggtctacggcaaggcctctgtagataaagaggcctgtatctgccccaagggttcttcctctgagaggctaaaggagacttggactcatggaatgggagtggcaagtgcttttctctggagtttgaagcactctgtagcttccagggctttcttgcttctggtgtgatgctattttgagcatctctgtctatatatataggatactcccgcagttgttttctttttaattgtccatccacgtgcttgtgttttccacagaatatgttgcggtgaaattgttcctgcaaagcccctgcctccttcctgaaaccctctaccccctcgcaatgccccgtgcaccagcaccgtggccccaggccacgtcagagtaaacaaaccacagaataaaattgcagccattcaagagaggagcctttaatttgagcttaaaatagcccactgtctgagagtttgagggaccaggagcaaggtgtaatcgcaggaatgagcgtaggagactcatctcaggatgactgagaaggggccgtgagctgggagaaaggcaggcatggggattgtgggttgcactggagccccctatagcttattcgaagttagcctctttcatgatggagtagcacatgacatggcaataaaaatacacaggacctgctgcctccatctggaatgcttgtctgccctcctgcctttcctcgaaactatgagcatcattgtcatatcacctacagtcaggaccacaacattgctgaattcctgggccaccattcacatgatgtactccaggtgtgccattttcactgtatactgttgaacgatgccccctggagttgtgtgagcagcaatactggcaacaataagagcaaagagatggagcacttatgagctaggcattgtcctagccgtttgacatgtataaccttgcctagttcttaacccaacctaaggaagaggacacccattttatagattatccacatactacagataaggaaatagaggcacagagagttaaaataacttccccagagtcatgttgctacttctgtcccccaagtgcagaataagcttcagtctgatgcagagtgagaacccacacttttaaccattatgtttcatccaccatactattgttgtgcttgttattcttatttttttgactgccgctttcttgttttcgaccctcctagactatataagcgcctagatcagggtcagcagacagccatgtcatacatgtatatttaggctctgggtctctcagtctcagtggcagctacacaactctgcccctgtcgcgtgaaggcagccatagacaatgtataaacggatcagtgcggcttggttccaagaaaactgtatttatggatactgaaatttgaatttcatataatttttatgtgtcatgaaatattatccttttgattttttccaaccatttaaaaatataaaaaccattcttggctcccaatccatatgaaaacaggcagtgggccggatcgggcctgtgggctgtagtttgctgacccctgtcttggtgtgcggggatatggagcgtgatgtatttattttaatctgtgccttcttaggattagactcggtcctggcactaagttgccattcataaacgctgattgaatgaattactgtatactctttcaggtgtgctggatgacttggggacactgctgctttttgaggaaagagtaaaaatttttctgagcaagggatgagaatccaatctttgtggcaatggctgaggagagggcgggagcctccctcttgtgggtcttcatggatgtttgtaagagtaaagagaattttcatttttatgtaaagtgtagagatctatttttcacaaacagacctacagaacgtgatttgtaataggaaacagatttccctccccttaagataaatggaatgtccccacctcccaaactgagaagagaattgtttcctccttgcaaaggaaacaaattggattctcaaaggaataatcagaagttttaaaaattgtcataataagcaagatatggtttcatggatgatgaaaggatgtttgtcttcgttgggagtggacatgaagttttggttggagaggcagttgggcccttctccctccctaattcctgccccttggcattttatcagtgccacatgggagaagtggcttctgcctgaatggggttggtggtcccactctggtcccactgtcagactgcattctcttcctttccaaatcttcatcactctactgaagtaggtccccattcctcagccaagcttcctgacagctgcagttcattttgatccatgggagagggtattacagatgggagagttgcctgagcaaagtcatggggcttggaatgagcctggtgagtgcagaggatctgcctggctgtttggggacacatttctaggcagctggggcattagtttgaggcctctcatgtcagtaaaggtggagaaccatagagagtggaggagcccagtgctaagcacctggccaaagacagcatcagctgtgtcttgggccaaggccggttgcgtggagtcaacaagagttggtatataagtcagagtggttaaggagagggaggacctgcagtcattggatccaaagggtttacctccctagttcttccctgggtcctggagacatgaaggtgaacccccacagcccttgcccttattgcttacaggctaataaaggagacaagctgggcaccttcaagtccctgagagtttagagcaaagagcagggagctcagaccatccaggcctgtcctccagaatcattactccgtggataatactttgaagatgtgtgaattggggcaagttatttaacctctctggacctcactttcccataaatactatttttggctttcataataacatacgatgatggtgataataagagtgtcccccttataggattcctgtaatatttcaggggagatgaacagtgcctgatatgacatgataaatcaatacgtgggaaaaccattattaattgttatttttatagttttccagcagtacaactttttaaaaaatttataaaatgctttgtcttgcattggctcacttgagcatctcaaaaaccctctgaggttctgcaagtgctgctaacccattttgcagataagggtggtttgcccaaaacacacgagtagtaatgaaactgggactggaggcctgatgctacagctgctgtccagtgttcctcaactccgtgccctgttgccttctctcatggatatgggggctgtgtctgctctgtgggtgatgcccagatgtgtaagaaaggttctctgctttcaaggagtttatatctcattcaaattggaagagccttgatctggaaattggagagttccgcctgcaagtgagggccacttctgctgtctccagcaaggaaagacaggcaggaaaatgactgggagtcttatgtggtgccatcagatgacattcagaatttccttgggtcgaacctgcagagacctgtctctgatttcctgcgtgtcactcggcaaattccctccatgtgtgaaatgagcaatgaagctaactctctggtgcatggtgttagcaccaagttgcatcacattcccccctccgccactcctccttcgcaacagaccttaacgttattctgtgattacttcgcatcatccttcccaaatgtgcatcaaattaaagagttattagggcatggcaggacatgtttatggggaagaatttcctttaaagtcacagctcagcctgaactcactttattagtgtttatacaaagtatgtagcctgttccaatgcagtccatgtttatattcctgcagcaatcattgcattccttgggctgttccttcgttttcttaaagtgattactgcacctatgttaaaagttaatagtgtatgtgctctgtgactggttggacttgggaggtgggcaccattcagaaaatgacacttaaccaagatgtgtcctgcaaatagccatagacttagaagtggtcttcagcccaagtggacaggaagaaggtctccttaagaacaaagacatggtgggcaaccaggccccatatgagtatttccattgtcacccactcctgttgccgatattttgtggctcaagctgggaatgaccatttgtgttgatctgatctttgcctgtttctgtggtataattattaatgacttcccctttaactcacaaaagtattcaagtttggataatcatatggtcattccaattctaactgatacccagatttactggtataagtgaagtacatcaactttagatctcaagccattgtcaattaagggcaaatgtaactcagttaaaactgtcaataaagagctcaagttaacatcagtcattcaacagatattgatttgtgcctttcatgtgccaggtattgtgctgagccttagggattcaaacataaatcagatatggccctggagcccagtaagttggagcttattagtttagctaaactttttgagtatgttactaaaattctctgaccaggtcatttcaatttctctttcaccctttaggactctatatttacttgctgcaagttgattgctaaattttcagccactaatccttgttcatttggtacttctcagcttgtgaccatagacaggtgtcttaatctccctgtgcctctatttgttcaatcataaaatgggactaataagtagcatcaacctcataggctggttgtgaggattaaaaaaggccccaaatgtgaagtgtttagcatagtccttggcacatggtaaacactcattgtagattggctcctgcatagtaaatagcagaaagttatttggaccttaatgttggttgggtgcagcatttgtacctctattgaccggagttaagtggccttcttaaaaacattgcttaaggtaatatgtgttaggatccaaagccagtgagaattattgtgaccctaggggatcagtttattttcctccttttaaagatgaggaaggaaaattttacaaagtcatgctctggattatcatggatgaagatcatggatgcttaacttgggccattctttcctactatgccgtattgctaggtgtatcagttagcatagacaaggctaagctgcagcaacaaataagcccagatatatcagtaacaaaacaatataaagctgtatttcttcctcttcctcccacccacccagtccagtagagctggtctgggtggtggtaggtggcttatgatccatattgtcacttaggaacccaggctgctttcctctgggggacccctccatttatgacacatgatctctacatgccatgaagacaagaaagggaaggagagtgtcatgcttgcaggatgttttatagccttgcctggaaatggcacgtattatttccacccacattccttttcttcagaaatcagccacatggtcccacttagattcaaagggcacaggaaatttaatcttgttgtttgcctaggaggaaaatggaacagtttggtgaacacagagcactatccttgccataccgtattccctacatttcttgccacatttccaaaggttggccccagtctcttctaggatttgtttcctgcctcccggtgattggaggagccattttatcatgtgctctcctatgcagtgcagggaagtgttttgagaacaggccttgcaaggagtttggaagggtttgagatttctgggcatgataagggaaataaaaggtgaaacttttggactgatagtcgccacctggaggttagtgctgagaaaagaatacgttgccttaagtcattacaggaagaatttaggaagaattttttatttctgagtgtgttggctgggttgtcctctgtgtgacaggaaggaagcactgtctctgcagatgctttgatgtgcctgaagtggatgaaggagatttggggtggagctgtggatttgaccaggtgcacctttgtgttagaagcacggaggtcctgccaacatcatcatcttacttgtgctcacattttgcctgaataataatcagccaattgatggttacttcttgagtacttactgcatgaccagccctgggctagaatcactttatacgtatcatctcatttaattcttgcagtatcctaggaggtaggtactgtgattatggccatttaagatggagaaacagaagcttagggatgagttaaataacctgcctaaaatcatgctctatttgctaagatttgagcccaggctatctgattctagggcctgccaccttaagcgctatgtttggcagcagggatctcaaactctgatgcgaaaaaagattaagcaggtaacttgagtgagggaattggatcaggtggactggtgaattgcaggcatgtaccttatgcaaagtgggcaattgcctcttagtaccagcttatgatggccactaaaatccattgttatttgatggactgacctttggagacaagccagaattgtagatttgtatttgaaatgctcccaaattggcaattaatttgcatatgtgaaaatcacagtgagaaccagactacgcaggtctgcaggccagaactcaccggtgggctaccagtttgcaagttcgtctctgctgttcccagtaaagagctagttgtacgttttgtttgtttgtttgtttgtttgtttttgagcatggagctgaactgagcaaaacaggggcagggagtcctcctggtgcaagggatgaaggaaaagagaccccatgcccaatactcctctttacatgccctcaccatgaccacatccaaccacccgggttgcccctctgtttggcccattcttctccctgcaggtagctgtctgcacagggctggctgcaagcttttgcaggtgtaaaattatatatgcgagagtgttgccaagccaaaaatttagcccagagaggcttagttcccaaacaactgaggtagtgtgaagccagtttttaaaatcaaattcagctcatttctttcccaaatgcgtgtatgtttttaaacttgcatgtggttatgtaacagatgagaacgaagtgcaaaaatcagaatagttaataatgcctcctgtggtgtgagtctggagaggtaaagcatgagatgggagccctataagggtggcccaaagggaaacactgctctccttgacctggtaggaaggtgatttgatggttttcaaacacatgctgtttctctctttcatcagggtagctgggtgggtggcattaggtcctttggactggggagaggagacagaggaagacacccattaggaccgcctgatgtgagcagtttcagaggtctgcccttgggctcatcaaaaagcatcttccggccaggcacggtggctcacgcctgtaattccagcactttgagaggctgaggtgggtttgaggtcaggagtttgagaccagcctggccaacatggtgaaaccctatctctactaaaattagccaggcatggtggtacatgcatgtaatcccagctactcgggaggctgaggcaggagaatcccttgaacccaggaggtggaggttgcagtgagccgagattgcaccactacactccagactgggagacagagcgagactctgtctcaaaaaacaacccccaaaaccaaaaagcatcttcctttggctaaatggctaaaattccagagtcttgaatggcttaaactctgcatggtcactttatctatggggagagtcttaggttaactggactccttttttcagtggttttttttggaaggtaggaggtatattgaataatacatgtttactccagaaaacattgataatactgataagcaaaatgtaaaatgtttaaaaaaaaaaaaccccgtttctccaccccgagaaacctagtgtacatttttctgagtgtctccatgaggccttcatccaaggtgtctggaggaagttggggagtatcctcttcaaggtcctttgggagacaaggcagacacacaggaaacaggcagcagcaaggcaacgtgatgaaagaccaaaatgagttgtgcagagagagggtaaatgatccagaagttcagaagttcagggaagggagaagccagcacgagatggagcagctgggggaggctgcagggggagtgtggggtgtctgtgctatggcagccctagcacacagatacgcccagagaaagcctgaacgttgggcgtatctgtatgctagggctgctgtaacaatgtaccacaaactgggtgccttacaacagcaatcatcctttcagacttctggagcctcgcaatctgaaattgaggtgtcatcagggccaggctccttctgaaatctgcaggggagggcccttccttgctccttcctggctcctgggcttgccagcagcccttggcattccttggtttgtaactgcatcactccagtctctgcctctgttgtcacacggcactatacctgcatgtctgtctcgtcgtctttttattatttttcagagacagggtcttgctctgtcactctggctggagcagtgcaatcatagctcactgcagcctctgcccccctgggcttaaacaatcctgccacctcagcctcctgagtatctgggactataggcaagtaccaccatgcctggctggttttctcttttgtagaaatagggtcttgctatgttgcccaggctggtctcaaactcccttctggcctcaagtaatccttctgcatcagcctcccaaagtgctgggattataggtgtgagccactttgctcagccctgtctcctcttctaataaggacaccagtcctattggattagggtccaccctaatgacctcaatttaacctgattacatctgcaaagaccctactttcaaatacgatcacactcataggtagctggggttaggacttcaatatatcttttgaggcacacaattcagcccataacagagcagtaggatttaaatggacgcaggactttgagggcttctgaggccagcatacagacagcaggaacatatgtgccaatgaagtgcctagcacagttcctggatctgataggtgctcaatacatgtctgtggctataaagaagaaagaattaaatgaggcaagctgagggcagtaatgagaacccccttcttattgagctgtggaatgaaattgacatttgggggaaattaatctggcaggattgatggcaggggaatgaggctgagggctcttaaattggtggtttccttgctcggccccttttatggttccagtccccaagcatgttgtcagccccatagatgcctcacagcctggacaccacctgcctctgtgatcccatttggtgtcactctgctgccgtcacctggacctttttgtttccattcttccacctggaaacgtctcccttcagcctgtccttcaactggatccttcttttccttctagtctcagaccaaatctcactctctaagagaggttcttcctggacaccctagggagggcagtgccttcactgcctctcaccatatctttattctcttcacctcaccctgtactgtttcctagctatgcccatattgcagtctgtagtctccttgtttatttgtggtggcctatctccccctgtgttttttattgtcatataatgatagcaaacttcgtggcttaaaacaacaggcattcagcaccttccatttgtctcggccctctgcttcagggtttcataaggctgcacacaagggtttggttgaggttgtgatctcatctcaaggctcaactggagaaggacctgcttccaagctctcaaggttattgggataattcagttccttgcagtctattagaaggcttcaggttcctgctggttgtcttgaattcttggttggttgtgggtagaggctgcctccagttccttggcatgtgggcctcccaaacatggccacctgcttcatcacagccagcaagagaaagagtcctatagcaagacgggcattgccgtcccatgtaacatgtcacaaaggtgacatccgaccaccttttttgtgttgcatgggttagaagcaggtctctaggttctgcccactcaaggagaggggaaggtgttgatactggggaccaccttagaatctgtctgcggcattcagcaaagaaataaaagttccttaaaaggaacttctttgctattgttttactgtctatccttagccatcagcatagtgccaggtctggagtaggtgtttaataaaagtttgttgtaggaagaaaagaagcaaggaaaggagggagggattttaaaaaaaggaaaggagatggggagggaaggaaggaaggaattaaggaaaggagagagagggaggaaaggaaagaagaaaataaggaaagaaaagaagaaagaaggaagggaagaaagatctgtgtttctcttgaaacatgctttaacagccaaataaatctgctggcagttatcctgaggcaatgcctctgggcttttatacatgctggggtttttttttgttttttgtttttaaacctaaaattctttttctctctcttgaatattcctatgccaacctgaatatagccaactctttcttgaggtctcaattaaaatgtcacctgttcctggatgcctcccccgaccctacaccccaattactccatactccttcctccatactcttctgtaagcttttgtttatgcctctggcatagtagagagcaggagtctataaacgacagcccctgggccaaatccagccttcagtctgtcttcgtaaataaagttttattggcacacagccatactcatttatttatatattgtctaaggctactctcacactacaaagctgagttgaatagttgtgatagaaaacatgactggcagaacccaaattatttactatctggcctttaaagaaaaaggttgccaacctatggtatacagcgtttatcatagtctatggtaattactcctttatttcttcctctctaaactctgagtttcttatgggcagagaccacgccactattgtttatagctatataccagcatttagcacaattcctgaaacttaatgatgaagacttgttgaatgaatgaatgaatggtgtatcagtaagaaatagaaaacaggtagaaaattcaaattaggaatattccaggagagttgatttatttacacagggatcatttcagaggtgtgggtatgtttcagagagatactgtagaacccaagaccatagaagcaatggagcaattatcacctctaagccagaagaaataggaagaaaagtgtcctggaaccaagaaatggacagtcataaagacgaactgtaacctttgttggcaaaactagctaacgtgggtgagctctcagggaggacgaataccccgtcctcggtctgatccttcctgcatcccctgcttagctcatagggaagagaaaaagcacagaaccttgccctttctgtgatgtggcccattcaggtggaaagcgtagtgagtgcataactgaaactgaggccactgcttccttgccaacttgttctgatttggttggaacctctttgctggtggtaaatgaagggtcaggaagtgctatgggggcctcttaattctggctcctcttacccctttcctgagtaggagtcctcaaatcacactatgggatttttttttttaaagttgtttattttttttaagactactcaagtgcagttgtgagaaggaggggaaagagtagaacaactacttcaatctgtaactgagtgaacaatccattgagatagctatgctgtgggaacttgaatgtggaggcgtcacacattgaaaggtttattcaggagcaggaggtcttctctctgacttcctgcttgtctactccccttggtgtttagaccacatcccttaacgtttcattttgcaaattcttgccttgttctctaagaatctcctgagtcttagctcatcctcagctagactccaggctccttgaaaacaaggaccaagctatatttcattttctaaaaattcatttggctctgggctcccaaaagatgacaattacagagttattgacaggactccataggtcatgtagttcagcctcctacccatcacaaggatctcctagacatcatgcccaacatgagttaattttgcctgcatagccttgtaataaggaataactgcattgtatggtagcccctacaggtttacttcatgttgagacctgatcttctttcctgaaacccagaaggcagtattctgtaaatactcagtgtacaggggacaggtagtcttaaaagtctggtctgagcaatggtgtgctccctaactatcacagatctcactatcacagatgaacatctttttaaaagtctatcccaagctacaccattgcatcctctccctacctgttgtagcccgtgggtgaaaaattaaccactctgaatgctgtttagaaagtacttccttggccaggtgccatggctcacgcctgtaatcccagcactttgggaggctgaggcggttggatcacctgaggtcaggagttcgagaccagcctggccaacctggtgaaaccccgtctctactaaaaatacaaaaattagccagatgtggtgatggcacctgtaatcccagctactcgggaggatcacttgaacctgggaggtggaggttgcagtgaggtgagattgagccactgcccttcagcctgagcaagagagcaagactctgtctccaaaaaaaaagtactttctcaattgagcctcatggtgatctgacagacgtggtattttgggtcatgttttacaaaagtcacagcaacaacaatgggagttccataaagttaagtgcctttctcaaagccacatagctaaggagtgaaaaggttgagattcaaatccacaccatttgaatttataattgaagcccttttccccacactatgctttcactgagggctgttttttcactccttgctcttcccagatgtgccacagctggaagaaaattttgcaggaatgccacagaatgaataaaaagaagggtatggatatacatgtgccaagataaggccagtggcctgacctagaaaatgtcatttttgtttcattttttccagtgttgttctgaattcttctttctccctaccccacccaaggtgtcaaacagatgtgaaaataccacaaagctccaagtcgcagcattggtttatgattcactgattgggatggggaaaaacaatccaaattaccatggtgatgcctgtttatagaggcaacatggcagatgctgagcaacatgaccaaaaccagacaggggtaaacacagcaagaaagctcttcctccttgagcttgcagaggggctcagccacttcccttggccaggacttcactgggagacagggtaggaaatgtgctctgttagctggagtgggggaagcaaagttactaagggtatgtctttgtttttctccaaggcacgggagtgggaaattctattatgtttgtttgtgcatttatttatgcattcttttaaaaaattcagtggataacctgatgcagtataaaaaaaatgctctaatggtaaatgagcagtaggatgtgataagtgaaactatggcctttgcattcagagagcccaggttcaaatctcagcattacccacttccctggtatgtgaactcatgtcaaatttctttattggtaaaaatcttctaagcttagggtggggatgggggaaactaaacttcagcttcctcatgtgaaaaatgaggtaatagtacctaccatatatggttgctgtctggattagataaatgaacacaaagtcctcagcacagtacctggtgcgtagtatgggtccagcaaatatcagcttttattaaggctgatctacagcattttaattcgttgaagtaagattacctacctttcagaactgttgcaaagagaagaagaagaaagcatggaaggctgggcatggtggctcatgcctataattttagcactttgggaggccaaggtgggcagatcacctgaggtcaggagtttgagaacagcctggccaacatggtgaaaccccatctctactaaaaatgcaaaaaaattagccaggcgtggtggcaggcacctgtaatcccagttacttgggaggctgaggcaggagaaggagaatcgcttgaacccaggaagcggaggttgcagtgagccaagatcgtgccactgcactccagcccgggtgacagagggagacaccgtctcaaaaaaaaaaaaaaaaaaaaaaaaaaaaaaaggaggcatagaaagctattgtatcaaagatattttatttgtcagcgtagactgccataacaaatagtttccacatttcagtggtttaggagttatttcttgaataggtctgagtttaatgtgtgtaaatggttgtggggcggggtgggggcggggaggttggggtggggggctgtggggatccaaaggaggagaggcctctgtttcatgcagtcattcagggactcgggttctttcagtttcccatccctgggatcctccagtgtatctactgaatcccacccaagatgagagaagacagtgtaaaggatggggcagaaagttttattcctcaggcctgaaggcagcatatagtacttgtgctcctgtaatcgtgatgagaattcagtcacatggttgcacatacatgcaaagaaagctaggaaatgtaatctatctgtatgctcaggctggtgagttgtccacgattatcattcatagagcattgtggcagactggtgagttgtccatgaaacctttttccctctgtcttgagcacaactcaaaacaactcaccagtctgccacaatgctcaatgaatgataatcattactgtgattagtaacctaacatcataggtgattcccatggtatcctaagccctacttggagggaggggcatctctaattatgcagtcttttctcctttgagcttgagagaaggaacagttctcacctcgttcccacaataactcgggagccttctgcccccatgagccatccttgaccataatgacaggactgaggttctcagaggtggcacaaaagtctcagaaaggccttgccaccaaaagccatgtgaatggggttccattgctaatggtaaatattgtgtattcagaaggtggctttctcctcctttctgttccacctctctattgttataaaatgaatcaccccaaaacttcatgcgttaagacacagtggtcactttggtacagtaatgtgtgtttaacgacagggatacattctgagaaatgtgtccttggcaatttcgttgttgcgtgaaagtcatgagtgcacttgcacaaacctagatggtctagcctactacacacataggagatatgggtatagcctattgcttctaggctataaacccgcacagcaggttactccactgaatactataggcagttgtaagacaatgctgagcaatggtgagtatttgtgtatctagatatatctactgttttgttgttgttcttttaagagacagggtcttgctatgttgcccagtccagtcttgaactcctggattgctcaagcaatcctcctacctcagcctcctaagtggctgggactataggtgtatatcaccatgactggctaaatatcagacatagaaaagaaaggcacaaaaataaagatacggtataaaagataaaaaaaaaatagtatacctaaataggtacttaccatgaatggagcttgcaggactggaagttgctccaggagagtcagtgagtgagtggtgggtgaatatgaaggcctaggacattactattcactactgttgacttgacaaacactgtacacttaggctatgctaaatatttgtacatttcttcaatagtaaattaaccttagcttactatataacttttttttgagggacagagtcttgctctgtcgcccaggctggagtgcagtggcgcgatctcggctcactgcaagctctgcctcccgggttcacaccattctcctgcctcagcctcctgagtagctgggacaacaggcacccgccaccacgctcggctaattttttgtatttttagtagagacggggtttcaccgtgttagccaggatggtctcgatctcttgaccttgtgatccgcccggcttggcctcccaaagtgctgggattacaggcttgagccactgcgccctgccaactttttaactttataaacttttaatttttttttattccttcgtaataacacttagcttaaaacgcaaactgtataggtatacaaaaatattttcttcccttgtatgcttattttataaactttttttactttttaaacttttttattaaaaactaagacacaagcacgcacattagcctaggtctacacagggtcaggatcatccatctcactgtcttctgcctccacatcttgtcccactggtaagtcttcaagggcagtaacacacatggagctgtcatctcttatgataacaatgccttcctctggaatacctcctcaaggacatgcgtgaagctgttttaccattaactattttttaaaataagtagaaggagtatgctctaaaatagtgataacagtatggcatagtaaataccagtaacacagtcacttattattatcaagtattaggtactgtacataactgcatgtgctgtacttgcatacaactggcagtgcagtagatttgttttcaccagcgtcacataaacatgtgagtgatatgttgtgttatgatgtcactaggaatttttcagctccgttatgatcttatgggaccaccatcagatatgccatcctcattgactgaaacattgctatatgttacatgactgtattatctcttacagcttctgtgggtcaggatttcaagagtggttcattcagctgggcgattctggcttagagtttctcataagttataaccagatggtggctgaggctgagtcccaaaggtatctgcacctaatgtgcctgacctctgggctggaaagactcaagccagggctggcatctctccctcatcctcatcctcttcctccatgtggtttcaccagcatggaggcttcagatcatctgcttttctcatatggcagctcaaggctgcagtacaagtgaggggagcgagagagcaagcccctcccctattgcctcttctaagctagcctcagaagctctgcagcatcatttctgccacagtcttgtttgtccagcagtctcaaagcctgctcaagttcaagggaaattggcatagacaccatctcttgatagcaagtgtatttaaaaaaaaaaaagaaagaaagaaatggcagacatgtttggagaccaccacacttcccacatccacatctggacactgtccttggcccccatccaggatcacccctcctgctgacagttcagaacccatcccaggctgacatacactgactcccttgaggccagagctgaaggtcataaaggtctggaggagcctgggccgggacagtgggggctggccttgggacaggcagcctctcctcagggtcagtgtaatccattcccatttctaaccgcgtgtgttgaatccccagctttgtgtttctcatcatcctatggcctgcaagtaggagacaaagctcctacaaagcatgcaggcccagagaatgtaagtaagttactcaaactcacccagacccagctgtgtggagttgggggctagaggtatctcacctcaaagcccacgtgctccctggccttcctggcagtatgtgtgtttgggaggtgggcagaggcaggcagcacagctcagtgggaggggagagcccatccctcctccgtagcccctgtgtcacttgcacttagatactaaggaaatagaggtcacagaaatgctgcgaaggacaggcagtgggctgggggagtacccttggccccattattctatttgtcagccacaaaatagatgcctttttttacccgtaggaagagagcacaccaacaaggagtgtcttggggaccccaggattcatccgtgggcacaaagtttggggtatggggctgtcagcttctgctggtgaactgaaatttcaaagttgagatgggagagatgcgcttcaactaattacagtaatagctgccatgattgagtacttaacaagtgccagataagtgctgtgtgtacatcatctcatttaaccctcatcaaagctcctgaggtcaagattgtcagcctcatttgtaaatggagaaaccgcacctcagagatgaagtgcactgccattagatcactcagtaagtggcaggacagggattcaagctcaggactgcctgcctctgaagctcagctcccaaacactaactctgtgccggggacagtcccacagcacaccttctgccccccgccacatccttagcatttcagcagtgcactttgtgtgctttgacataataaatattcaaaatattagtgctgcagatgctggcacaagctgctgagataccatgctgtgtcctggtaattaaacccttggttgcattgtcatattcacagttgtcaaggtccccaaacatccatctgaattcagatgggaggtaagaagaacacgtgtgatgctttggagtgtgtacagatttctgtctgcaggtttcccatccctgcatggataacccttctttattttcctgggtaattcttgctatgcttttttttttttcttctaaaccagcactcagattagccagagaagtctaaatactgcttttctccatcacaagctagttcagaaacaactttgatgctgttttaggtattggaaaactcaaggaggaaaggaggaggtacctgtgtgaggttactcaaggactcacttgatttttatttcagtattatgtctgataccaggagattaatccctcctcaaacttgaattttttatatatatataaagtgctggaatctgaaaatgcctttcctgttcattttatgcaactgtataaaggaggcataattgcagggtggcatctttaggaagcaactaggaaaaccgaagagatgaatgtttggatggggattcatcattggaaaaatggctcttagtatataaatgttcagaaagaaaagacaattcacagataccttgttgaaactccaagggccaaaaccctgaaaagtgagggttaaagagggcagaatctgtagggatcaattattcagcatccattattgagaactgtagcatattattcatggttcctttttttggcgttcagtcttgttagattattttagtgaacacggaatattcatgcagttgttcacaggcttgttcgtgacttcagtttttcttaactgtttttccatcatccatgctgccctccaccctcacttcaatatcaccgccaccacttcagctcttctatggcaaatccttctctttggggctatattcaggagcttaagcctataaattgaggcaggagtaatccatgcaaatgtctttacctaacatgtgaaatgagttaagttacctctactgggtgccaagcacatactctatctactatgttgggtatggagttaaatgagatgtggcctttgccctcagggagtttgcaaagtagctggaaaatagacaatttttgtcttgtttgttggtttctagctacataccaaagtcaggcaaattcttttgatttcaagtgatagaaaattcaactcaaactggtttaaatcaaaatataggagagatgggatagaatgggtcatacactctcaaaatacagaggtatctggcttcaggcatgagtgagtctggacattcacaggagagcaccatctgctcactgtttttgtggcggtgagatggcttctggctaccctgaacagcttagcaatcccagtagataaacagttattgggattttgagtcatttaggcatttctgaaacatttgctgtggtcaggaaaactgaagatacttatcagcctggcctggatcagatgccagtgcctagagctggaaagaggggtcagccccatttgtatgacatgatctgagagttgggggaggggaaacttcaacagaaaaatttgttacctaaagaagggaccacagaaggcaggcagttacatataaaagagttctgctatgtgcataatgaatggtttattccatacaatatccttaaggttagccgggcacgctcaagggatatcgttaatcatcagaattgccgccttctggacaagcaacatcccttcagtccaagccagtctggattaaatagaccgtaattgtaacccacaaaaatctgacctgaatttgctctccattgcagtgacctggacagaaataatatcaccaggatcaccaagatggacttcgctgggctcaagaacctccgagtcttgtaagtagttgatggctctcaagtgtgttttcatttttagctcttcagcctcacaaaaaaatgttccactgcccctgacatcacactcccaagccctggacaacaggaattcaccattctgcagcagaaagcccctcgttagcgtacccacatgcttacaggtatcacattctgtgtctagatgctgctggctgagctagatcgatggaagaacttagttccagtgatagggaaagtggaaggctatgaacaaataaatcaccatgcccagcttctaggatgacagcgatgtcaggttgactaaccatgcttccctttcatagagatgataatttcttctccagcctgtgcattaaaagagcaatcaggacaaaagttatctgtcttgtagcttaatggagaggaggggaggagagcatcagaaagggtcagggcccttgctgaacacccacagctgtgcagacaggtagcaaaatttgaaatgggcattgatggactagaggagcaaggaatattaggtttcattgctgaatattgaacactttcatcaatccttaagtctgtgagtgataagaaacttcccaagtgcttgtctgtcaaaaagtctaagacattcagaggtacaggaaaaagcaatttagattttattttccatctttacttggtagttaattttgacccataagtgtggctccatgcaagaagtacagactgggccaattggccactgccttggtatttgtatgccatggaatcttagctggcaaattgttactagaagtgacagctaaagtcttggtacctgaagctaccttctttttactaatagccctatataataaatataatgaattttgtatttggttcagaaagtaccaggctctggtcctgattcggaattagctacccatgaaaccttgggcaaattatttttcctccttgggcctcagttttctcatctgcagtatagggaatacgttgttagaagtattttcaactctcatagttacacgtgtagtgcttcattgttttaacattttctgattatttttgtgattacttgtgaagcgttaattttacaacattgtttgccatttctgattgagttgttagtaataatgatgatggatatgatactttcatgggctcagcacagtattacatagtggtaacaaaaaggtggggcattattatgagcccctatttgtagcagaggaaaccagaggtgcggataggttaagtagacccaactctacatagcaggtgactgaaggagttggaattggaacctagactctgtgctttctaacctccatgcagtgccactgtgtattcacattatagaaagctaagaaaactaagacaatgatagtctacccattttgtaaatgcagcactgataatgtgggggcttgtcagagtttctgttatgtacacatgtgtggggacatggggaatctgaatcctgggactccagcttgcagatgctctccacaccgacatgttctccgtctttggtctcaaacactctcctctcaccaccctcaaagggaaggcacaccctgtgccaagtcttttgccccagcagccatgtatctgtcaagtaactggtagttctgacaaggtgtgcgtggatcagaatcgagactgagatcagggtgggggaattccatggttcagttttagggcgattgttattgaagaggtataggtagcaactcttgattctatgtcatttgccaggttaaaaaatagatgcttgtttaccttctcactttatttttttttatttatttcccctgcatctgtgagagatttccttttatatttcacctaatgcttcattttctaacaaagtcaaaaacaacccttgattttcttagcgttacatcagaaagactaataaaaactccaattttcatatctgctttctgcaaatagaaagtttaaaataatcacaaaagattgttttaatatcccctggatggtctacaacattcctttgactacagtttatcttttcagttaattggtacattcctcttattttgataagcaatgccaaaaagccttcccctaccccccatcccccagtagactattaatatactctgtttcattatcttccttatcaactcaaagacaatcccattcaagtggccctttattactgtgaaagaatctgcctggtggaatagctgaaatgctttctaactaacaccaataaaatatccagacatttttaccatatttttcctcaatcgattctttttagctgagtaacctagacaactatcttttttaaaaagatttttttcacaccttggcacattccccatatctgtttcttatttacaatttctagagaagctagaaaagattcagtagtcttgaaaaattggccacccaacagtttctgtgtcaaactgttaatatgggcaaaagcagataaaatggagattgaggaacttcagtctcaacccagggcaattttccccaaatgaagagcatttaaggagaagatagaagaattgcccaggacatttttttttctcccatgggatgggagtaggaaaaagtctcttctggtggtatcaattatgtcccatttcttggcagtctaagggctctgctatgctcacaatgtgggagccagctttatcccaaatggggttaataaaaaagttaaactccaccccagccgtcatcacatggggggcgatttccgatcctgatccagtgctaaagctaaaaaaataacaatgccaaaaaagctgaaaatgaacacaggctctgttctaattcagaacagactccagccatggacagcctttctgggtgtccagcccttcccggattcccctgtctgaaaatgtggggaaggtatcagtggcttttagtgcatgctcctggcttgcatctcagcccagaagtctggatgggagggtcttagctcattcattcactgatccatttattcatcaaatatcgatgatttgttgagcctctgattgccaggttctaggctggaatgtgatggaactaggaagtagatctggaagggatgtggatacttggtcagtgagggtcccagcagaaaagagggcaaatgaggagagcgaagtaaagacttatttagcggtgtgggcaagattaagagaaacgtagaggagatagtgtagttccttgaggctagagtcaaaacggggtcactactgtcccctgggccttaaggagcacagggaggaagtggttatcagagcctggcaaaagtagggactgcttgacagaagctgtggtcttaggtagagggatgcagtcagcctgaagtggcttggcagggaaggagaagagtaaatcccccaaccacactcttcctccaccctctgatctcctgccggtgactctctttggctgaacctgacaggaatccagaagtcaaaaaacttcttgatggtcttgatggctagatgtggtggctcacgcctgtaatcccagcactttggaaggccaaggtgggtggattgcttgagctcaggagttcaagaccagcctggacaaggctgcccaggctgggcaacatcgtaaaaccctgtctctatgtcccctcctaaaaaaaattaggtgggtgtggtggcatgcgcctatagtcccagcaccttgcaccactgcactccagcgtgggtgacaaagtgagaccttgtcttggagggaaaaaaaaaacttcttgatgaagccaataaaagtcagctttccagggcctgcacaaggtggaaacggtgtatctcatatagatatccttgcatctcttctattcccatctctgaaagaagcttgaagtgttagattcattagcacagaactaagattcattatagaagggctgggttaggctccctcagaaacccagagggaatgtggtacttacaataccctagagttggtccttgtcatccagcaaggaaataatgactacaaagtctgtgactgatttgattggtggatggatagtaaaaacttagctcagcaaacctccagtcagtagtgttgaagtgggaccctatttagcgtgacgtgctagtgtgagactattagcattccaaggccctccttgcatatggtggaatggaaaaggaagacgagaagggaaaaacatttttttttttttttttgagacagagtcttgctctgtcacccaggctggagtgcaatggtgcaatcttagctcactgcaacctccacctcccgggttcaagtgattctcatgtctcagcctcctaagtagctgggattacaggcacatgcttaattttgtatttttagtagagacagggtttcaccttgttgatcaggctggtctcgaactcctgacctcgtgatctgcctgcctgggcctcccaaagtgttgggattacaggcgtgagccactgtgcccagcctttttttttttttttttttttttttttgagacagagtcttgctctgtcacccaggctggagtagtgcagtggtacgatcttggctcactgcaacctctgcctcctgggttcaagcaattctcctgccttagcctcccaagtagctgggattacaggcatgcaccaccacacccagctcatttttgtattttcagtagagacagagtttcaccatgttggccaggctggtcttgaactcctgacctcctggtccacctgcctcagcctcccaaaatgctggtattacaggagtaagctactgcacccggccaacatttcttaagcctctaattgtatagcagaacctgggctagatgatttacttatttattccatttttgttctcgtaagaacttttgcagtgttttattttctctgttttacaaatgaagaaactgaatctgagagaggttggctagttaacccactcttatatcatcagctaatgtgcaagcaaaacagggcttctaaactaaatctactatgctcaccagactgggagttagaaggcccaccctacctggctgtgggaattggcataaataatttctcctcgagcaagtcttttagcctctcccttcaatcgtttctataggtgttaagtgaggagcttgtaaggggccagaagtaatagaaatgtgagaagcagagcagatgaggacatggcaaactgtggggctggggaccctcgcctgaccagttctacttctggtcaatggatatttggaaatgtgagagctgatttgtcaaaaggagtttcttttgcggggtgtgggtgtgagtacatgtgaaatatcttgattttcaactgttggcaacaaattcacaaaaatgtaaaatatcatcgagcccaaacgaaacagttacctgtcccagacacatatacaatcggtgtgtgccatggcccaaagtcttctataggttttcattcattcagtaaggatttatgaagtgcctgctgtgctaggcaactgtgttaggactgggagtaggatgatggacagaatgtctatcttcttgctccttaggcatagtggggaagatagacttgggaactaaacacaagggcccaagtgttaaggctgagaagtgcaggaggttatgaaacatctaatggggagagactgtcatggagcattcagtttgatataaagatgcagccttcccagggttgctcttcctctccatctgccatttgcttaggtgcttgtgggtacctctcctcctgagtaatccagaggaatccatagcccttccgaaactccactttctaaagaaacattctccaatcacaattgcatccccgttaagtcccattcagccaccatgtgcaatctgtgtcatttcccagcctaaggtcagcccccaatggaagctacatagcttcattgtttctctcccctgctgttcagctcatccatttaagcggccattttttttttaagttagggaaacaaacatttcattatatgctaaattctttggatatactctatgcgtgaaccagactcacttatacagagtgtttaggatttgtaatcacctgcttggaggactgaggcgggtgagtgaagcgtgtggctggagggagggagcctgatcttttaggaccatcatcatgagattgggattagctggggtctcagtgagaggagttcctgggaccaggctggttttcttagcgacagccagtcgtttcacaatagcctcaccctttctactagggtgagctgggaaggcccttttcaatgaagtatttttgaatccttggaggagggagctcccagggaagagatgctgaatctatgtgtggtttttataaagagcagcttttacctcttccttttctgtgcaacatcctgcagtgcttggggggacatttactgagaacattcttaaaatagaggcatggaaaccaatctgtcaggtagaagtgtgcaggcggcaaaaccctggttaccgtgacaccaagctgggatatgagttatcttgtcccatcagactgatcccagttgaagggacactgacgatcatgggaagggctgagtgaccatgcctgcatggcatgaagcctagtatgagggtccctgagcccagctttgtccttagtcattgctgtctctgtggttgtaggcatctggaagacaaccaggtcagcgtcatcgagagaggcgccttccaggacctgaagcagctagagcgactgtaagtacagtacagcctcctttcttaaagtatttatttacatttagtgttttttgttttgttttgttttgtttttgtaaattggccttataaccttgttaaaaaaggtctccagtgtttaaatagaatgtttgctattatacttaaggcacattagatgcatgttaaagaaacactgagatccacttacactccttttctgtaaaagttgctagaatcagctttcagggcttgtttcccttcttctcaggcttgagctctgtcttggtacctgtataaggggctggtttttacccaagtgtaaaccttcccttccacggaggagggaagtctgcagttatccctgccatgagatctggcatcagatagtccctagtcctctgcacgggcagaagctccctcctgaggccttctcctccctgagtgttctctgccccactcttgcggggagaggaaggactggtgagtgggcgcagccttcagcgcgcttgtatctcctgtgagtgagcatcagcctgtgtcaagaagcccccacgtttccacgagagaatgcattgccagtggtttaaaaataggccactgttctgactcaatgagagggaaagaggaaaagggatgggaatggaagatggttggagcctccatttgttttgttgatgaatacttttgcagaaaactcttggattactttgaggagagctgctcagatggttaagtaggcaacttcacctttcttctgttaatcacatctggcagctcataacatctggatatttgctttctgccctctgagcagggattgtccccaagagcacttagtcatgctggtgggtggctctcttcaaagttctctctgaatcttggttgccctgacatttcagcctctttcttctgcagtcagagggatgaagctgcaacagctcacggctctgccggcttccctagaagaactgtgttctgtttacctgtctggttgccaaatctcatttacagaggtgggcttgggtaaggtggtgtgcttgtccctgactagttagctttgagatgtgccatcttttcccctggagtcaatttatctggggccacataagaacagggaaggtccccattgcacgtcagttagtattacccagaaaaatgctttcctccctctctgttgtgtgaaccgtctcatttattgttctccttctgggtcaaatcccagcatatgttctgctggtgttggtttgaaaatatgacatttatttcttgcaagggaaaataattataaaaagaatgaatgttgtctctgtttacacgtttatttttaagtttcttaacactcaagttcttcttatttagaccaaagagaacataaaagtatttgttgaacctggttcctttgtatgaaatattcagcatttctacagaaaaatgaatacgtggtcctttgtgaaaaggccaccccttgcttagccttctgattagaagagtgaaaacaattcccaattcattaatttcctggttttggggaaggaactaattgagtaccttggacatgccaggaactatgccagtgttttacatgctatttgtatttttttattgccacaaaaattcctatgaggtgtaattaccctcattttgcagatgaagaaacagacccagagagactgagtcaaagaatggtcaggaggggagccaagattcaaagccacttctgtctgacatgaaagatgatgttctttcatactcatgtgcagcagatactagatgaagtgtgatctttagtaagggccctgagagtagcctctcgcataaacatttaactccagggaatatcgatgaaatattttggcaaagcctcttttctttggcttggtgaacaaggctgaaatacccatgcatgtctggggaagtgaatggattacagttgcagaggaaacctgattatttctccgtgttggtgtattaggtggggtaatgctagctgctgtgctagataaaccctcaaatctcagtgacttaacacagtggacgtttacttattcatgtaaaacccaatatgggcattcctgataaggcctctctcctccaagtggagactcagggacaaagtcttcttcttctcctcaactttaccctccttaaatcttggcttccaaggtaccagtgtttgtctgcatcaagccaggagaagagaaaacagcatgaaaaatttcacatgggaagtttgcagatttcaagaagtacatgtcacttccagtctcacatactttgggctagaactcagtcatgtggccacaggaaactacagaggcgggaggaaaggtagttgagctttgtgcccaggaagtagaggaaacaggcttagtgaacagttggccaatctctgacttctattgcaagtgatctgaagaagtacttaatcaggaagaacattagaaacacaggcagctgggttcatatacacagctgaatagtcattctcataatacctttcagtgttagcaagaagggatgtgtgtgacattaatcctgataggcgttaatctggttttggttattcgttctgttttcatacagactgggagatgtagaattggaaaacataatacatttgctattaataatatgacggtggattgtgcctttctagctctttctcctggctcaccttatctgtgtctttgtattttgtaatagataaatctttattgatcacattctaagatagagcctggaaataataggggttataatacttcatttctggagggtttatttccactctgagtagtcattattggtttgttctcttgggtcttcctgggaaagggaaaggaagtctgtcctctgggtctcaacttagaattctctattcccccatgaaagtaccctatgcctctggctgagttaggtacccctactctcataacacaggtgtcttcctatcacaccacttatgacaccatattttaattccctgttttctggattgtttcttcccaaaaccatgactgttgaggtcaggattcatgtcccatttagctcctaatctcacagacttgagcgaggcatgacagtaagtgcttgaggaatatttattaaagcgcttgagtttttgttctatataagtgattctaagctgggcctaattttgccttccagaggacacttggtaatgtttagatacatttttgattgtcacaactgggagatgccacccagccgatggggtataggaatatctcaacatctttaaatgcacaggacggccctacaacaaagaattattcagcccaaaatgtcactagtgccaaagttgagaaattctgctctttatcatatgtcagatagcatgtcaggcactttacatataccatctcatgtaatcgatgcaagaatactgtgaagttagaattatcataaaatatgatgtgataaaacatgaaactcaaagtatcacctacgaagtactttgcttaatatatttacctaaacctaatttagctggatctcacttctggttgccagagagtggatgggatataggaaaaagttaaaccaagaggaaacaaacacactttgtaagtgggatattctttgagacagctgccctgatcttttaaaaaagtcaatgtcaagaaaaacatgggagttgacttttaagttcaaaaaaagcttagaatagaatagaaacagtaccacaaaattggaagggtcaatggaattaaaatgttctaagatccttaaattattcaggaagtaatagtgctaatatttattgccttattaagtcaaagatgtatgttgaaatctgtagcatagcctctaaaaaaaaaaaagccaaaaaattatgatagtctcaggggaaaggagcacagtatgatacaaaatatgaattaaaatgaaggataaaagggaaggaaaatgaacatagaacaaatagacaacaaacagaaagatgatacatttaaacatgaatatatcatattaccttatatgtaaatgcactaattctccaattaaaaaacatagattgtcagtgtatttaaaaaataccaaacatatactttttacaaaagaataacattaaacataaggatagagaaaacttgaaagtaaaaaaaaaaaaaaaaaaaagaaaatgatagcatgaaaacactaaccgaaaggttagtgtcactctattaaagataatatagactttaaagaaaatatattagatataaagagggaattttgtaatgataaaataggaaatatcccaggaagatataccaaatctgtatttgtatgtgtctaaaaacatagcctgaaaatatggaaagcaaatattgacagaactaaaaaaaaaatagacaaatttataatcatagttaagatacactttttggtaattaatagaacaaggaggtacaattcttggtaaaaatatagaatattaaataacaatatttgtaaacctgatgtaactgatatatagagaacactctaaacaacatagaatagacatcttttcaagggcatatgaaagttttattatatactgatctagaaagcaagtcaacaaataccaaaggatatcatatggagcatgttctctgtcagcaggaataatcaagaagttaataagaaaagtagaaaaatccaaaatattttgagattcagtaatatacctctaaatactccgagttgaagaacatatcacagtggaaattagaacatatttttctgaatgttaataaacatacaatgtctcacaatgtgtggactgcagccaaagccatgctcagaggaaaatgtatagcctttaagctatattattcaattcatggtatatattatgtatagtatctattttaaaagaagcacatatcttgattaaaatatcctccttacaaagttagggcaagaacaacagaacagaagaaaggaaattattaagagcagaagtataagaaatagaaatgaatgtataatagaaaaattctaaaaagccaaactaattcttgaagcaactaaaattacagacactgacaagacatatcaaaacacaaaagactaaattaccaacatgaagaataaaaagggggatattagtatggatattataaatattaaagtgataataggagcagactttgaacaagtttatcttaatgattttaaagagtaaatgaaattgaaaatagaaacaggaaggaatagaaaatctgtcttatatcaattagagaaattaaatatttaaaacattccatcaaaaaatctaggctcagatggctttagcaataaattctaacaaagttttaaggaataaagtatagcaacttaatacaaactcattctgttaaaagaatgaacatttgtctatttagccagcataaccttgagaacaaaacccagtaaggacatttcaagaaaaaaatataaaccaatgtgattcatgaatatttttacaaatttcctaacaaaatactagcaaattaattcagttataggtgaaaaggataatatattccaaccaaatttagcttattcaaagaaggcaaggttggtttaatagtggaaatttcacctctcaaataaaaacatgctgaaaaactaggacagcaaaaccaaagacatacacaacatctacaataaaattatttggagcagtaattcagtgaatccccagtagatggtttcaagactgttgtggtatctcatctgtgtgggagaaagcagagggaaggcagctacggttcttaggaccctgagaagagggcatcccttaaattacccatctctactcattggaaaatacagtggccaatctgagaaaagctgcaaaatatagaagagagttctatcagatccaattcatggtaagtacaaaggaaccatgatgtaataatgactgataatacttggaacattctggggcctataaactcttcaaacaaaaatgaggctcttttcctaggaaaggtctaacattggtaagaaacttctgggagcagttgatcagaaaaggaacaatagtagaaataaaaagagaactccttgagaagtataatgttagaattcaccagaagagtcaaatcttggaaaatacaaggccatgtttttcattgctttgcaaaaaccagaatgagctctagagtcttaaatcttaaaaaaaaaaaaaaaaaaaagctatttcactgctccattctaaaactacagggaaatttatttcacttaaaaaataagcagttaaaaggattctgattgaagcccatataaaggtttttaaataagaaaaagtatgagaagcagaactttcttagaaacaatgaaaacatataaaaggagatacccacaaagcaaataaactgtaatagaatagttgaaaactggctagaagaatttaagaacatataaattataagagtacaacataagtctgaatttcaaaaactcagaaatttaataagagaaatgtaggatttgaaaggaggggtgaagaactcaaaaaagaacttaacaatagaagtacttcaaaataagtactgccaatacaatactgaagaaaaactaacttgtagaaattacactatccagtttcaagacttactgtaaagctatagtaatccagacagcatgatatttgtgaaaaaatagacacacacatcaacgggacagaatagcgagcccagaaatagacctatgcaaatacagttaactgatttttgacaaatgtgtaaagataattcaagggagaaggaataatcttttcaacaagtggtgctgatacagaaaaatgaatctggatacaaatcttacatcttacacaaaattgaagtcgagatgattcatagacctacatgtaaaatgtaaaactataaagaaaatattttcaaaacatgtatctgataaagaatttatatgcaaaatatacaaagagatttaaaaactcaacagtaagcagataccactctccccctataaaggaaagaaatggacaaaagattcaaataggcacttcattgaagaggatatacagctggcaagtaagcatacaaaaacatactcaacagcttctttcattagggtgatgcaaataggtgtgtagtgagatactactacacacctattacagtggtgaaaatttaaaaaattgacaatgctaattgctggtgaggtggagtaacaggaactctcattcattgctgacagtaatacaaaatggtacaaccactttggaacacagtttagcagctttttaaaaagttaaacatagtcttatacaatccagatctatggttgctagggattcagagcagaagagggaaccgaaagttgaataaagcacagtgggggatggtggggtttaggatggtaaaactatgctatatgataatgaaatggtggatacgtgacactatgcatttatcaaaacctataaaattttacaacacaaagagtgaactataatgcgtgcaaatttttaaaaagtcatgtaggagagtggggtatcccgggatggaatgcagactgtgatgaatgtatgcatcagcgtcactgaacttaagggagcaaaggtgctgacctaagctgtggaaatgagtggagtctgtaagactaaaggcaaaaggaactgcacagaagaactgtactctagttggtaaagttgtttcccctggggatatgggttaacagttctgagacactgtacacgtatactggaattgaacaatagatggtggatggtgaggacagatttcttgctgttgaaatgggtggttagaaacaaacagtggagaaagctagaatatgtgggaatggactagagtttgagacatcagtatcaactcatgtttagcctactgtaggtacttttatttaatatcaatgaatatatacatagaaatatttttgatacatgtatttatatgaattaatatgcaaaaaatatttccttgctctggctgggtgtggtggctcacacctgttatcccagcacttttggagcccaaggtgggtggatcatgagatcaggagattgagaccatcctggctaacatggcgaaaacccgtctctactaaaaatacaacaaattatccaggcatggtggcatgtgcctatagtcccagctactcaggatgctgagacaggagaatcacttgaacccaggtggcagaggttgtagtgagccaagatcacaccactgcactccagcctgggtgacagggagattcagtcaaaaaaaaaaaaaacaaaacaaaacacttttcttgctctgtcagcaagagggcctggaagcaacaacactggagtagcaatgagcatgcccagcacccagttgatgatttttaaaatcattttcacacaaaaaggaattaaagcgtcttggaaaaatggtttattctaggactgaggcatgttgttgtgccataaagggagtgctcaaaacaaaatgtgaaaccccacaatttggggagtatgtcaaaaggacgtaaaagcaaacaaagaattcttagtggccaaagctggaacaatttgagtaacaaaataattattgaattattaccaaagtttaaatatccatgagtccatactcacagaaataaatgagtaaataaataaatggaataaagagaaagatcccatacagaaaaattctaactaatttgttgtgtaggttctctgccctctaggagattgaacctaactcactgttccttaaatgtggacttcacagagacacttccttcgaaagagttctatgtgaaaagggaagggagtgggcagtagctttacaatggagaaatatgacacacaccaccttagccgtgtgatcaaggtcagtgtcaacattgataaatcatttgatagtatgtactttcgatatgatgcaatgaaaatattactttgtatctgtgatcttcctccccgaaacccatcatctcagtcttaagtgaaaaacatcagacaaatctctattgagaaacttcataaaaaatacctgaatagtcctcctcaaaactgttaaggtcatgaaaaacaagggaaatcagaaaaactgtcacagccaaatggagcctgaggagacataatgactaaatgtaatgttgtatcctggatgggatgctgaaataaacacagaaagtaaaaactaagaaaatctgaaaaaagtattgactttagtgaataataaatgcaacaggattgcttcattaattatgacaactgtattatataagatgttaataggggaaattgggtatgggctatatgagaactctcagtactatcttcccagcttttatgtaaatcaaaatctattctaatataaaaagtttttatgctgacccatgaaacccttcttgatttacagacttacgagcaaaataaatgttttttatgccaaaaatacatacatatattttaatctagatggattttaaaaagaaatggatgaatactgctttaaaagaaatagaagatggaaagagtattcttaagtcaacaagaaattaatatagagataaagggatttaagagaaagtgagagttaggcaaagaggttctaacaaacttataataggaatctctgaggaagaaaacaatggaacaaaacaaaactgatagtactgataattactattcaagaaaatgttcttaaaagatgattagaaggtacctcgaggaagtgcactgaatgtttggaaaagtcaactctgaggggtcaaaacaaaatatgttctaataaactattacattttaaaggaaaaagtccttaagcattcaatcagagactcataatgaaagaaaattggatttcttgcctactttttgatgccaaaaccttatgtcagaatacaagtgaataacctaaaaaaataaaatgtgagcaacagcatttatatttagccttgctgacattcaagtgcagtgactgcagactacctattatgaacattcaagaacttaggcctcatggtgcccatggacactttctaaggagtctacaaagaacaagcttcaggctggatgcggtgactcacccatgtaatcccagcactttgggaggctgaggtaggcagatcacttcaggtcaagagttccagaccagcctggccaacctcgatgaaacctcgtctctaccaaaaataaaaaaaaaattagccaggtgtgatggcacacgcctgtagtcccagctactcaggctgaggctggagaatcacttgaacccaggaggtggaggttgaggtgagccaagattgtgccactgcactccagcctgggacagagtgagactgcatctcagaaaaaacaaaaacaacaagcttcatacaaccgaaagactggagagacattggtataggacagacacagtcaacacttccaaaaatcctagaagttggtgcggaaatgtgactgcgtctggaattctgtggaatgagagtagaagtgacatgcccttcatgaccctccatacttgtactctttccctatgttggctaaattgacagcactctaaggaggatgtagagctacaaagtagaaggatccagggcccctgctgacctgaatttggctgtgacatgaacaacaaatatacttttattgtttcaaaaataaagatgtaattaatcacattaacagaagaaataagaaaagtcatttcctcttctcagatactgaagaaagtatttaataaaattcaatactaatttgtgatttaaaagcattttacatattaagaataaaagggaaattctttacctaaaaaacctacagcaaacatcgaagttgatggtgaaatattgaaaacgtttctcctaacagaactagactcctgccgtcatagcttctattaaacactgtattggaaattctggttctggcaatgattcgaaaaataggaaaggaaggaagggagagaaaagggagggaaggagagagaggagccaaaaaaccacagaaccaaggaaaaagaatggatataaagattggaataaaacaaatttaagtgccattatttaaatgatggattacatgaaaaatataaaataatctacacataaactatcagaattcttttttaaattttaagttccggggtacgtgtgcggtatgtgcaggtttgttacataggtaaacgtgtgccatggtggcacattagattgtaaattgtgttgttaggtgcacaaaggctgcatgtatcaacccatcacctaagtattaagcccagcacacgttagctattcttcctaactatcagaattcttaagtagatttctaaggtcactggacacaaggtcaatacaccaaaaaaaaaaaaaaagacaatttctatataccaacaacaaacaattgggaaattaaaaaaaactatgtttacaatagcaccaaaaaataccaatgccgaccgggcgcggtggctcacgcctataatcccagcactttgggaagccgaggtgggcagatcacgaggtctggagatcgagaccatcctggccaagatggtgaaaccccatctctactagtaataaaaaattagctgggcgtggtggtgcgcacctgtagtcccagctactcgggaggctgaggcaggagaatcgcttgaacccaggaggcggaagttgcagtgagccaagattgtgccactgcattccagcctggtgacagagcgagactctatctcaaaataaatatatatatgtgtatatataccagtgcctaggaataagtctaatgaaagatgcacaggccttaacacagaaagacagacattactggaagaaattaaagatgagtcaaatatatggagtgctgcatggtgttcatgtattggaatacttaacattgcaaatatggcaactctctccaaattgatggatggattcagggcagtcctaatcaaaatgccagcagcttgttgttgtggaaattaagatgatgctaaaatttatataggaatgcaaatgaccaagaaaagcaaagacagtctagaagacccagatatagaaggatacttgatttttaacaaaggtggctctgtgaggccacctggaatggatggtctgtctaaaaaattgtgctagagtaattgggtaaccatatggaaaacttgttctgttgatccctactaatgccattcataaatcaattacaagtggattttagaaagataaagacacttctagaaaataacaatattttttggccgggagtgctggtttgtgcctgtaatctcagcacttagggaggctgaggtgagtggatcacctgaggtcaggagtttgagaccagcctgaccaacatggcgaaaccccatctctactaaaaatacaaaaattaggcaggtgtggtggcatgtgcctgtaatcccagctacttgggaggctgaggcaggagaatcgcttgaacccaagaggcggaggttgcagtgagccaagatcgcaccactgcaccctagtctgggcaacagagcaaggctccatctcaaaaaaataacagaatattttcgtggccttgaggtagttgatatttcataagcaaggcacagaagacgctaaagagaaaagatgatttggactacattaaaataaataattcgccaaaatacattattgaaagaacatgtcccagagtgggtgaagatattggcagtgcatataactgacaaaggacttattttagaattgagaagaactcctacaaatcaataagaaaaagacaaatgactcagtagaaaaatgggtgagagttttggacacttcgcaaaagaagatagagaagtggccaatgatcgtatgaaaagttgcttagtgtgtcattagtctttagggaaatatagaataaaaccacaatgacacataccacacactaattggaatggctaaaacttacaatatcaagtgttggtgatgaggtgaaacaactgcatttaccatatactgttacgggagttattgatacagttactctcgaatatgggcagtaccaatcagagctgaatgtacatgtaccttccactcttgggtacataccctacaaaaagacatacacaggaatgttcatatcagcactatttgtagtagccccagactggaaataagccaaatactcgttgacattagaataaatcaatagactgtggtgtattcatgtaatggaattgactggtagaaaaagaaaacaatgtgcaaaaaaaactgctgtctgtaaccacatggtaaatctcagaagcataatcggggacaaaaaccggacataaaagaatatatattacctgattccatttgtgtaaacttcaaaagcaggcaaaactaatctatggtgttaaaagccgaggtggtgttaagcaatggggagttgcgaatggagaggggcactaagggatttctggggcgtgtcatcagctgtttcttgatctgggtagaggtttcatggatctgttcagttggtgaacatgcttcaggctgtacaaatttgatttgtacatttttctgtacgtgttatacttcaaaaaatttattttaaaaagagactcaagagacagatataacaaccaaatttcatgcatggctctgacttgaagctgtgagaaaacccatacagatatgggacattgcaaactccacagagacagtggtctcagctgggaagtgatttttttcctaatcaatgttacaatgaagggacattgaaggaaatgccattattcaaggatctgctgcactttaaaatggttcagtaaataaaataaaacaaatgtagcaaaatgaaaataattgttgaatctaagtggtggatatagggatactcaaaatatatttatccttttctgtaagtttgaccattttcgtgactgaaaactttttaagatgcatatttaaaaaaaaagttttattttggcagaggaaaaaatctgaaagtcagatagttaaagaaatttaccattctgagatttgaatccaggactgttctgaatccaggtaccaggaaaagaaaacaaccttcaggagtcagaaggagattgagatattgcattatccaatttcctcctcttacagaagaggaaataggctagaaaggaatttgactttcatgaaattttaatgcggagtgcaacgtttaaagtttaagttgccttggtgtgttagctccgtttttccaaagaacagaaaaaccatgacgtttttagctctaacccagagttccatttactctttcattagatgtgaaacaaataattagattacatatttaaatgcatatgtgtggcaaatatattcttttaaattactgcaagagttattttgctcctagtagagaggaatcggcttctgttatgtgcgttatgttccttagaggtttagtgggttctagcctaagtatgcagagattcagagcatgaactttagagttaggataaacctggatttgaatctggataaatcttctcatttcacttaccagtcatgagattgcaggcaactttcttagcagctgcgagtaacatctgttaaatggggttaatcattgttcagtggagttaccttttaaagagagacctgtttgtagagttagcatggaggataaaaatagaatatattcaaaatgattgacaggtatagctcctagaaacaagacatgtagggccatgtatactgagaagtaccattgattactgaaattacactccatgaaatgcttatacagtgagcagcagatgaggactgtgagaccgaaggaagagcagattcacatccctcgtctcagggtcatttgcgggcacaggttcattgagaagaatggctgtaggatcttcggcacctcgaatttctcaccttctcttactccttcccccttaatttttgctgggtgcctatgctcaggttcacttacaagttaaatgcatgtacgccatgcctccattaacccactttatgaggctcttatgagattacctatatgaagtgcttcattttgagatcggcacagccatcactcagtgatttcagcactgctcctctccctcatcatcatcacggcccaagagtgatgaataaggagagagagagagagagagagagagagaagaatttatttgactaagtacgctttacatttttactcattggctttagtccatctcttaggtcaaacatcccatgccaaatacataccaaactggcattctttccctgttctcccatcagaagctgctgaagcatgcttcttctcatctgaaaaatgaacttaatagtcttttatgtctgataggaatgagggtgttgtcagaaagtatgtatgtgttaaagtactctaaaaagacatacagacaaaacaatgcgagttatcgttcttatttctatattactatccttagtgggtaagcccacattaatctgttgagagttgggcctcgctctttcccctcaatgtcttgaagatcaaaaaaactagattttagttttgttttattctttagattccatttttttggtagaatttggaaaaaaaaaatagctgaaggatcgacttctgcatttcaaagcataacaaggagaattgttgtgagcctgggtatatgtcagccaagttttgaatctcaaaatgcttatgtctccctctctctctctctgtctctgtctctctctcaatctgtgtgtgtgcgcacggcttctccaagatgtggaggtttggaataaaaatggtgattgacctttaacgagagagctgagagaactgcttctgtatattacatggctgtgcgctggattttaaatgtttgattaagttattagagtgttttgctttggcataatgtactataaattcatgatttctggccaaagcagttagtcagtggagaagaataaattattttgagaggtgcttcaaaaccaggattttattctcttggaaagacaaggctttaaataaatcacataatataaatgagaatttccataattaaggttctaactaggaagattcctaggagctttcagagcaggaaaatgaaggaagacattccagtatgctttaattctcatgttttaaaaaaatttgtattctgaatgttctatttcgttttagaggcgcagagaccaaaaagcaccaaacaagcatacatgaagtatatgttgttaaacactttgtctccaagatgtgagtgctgtagggggattgacatgttaaatgtattaaagcaagtccaggaaggctctggtgttgcattgcttccaacagtttgaggcccctgatgacggcacccgtgtcattacttagagaatttctccgggcagtcgtcactccttgtcacccagtaatttcattttctggcagcttttgtgttttcagagtatgttctcctgctttggtgactttagaaaatctctcttaaatggcagctcctcccctggggaggcctttttggcccttgacctcaggttctctccccaatattcttccagcagtttcctcaaagtcccacagtcgctcttcagcactgctaggtttttctcccaggagctcctaagtaaataaaatgcaattaaatatatgtgattggttcttgtactgttttatttatgtgatatatgtacacaccagagaactgtatactgtacagtgcacaaatgtaccatttataattgattcagtagggccatcatagtcatttctagaaaaaacatgccatcaggccttccgttgggaacctgggcacttacttagacatgtttctctaggatcaaataagataaagttggaagattgcagagtgcccccacctgtattgccaaaatgctgatattttagacatcatcttgaagatgaggagcacaggctaagacctcaggctccccctgcctgaatctcagctcctcctctgccagctgtgcagatttaggcaagtgccttcatctcctcatctgcgaaagggggtaatagaagtattaggttagtgcaaaggtaattgcagcttttgccattaaaaataatgagaaaggtctgggcgcggtggcacgtgcttgtaatcccagaactttgggaggccgaggtgggcggatcaccttgaggtcactttgagaccagcctggccaacacggtgaaaccctgcctctactaaaaatagaaaaattggctgggtgtggtggtgcgtgcctgtaatcccagctactggggaagctgagacaggagaatcacttgagcccaggagggggaggttgcagtaagccaagatcgtgccactgtattccagcctgggtgacagagtgagactttctaaaaaaacataataatgacaaaaccacacttatttttgcaccaacctaatacctacgctgagttgttgagaggactaattaagataacgcatgtaaggtgtctagcaaagtgcctgacacaaagtaagtccccataatatgcattaaccattaactatatcatcatcctgattatcagatttaagtggcgtaatttagtatataaatcttgtccaagaatgtaagcaagtgtaaattagaagacagactgttcagctattccctacctcatgcttaagtctgtgcctcccattcctatatatgccagtgcccactaggggtggccctgtctcctctgtgtcttccacccctcccacttatccattatcttgtagacctgtggttgcctggaacccgcccttttccatgttagtgggttccccagacacaaacacagtgtgggggctttagtgataggactgagggaggcagggccgaggggtgtgaagtatgcagacaaagtcactgtcagtctagccttagtatatatctcattgaggcatcccctttggtgcagatgttaaaatacccgcctccagtgtcccacattgtaaaacgtagaagtgaatctaggccacgattctagcaaaaaactgaaagtgaatcttacctgagtctttgagcctcctgagacccattgttaccacctctatagatagagacagagtaagagaagggactgaggataatatggggtaggggttttgattctggccttaacctcacccctagaatgcatgaataatgcttacatttattaaacacctactgtgtctcacactgtgcttggtgctttgtgtctactgtctgatttcattctctgagctagcctgcaaggtggggactattatcagcatttgacagatgaggaaacaatgtcggcgaaggcacccaatttgtttttagtcccgaagatcagagactgctacctgggaccaaagctcaggcccctcttagtgtgttctaggccttcagggactcttgttttgtgactggactgagtaggggggtagtggggatcaggccactttttgttcaatcctggaagtgggaagggtcaggggaagaaaaggggctgcagaggagtcgaaggtctcccaaaggtgtgcctcagcaggagactctctgacccagaagcccagccattcagctttgcccccctactcctctccccagtttcctgagagctctggtttctctccggctctgtgtctccagagtgcctgctgcccagctgtaagtggttagtgggcataaggatggggattccacatctgtatcgttacacccaggggctggcagagactaaagtggggtatggagggcagagatgggggagctgccttctacggttggcctttccctctccccttgcctgcttatccactgtgctgatctcatccgcgccattatcttctcttgctcaaaggactgcagacctcctctcttccctgtctgcttccactctggccccacagacaatgtactccacactagagcagccagagtgagcttcccaaacacagactatgcttaacacccttcctcagcttcccttggctcttagaaaccaaactttggttccctgccatggtgctcagggctcagtagcacctggcccctggcccctgcctccctctctagtgtcacctctgcttttccctctattgggaaatcaccccctgccgcccaccccctgtcttctcttttgtggcaactgccattcatttttcagctcaaaacagtcacttcctccgggaagccttccctgcccctcgggcgtggccccactccagtctcatacagtcttatggggcctttgttagtggtgttggcttggcatctctctctctccttagactataaggcctctaagagggaaaccacatatttgtgtggccaaagcacagtatcactggtacctagcatcgtgcctggccggaacccacacttggtgatgtttgctgtgagagtgagcagcgtcctgctttggaatcccagtcagagcactgagagaggggcagccagacctgggagctctgtgttgcccctgccattgtccttacatctccagttagagagattttgctgggttattcttcagcctgctcttttcccacccacttgcagtgggagtggtaaaaatctagaaaaacttccagtagttaccttgtggggccacacccctgtcccagtgatggacctgtctgtaaaacacttcttgtagagccttggcctctccctggttgtcatacaagacttgtcacatagtgggtgcttaggaaacatttgctgaattcccagcagccaattattttgagtatccttattagtaggaagtacttttctcttatgatgtaatttacataaaatatatagattttaagtgttacatattttaaagtgtgtatttaatttaaaaaatgggccaaacgtgggggctcattcctgcaatcccagcacttcgggaggccaagatgggcggatcacttgaggccaggagcttgagaccagcttggccaatatggtgaaaccccatgcctaaaaatacaaaaattagctgggcatggttgccggcacctgtagtcccagcttatcgggaggatgaagcatgagaacagcttgaaccctggaggcagaggctgcagtgagccaagatcgcaccactgcactccagcctgggcaacagagtgagtctgtctccaataaagaaagaataataataatttttaaaatgggcctggctgagtgcagtggctcatgtctgtaatcccaacactttgggaggctgaagtgggaagatcacttgagctcaggagttcaaaaccagtatggaccacatggtgagaccccatctctacaaaaatacaaaaggttagccacgtgtggtagtgcacgcttgtagtctcagctacttggaaagttgaggtgggaggatcacttgactccaggaggtcgaggctgcagtgaaccgtgattttgccactgcactccagactgagcaagacctagtctcaaaaaaaataaataaataaataaataataaaaaattttaaatggacaaaccatttggaaccaggtggaataaatacagtatgttggtaagctgggtgatctcctatcatagtaattttctatatgccatctaatttctgtagtgatatcctattgtatgcctgacaaatatgtatttcttgttttaattcttaccgttactctatggagtgcatattatcatcccattctaccagttaaaaaaaggacccagtgagcttaaatgagaccaaagtctcattgctgtgagaagtggaggcaagatttgaaagcagctctctttagcttcaaagctaatgatcttgccatttcctaatccgatgtatcttcttaagactacttagtaaaagacgagatatgattacaatgtcaaaagcctgtttcttttgtgtaccttgtacacagcctctagaggcagaaacaaaggtgaaggacccatttatcagccctccccattgcctgcagcctcctcctttccctccatgatattcctgcagatggtccggaagacagattcacaggcatttctacagaaacagatctctgagtcagcccttggaaaaaaaaagcaatctctttgctggttttgtttttcttggttgatttatttgacaaggacccattttgtacatcatttttggaatttcaaaatcttttttatctccaaaggtctctcctaaaaagctcaaggagaaataaaagacaggctatgtatatgactccagtgtgatgcttactgaagcctgagccctgcctttgcacttggttttctgaccctcagatcacccaggttgcagtatagaggcctgaacagagctaaatcccatcaggtaggagtcctgatttgcactaatccctaactgcacgtctctatcacttttgtttgacttggcaggacacctacgctgctaaacgccatagaggaagagcacatgaattattcactttctaacagaggttccttggtgagattaggtgttagaaccagccagcaaaaggaaaggtccccaactctggctggctgcagactgcagattcagtcactcgttctttacctagaggtcatagcatccccactccaaggctttctgcagagatgctaggctggtgttcctgggatcttggttttggcaacaagtcatttacagaggtatttctcatcccggcacatggtatgtcagatgctatcaaaacaggcactgagcttccctgggaattctctctggtttaacatgtgtttcagctgtgggaaaagcacaggaaaaaaaaatccggactgaatttacagttgcctttaataacccatgcagctaaatttattaggtcacagtgcccctttgaactgtggcatggaattttccatgtagcgtctagtttctccggtgagaagcagaccttcccattcggttttggccatctgtctccttgttgagtgaactcccatgtctcagccattttggttaacaaccaactttggtcaacggtgggctggggagatttcaccatggctcctggtgcttctctctgggtgacaatggctgaagtgctaacctgcattcatgtaatggctctgcatataccaacactgcatgaaaggactggatctggagacattcttcctaaagcaaaaattctgcattatgttttgcaagctaagctttcctgagtgctttgttgttttactaagagtaagttacggcatagcttgtcagttttcttagacccttctacttgaaccaaaaactgaggtgtttttttcagtagcttccaagtctcaaggcctagaaatcaaggaaataatttgcttagattagatcctgaactatcttttttttctttcatcacaatcctgacaagtaattgtcacctgagatctaatcaataatcaccaaattgatattgagcatgtactgtgtgtacgattctttactagcaatggtgggaaatataaagacacaatggagtctattgacttctgagtcattattttccttctacgtgccccaaggtgtagccagcatagtattttcatggatttttttggtgatgtatgttagatacacagcttttcaaatgcatgaccctacagatacttttgcttaggacaaagatatagcagacatttaagtaaaaatgaaacaggaattaattcacagaaatatattaaatcatacagataatacatagaaagaataacaaggtagtatgtgaatgattaaaaatctcaaaagccgccatcctaggtgtacttcaacacacatccccaaggacccaagtcagtttattattcaaggaggtaagccaagggcttttgagtatttgacaacacctggtcattaacttgcatggctcaaccacacagccaagccataatggacttttaatgaaattgttgtcctgtacatcctatgtatttcccggtgtcattaagatgtaaagcaatctctgtacatcctatgtatttcccagtatcattaagatgtaaagcaatctctgcaaccttgactgtctggatgaggcagagacatagtgggaagaaaggagcttctcagtgaagtgtgcacatcccactctgtgcattggcattggaagagggataccaagacgtgatgaaaggcagacacagcactaggaactgatggctggcgggggagtcagaggaggaacggagggcgaaggatgtctgaaggcaagtcacacaccacacatcacctgagaggagctggggtagtgaccacccacccttgcaacagaagcagtgaataaatcccaccctgcgcccctgggggagcctaacacccattcagatgtgtaatactgttgagtgcactgagtagactaacattgtcttggcatctctctggtgactaatctgtgggctccctgatttggttctgagttaagtggtctttatgttctaattctggtagccctcaacactgatacatcatgtccacgattctgcccagtgtattgacactcacataatgacagcctgttgaatgggaagaaacagtgcataaacaaaagagccggagccagagagaaagcacgaattttctgagccatatttgctctaatggaatcatgagattttcttctgttggtgtgagccaggatttcaaacctcaagtagatttgctcttgcactttgagctctaaaagagcttaagtttgattatacaaagaaatcagaaactagcacaaaggcaaaattgcctgatagagaaaatgggttctggaatcctgagccctcacaatgactgcagtgggaccctatgggttagggatctcaggggtgtcccaccctaagaaaaagcctgagggcacatcatggggcaaagcactttgtctcgagaaaccagatcagttgattaatacaaagagtgagagctggaaatgggagccaagtgaagggtcagatgccagaaggggctggtacagaagggagaagttggggggtagtaggattgtatagatcgagtgacctgaaggacactgtcccatgttggctgacacctgcaccaagctttgggagtagggttggtttgatgagccagtttggagcaggcatgtgagatgaccatatttctctcagcaagttcatgtatttttattgttactattgactacttttgaaattgaaagtagaagtacatattcatggtgcaaaactctcaaggattagaagataatataaaagataaatattcctgccttacccaatttctggttcccctttccaaatgtagctattgtcgtctgtcttttatatgcttccagaaattactcttatacaaacttatgagagagaatatatatgtgtgtgatctcatataccaatcagagccagccttatccatagttggagaagagaatcatttatttggtgtgattaaagaaactcaggaggtcccctagccaaaaaaatacacatccccaaggcctactgtagattgaatatttttcaaccatttgagaattttccttacattgatttttttaaaacctaaaaatttaagcttttttttttttttccatttggctaggatccatcttccagtttgtgaggaagagggcctgtttgcaagtgagttgattttagtatcttctctctgcctgaggatccccgccatgggaccagtggctatacagggcactgtggtgtccagagcaatgtggggtaccaaggacagggcaggaggtgaatgggaaagccatgagtcaggtggcttgcaagaatgagagtggtgctgggtctaaagaggggagccaggagacactgctggagaactgggggctgggacaggatccccatcattgggattggtcacctcgtgtgtgagtgagcagacgtgagctgaagacaccggcatgtagcagcgaatcacggtatccatgtctgattctgcatctgtgtctcacacatagaatgtcaagtcttgcccactggagacttttcgagatctcaaaaggctttgagagcaatgaaggaaaagccactcaaggaacactcagctatgatcatgttcctttgttgacagatgcctgtctttatacttgggtgataaactgcttctgcgatttcatcttttgaatttccatgtggctctatctcaggataggaatagacaccccggaatgtgtcaccactggcttctagctgaggctgagtaagatgagaagccctcccttgggcagggtcatgcatctgtgggtcgtggggtgagccccttgctgcattcctcagcagggcccacccctgccacctctgcacagctcagatagctccccacccaaacaggatggacagatagcaggtaggtgttggttgatgaaggcacagataaggtgagaggtgcattctgcacctgacagaagtcctgtttcagccacttaccagtagtgtgatgagttgtatgacacgtaacttcagttttccgagcttcagttttattgtctgtaaagcgagattaataatggtctgcaccttctaggcatgttgggggattaaattaattaaaacctacaatgtacttatagcactggcagaatgcattcgaggaaggttaggagttgctgctgttacactggaaccttattctgcctgtcagcagaggctgtggtctgtgctggaggtgggacagtcgtctcctgtggtcttttttcttctgataataaaccacccctgggcagggctggagctgcttcatgtgtgcctctgtcctgggggaatgtgtcctaaggcggcagcgctggtgtgtttgctgatctaatcaggagagagattcagggtccattctgttgtttacattggctctggacctaatcttgtctgtcttgaactgtaagtctaagaggatgggccagatctgatctggttcacatactgttgcaggattggagcctcccaacatttcagtgataaatcattgcagctggagaccgtggctgggttggtggcaacctcatcttaatgttaccagttgtatccctttttaaacatctcattacctaaagagtactcagttggaccagcattctgcattctgccttgaacactgagtttttaacaaccatgggtagcatgaattcagcaattaccagctgcaagctctgtgttaaccacatctatacgcatgatcttaagtaagactcagaactacccagtgagttagctctgtaagtctccccctttgcctagatgaagaaatggagttttaggggtgttaaatcactcgcctaaggtcacagagctagtgagtgcagaaccagagtttaggcaatctagctgcagagctctaaactctcaatcccttaatgttcccgccagtcacctggagatgtggttgtgattgacaggcagagtcagaatcagcagatctggggcatggcctgaggtgctgagtttctcacagactcctagaagatgctgatgctgctggtctctggcccatgttttgagtcacaaggctctcaactaggcagccacatagccttggctggctttgttatctagtttgttttgctgggtctaaggtgtgatatcatgcacaattgcctggcagccatccacttaccaattcatggcgaaggtgatatcttgtggctttcctgagataatgatgattaagcaaagatctgaagtgactcaaaagaatatggggacatttgaaggacatacagtaagcatgcagctggtacaaacagtccttggtagaaaggagcatggcctatgaaaatatcttcaaggaagtccaaaagcagacaccttcttctttcttcactactcggagacctccaaagcattttgcaacatgctctgcccatgttaggcactgaattaaatttcaagtttgggtgtgagacgaaaaggtctcgctttctgtgaaaggtcttgctttctgtgcaacctcacccatttcttcctcagaaatgtcttagctggacagccgggaaacagcagctgccattccatctctgttctgtgtgtttcagccagtgaggaatattgtctttttgtctcaatgatccttttttaccacatggttaatgacctcccacctctcggaattgtgggtatactttggaagagatgtggccataggtaggggttagaatcacagagcggcctgtgtgttgtattcatatgctcattgattcagcaattactggttcgttgcctactgcagcagacactggtgttgagcgtgcagtaaagaacccaggagataaatgcccctgacttccaggaacttgtgttgtaccaagggcccccaggaaccccaggctggatcagggccactagctcttcattagacctgtagagtgtttgtggcaatggtgtcatgttctcctggattactacaacattcaaatatgctccccaaacccagtcatccaacactggggtcccaatccctcagccacaaagtcgagccctgggattgccacgtacttcagctgtgagctcctgggacctaggcataatttgctctatattttccccaggaactctgccctgcttacaagtggagagtgtgtgaattcttgagagagtcattgtcttttaataagaagaaagaaagaattccttgtttacaccctgcttgctgtcttcacaccaatttattcacacccttggctcacaaaagaacttaaagtttagctccccaaggctgggggaagggtagaaagtctaagttttttttttttttttttttttaacctactcaaggtcttgtccaaacgagttgtcaccgaaaaatgaaagccagatgttattttagtgaggaataaatatgtggccaagctgtggattgaacctgaggtctccccggatggtttccatgtgtgttggtagctggactcccaggtatcagtggctcacattctttctcttgtcttttaactgaagtacggcacacacagatggctaatgagcaattaacatccgagccacgcatctccccgtagcaatacctatcggctcataagtcggtttcaaaccagcactgctgcgggctgctgaatttgggatgacagacatataaagacccacatccggaaaagagagaaaagacaaactcaggctgaaagtgctgcctccagcttctcaatgagttatttgcttttgttgggagccctcacatcctcacaggtagcatacctcagataaccatcgaggaattacagatgaaatcagggctcagggcaaagagtggccctttggggtttaacattacagcacgttcttccccaagtctgattcaatggtgagcttttcagccaaagaaagtgttttcggtaattggccaaatctctataggaagactgctgaacttgctactgtttctatcagagcctttctcatctcttggatttttctcacacttttcaagttctagatataatccattgtgcattaatctttgaaacgtgtcaggtgggtattagaacttccttggaggccagaaaaatggtgagagaagggaaaagggacggaatggagctcaaagggtcactggggcccagagcagagatgaatccattggacacaggaaagcagtgtcagacctggagatggtggataagggaattagagagttaggtgagcaggtgatctgcactagccacctgacccctggctggtggcacagtgtgtgagctgatcagggcaggtgggaggcatggattcaggccagtcatgacaactttggcagaaggaggccaacccaggggctggattccaggcactgagtgagggtctctaggaaaagaggaattggccaagggcaaggcacagccctgtctttaagaaacccctctaagatttcttcctatgtaaattagggataataataggcatgaactctcataataggtttgaactatcataggttattttgagcatgaaataaattaatcaatgtaaaatgtttaaaagagtggtactccataaatattatgatgatgataaagggctttagacatgagggaacaagaaaagacaattcctaaaataggaatttcattctaggaaagaagtttttcaaacaaggttagcacttggcctttgaaatgtatcatttatttattcaaatatttattcaatctttccttctttattcaggaaatctttaggagctcctttgatgtacaaagcattctgatcgggccagggagatgggcaggggatggcaagcagcagccatgggccaaatttggcccactgcctgcttttataaataaagttttattggaactcagccacactcatttattgatgtattgtttatggttgcttttgcactccttcagcagaattgagtaatgttgacagacaccatggagcctacaaagcccagagtaattactgtttggctctttacagaaagggtttcctagccttcattcactctgtgatgaaagaaacaaataaatagaaaattatagtaaaataatgacagaggactctgggagtagacaggaggatcagacagacttcctagaatggatgccctctcagctgagacctagaggctgaactggagttaataaagtagaggagaaggaaaaagtattccagatagaacaacatcagcaaaggcccagaggtgagagagtgcgagttacgttcaagaactaaaggaagttcgtcatggctggggggcagaggacagatgacacaaagctttccaggtaggattaaaacatttcgatgatttcctgagggcaatggggagctactgaaggatttccagcaggaaaacaacataattaagtttgtattatagggagatcattctttctgcaataaaggtggatttaaggcttaagtggaagggtgaggagcgagactggaggcaaggaggtgcccctttcagtaatgcggagggaagatggcagcctggaccaggggaacggccatacagttaggagaaggggattgtttggagacatatttaaagatgcatacctcatggcatacagcgattgattgcacatcatgagtgtcaagtgaaaaggagggaagcatgagcccttgctcagagctattctctgagatggggaccaggttggggatggaaggagatgacagtgtccatggtgaacatgcctttgggatacccacaggagatgtcacgttggattcattgcagagcagcatatccctttcactttactcttgaagacaattagggagtctccgttaaatgttgggtaatacccaggttcagtatactggtgttaaagaactccacccacttccaccaccaccatcccctctacccaccttttcacacacggatttgccgcacctcccctttgggaactttatttgcctctccagagggccctcccagtcaccctggcctcctcccagtttcccagacaagccttggttgttgccacttcctcactgcggttcctgggttttcctctgcctcttttctctttccacatcccaattcccctttaaggcccttgtgggagctgttataattactgcctcacacagtgctttctcctgagccctgacttctgctgcctgctgccttagagcaaactctgcatgggacatcttctttcccccttgatgggctctccatgaagcgggtgttgtcaacttacttggaaccagatattgagcacttattttatatcaggcagaatacagagccacttatatgatttcaattaattcttacaactcccttgggaaggaggtgtttgtcttctttccatttaacagatgagaagactgagacttgatgagtttagtcaattgttctgagtagtaaatgacagactctcccaatgctcatggcttagctctcaccaccaagtggatgatgcctgctgtctctttgaacttgacctattacttgccatcttggtaccttcgtttggccactcttactttattccacacctctttctccttccaagcttctgagtctgtcaaagccatcactattatgcacatttttctagaacagaagcctggctatttctttgattcatttatttaacaaatatttattgtgtcatgtgccaggcactgttcttagttctggggatatagtaggaagagaaaaaagtttttacccacatggaatttatattctagtgggagaccatagacagtaaacaaaacaagtaaaatgtgtaataggtcagatcatcacttggaaaaaattaagcaggggagtgagtcagagagctcaggaatggagttgcagttttaatgggatggtcaaggaagatctcctggaggaagggatatttgaagagagatctgaagaaagtgaagatgtcagctctagtttgaagtcagatagcatgatgcctccagctttgttctttttgcttaggattgtcttggctatgcaggctcttttttggttctatatgaagtttaaagtagttttttccaattctgtgaagaaagccaatggcagcttgatagggatagcattgaatctataaattactttctcctatccatgagcatggatgtttttttcttttatttgtgtcctcttattttcttgagcagtggtttctggttctccttgaagagggccttcacaacccttgtaagttgtattcctaggtattttttttctcttagtagcaattgtgagtgggagttcactcatgatttggctctctctttgtctgttattggtgtataggaatgcttgtgatttttgcacattgattttgtatcctgagactttactgaagttgcttcagcttaaggagatattgggctgagatggtgaagttttctaaatatacaatcatgtcatctgcaaacagaggctacagtaaccaaaacagatatatagaccaatggaacagaacagaggcctcagaaataactccacacatatacaaacatctgagctttgacaaacctaacaaagacaagcaatggggaaatgattccctatttaataaatggtgttaggaaaactggctagccatatgcagaaaactgaaactggacgccttccttataccttagacaaaaattaagatggattaaagacttaagcaaaaattaagatggattaaagacttaaacattagacctaaaaccataaaaaccctgcaagaaaacttaggcaatatgattcaggacataggcatgggcaaagacttcatgtctaaaacaccatgtctaaagcaatggcaacaaaagccaaaattgacaaatgggatctaattaaactaaagagcttctgcacagcaaaagaaactatcagagtgaacaggcaacctacagaatgggagaaaatttttgcaatatatccatctgacaaagggctaatatccagaatctacaaagaacttaaatttacaagaaaaaaaaacatacaaccccaacaaaaagtgggcaaaggatatgaacagacgcttctcaaaagaagacatttatgcagccaacaaacatgaaaaaaagctcatcatcactggtcatttagagaaatgcaaataaaaaccacagtgagataccatctcatgccagttagaatggtgatcattaaaaagtcaggaaacaacaggtgctggagaggatgtggagaaataagaacacttacactgttggggggagtgtaaattagttccaccattgtggaagacagtgtggtgactcctcaaggatctagaactagaaataccatttgacccagcaatcccattactgggtatatacccaaaggattataaatcattctactataaagacacatgcacatgtatgtttattgcagcactattcacaatagcaaagacttggccccaacccaaatatccatcaatgatacactggataaagaaaatacaccatggaatactatgcagccataaaaaaggatgagttgatgtcttttgcaggaatatggatgaagctggaaaccatctcagcaaactaacataagaacagaaaaccaaacaccacatgttctcactcataaatgggagttgaacaatgagaacacatggacacagggaggggaacatcacacacgggccgtctggggacggggggctaggggagggatagcattaggagaagtacctagtgtaggtgacagttcaatgggtgcgggaaccccccaaggcacgtgtatacctatgtaacaaaactgcacattctgcacatgtaccccagaatgtaaagtataataataaaaatatgccagctacttagacatgttttctaggaataaaaaaggaagaggcccaaaggaaggtgcaccctaatgtgttccaggagtagcaggtaaagccacatggctggagtagagtgagagagtaggagagtggtaggaggtgaattttgaggggtaacgggatagggagatggacagatcatgtagggatatatggcccattgtaagcacttagacttttactctgagtgatgtgggagcaactgaggggcttttgagcaaaggaattacctgattaacatgggttttaaaacgttcactctagctgctcatggaaaataggatgtaggagcaaaagcagaaacaggggaaccagtcatgagaccccaatccctcctcctctgcattactcagttttcctttctagccagacaacctcagaatctcagcggcttacaaaaataagcatttattttctttgtatatgggtcatgggttggctgggtttggctgtttcagatggtcttagctgggctcagttgggtttggattcaggctgtgatttgggttcaggaatatccttgtgacttctccttctatttgggttcttggctatcaaaggcatattttttgatggcaaatgaaataagagatgagatcaagccaagtcactcaagcacatttaaaatctctgctcacatcacactcacaccaaccttctgttaaccaaatcaagttacatggccacacccaacatcaatggaacatggaaatatatacttcccactttaatggaagatactgcaaaatcacacggccaaacccttgggtgtataattctactagtgtgcggaagaattggaaacaatgaaccagtttccacgccctgtctctattctaactgtcttcatcccatttgccactaagttttgccttgtctcctgtttctcctcttactttgattcattcattcctacctctggtcccctttgactcacacaacggtctttgtcatgttcaactccagtttcacccccaccacccaacacattctgcataccactgcccaagttctcttcctactaactgactttcttcatgccagtccttcccaggaaacttcagtgaccagctgctgagcaacacatcattttccaagtgccagtacattctataccttcttcatggtttttgtcaattcatgcaacacctttactcaaattattttctttaatttgactttaagtcaacttcctttctttttccttggcctctctttaataatgaccatgagagagttacgcatttttgtaaaaacataaaaaatataatgcaagtaaatttttttgtgcatttatttgccctctgaaatcttgagagattggacaactgcattttggaacccgctggcttcccacaaggccccataccttcatcctacctgtctggccttacctctcatttctctctatgtccgttgcctgggtcatgatgcacccctcactgtggactgccctgggtagctatctgccatagcgatttctcccacagcttctgtgttttgtggcacacatcacatgttcacacggggcttatcttgcttatcttattctgctgctagattgcaagttccttaaggaggaggtcttactgaattttgtatctcagagtatgatgcagaataggcacttagtagacattgaattttataatttttttttattatactttaagttctggtatacatgtgcagaacgtgcaggtttgttacataggtatacgtgtgccatagtggtttgctgcaccccgtcaaaccatcttctacattgggtatttctcttaatgctatccctccccttgccccctacccccgacagatcctggtgtgtgaggttccccttgctatgtccatgtgttctcgttgttcaactcccaattatgagtgagaacatgtggtgtttggttttctgttcctgggttagcttgctgagaatgatggtttccagcttcatccatgtccctgcaaaggatgtgaactaatccttttctatggctgcatagtattccacatgtggcatatatgccaccttttctttatccagtgtaccattgatgggcatttgggttggttccaagtctttgctattgtgaatagtgctgcaataaacatacatgtgcatgtgtctttatagttgaatgatttataattctttgggtgtatactcagtaatgggattgctaagtgaaatctggttctagatccttgaggaatcgccacattgtcttccacaatggtggaactaatttacactcccaccaacgtgtaaaagtgttcctatttctccatatcctttttagcatctatggtttcctgactttttagtgatcgccattctaagtgatgtgagatggtatctcattgtggttttgatttgcatttctctaatgaccagtgatgatgagctttttttcatatgtttgttggctgcataaatgtcttcttttgagaagtatctgtccatatccttcgcctactttttgatggggttgtatgttttcttcttgtaaatttaagttctttgtagattctgaatattagccctttgtcagatggatagattgtaaacattttctcccattctgtaagttgcctgttcactctgatgatagtttcttttgctcttcagaagcactttagtttaattagatcccatttgtcaattttggcttttattgccattgcttttggtgttttagacattaactctttgcccatgcctatctcctgaattgtattgcctaggttttcttgtagggtttttatggttttagggctaacacttaagtctttaatccatcttaatttttaagtctttaatccatcttaatttttgtctaaggtataaggaaggggtccagtttcagttttctgcatatgactagccagttttcccaataccacttattaaatagggaatcatttccccattgcttgtttttgttaggtttgtcaacgttcagatggttgtagatgtgtggagttatttctgaggcctctgttctgttccattggtctatatatctgttttggtaccagtaccatgctgttttggttactgtagcctattagtgtagtttgaagtcaggtagcatgatgcctccagctttgttctctttgcttgggattttcttggctatacaggctcttttttgcgttccatatgaaatttaaagtagtgaactcccattcacaattgcaaccaagtgaataaaatatctaggaataccactaacaaggaatgtgaaggacctctgcaaggagaactacaaaccactgctcaaggaaataagaaaggatacaaataggaaaacattccatgctcatggataggaagaatcagtattgtgaaaatggccctactgccaaagtaataatatgtagattcaatgctattcccatcaagctacccaatgactttcttcacagaatatgaatttcttaatttataagtaagcaactggaattttgatgtttcaaaacactactatgaattctttgaggcagatctttccttttcttttttttcttccctgtttgcccccaggtaagcaaacagtaggtgcttgttaaatttgacataagaattgtgtagtcttagtccattccagctgctataacaaaatagcatactctgggtggcttataaataaataaggggaagtccaagatcaaggaaggtgccagtatacttggtgtctggtgaggacccactttctggtcatagatggcgccttctagcttatgtgctcacattgtggaagatgcaaggaagcactaatcccattcatgagggctccaccctcatggcccagtcaccgcccaaaggtcccacctccaaatgccatcatctcagtggttgaattttgaatgtgaattttagtgggggaaggacagaaacatttggaccatagcacaggggaacacaagaaggcagctaagatggataatgaacagtgatgataattcaggtcatttagccgttcttagttcttttaagcctaagctgagtttgaacatcaaacacatcatgattttggttattgaaggcacaagagtgtgaatgtggagccctttgccttcatccacaattgaaaatatgttatttgtgttaggtaactacctctgttcatcctatactggctctaacttggagatgacgttgaattcttttcaggatggacttggtgccgtgtgtgtgtgtgtgtgtgtgtgtgtgtgtgtgtgtgtgtgtgtgtatgtatgtgtatgtaaaacagagaaagatagtggtccagaggccaacacacctggaatctatttgtgagggtccctgcttcagtccacgaattgggccattcatttatttctcagtaagtgaacatctgggattcagtttgaaacgccaataagtttggatgggatcgcaaagctgtggttgggatgtggaactgctcgcctgaggtgggagtgagcgaggtgagcgggggctcttaaactatttctgcagacttcagttcaaatgcaatagccagagggttgagaaatccttcccgtgctggaaaagcattaaaaaaaaaaaaagaataaggaaaagattcaatcagatcgaagtgacaatgcaatctgaaaagtgcccctttcccccttttacccagctccctttccatcctacagttctcatattatccaggtatcttccttttctagcaaaagaaaaaaaataacaaaaaaaccttggacctgaatcgggaagaaatgctatgagaaaataaaaattctaattagttatagatgagaattggtcacagataattattctacgttctttggcttatgccagaaaaggcttaaaagaactttttttgttgttgctgtatatgtaaatgtagatgtaaatgcctagataaacacacagagaggcacaccatcattaagagatcttgcagattttgagtgtttagaacaaaaatgaaagagaaatttgtcattcacaaactaggaatgtttgaatcgtttactgtcaggactttgtcactttgaactaactcaaaacaaaagaaaaggccaatgggttcaaacaggatcattttaaacagtacacttccagaaaatttgtgctgagttgtacctgccctccctgatatctactagctagagtatttctatttcaatttgcatctggcagtttcctacctgtgagtcgaaggggttggagacctagatgaaaggcctagaataacccagagagaacatggagaatctgtggtgggctgtgctcatgccatctgatttagaaccagctttgctgcattgttttgggggtcttaaaaggggaaaaaatcctaatagctgcctgaagtatttttctcttaattcctcatagaaatgagtagatattaaccacaggctgcccaaggcatgcttaatgtcttgatggagcgtgcttttgcagagtgttgctaacgcattctcagtccctcttccctgcccccaacatagccctgccatatttattcccaggcagcatggaaaaagagaaagttagcttttgggggcaatctgctttttccttttattaattgcacccctcactcttctcatatagaaaccttatgtggatgtcccacctggtgtaagaatgcttgccctgactctggcttcactctgttctgaagctgcctctgcttctctcaccctactgcacagaactgctggcatgagcctcttgctccaagctctcaggaccctctttcaagcagtatgggtcaaagtgtttgatttgtgctactgtgattgtgactgttcagtaacctggttgcgatactctggaaggtgcctaatgaaatactctagttttaacagctgaagtgaaatagccagcacagggggcttgggcagcagcacgcaacttatagcactttcagttcttcacaaagtttgccccctttggctcatctgttcctcagtaattctgttagataagtggagtagatattcactcatttagtcattcaaccaaccaatgaaccaaccaaccgatgaaccaaccaactaaccaacaagtatttattgagcacctactagttgccaggctcaagtggcagtgaacaaaacagacaaaaatcttctcatggcactacacatttgaatggatatcctagtaggtatcattatgcccattttcacatgaagaaaccaaggcatagggagattaaatcctaaggccatgcagtacattaaaattcaaatattctctccagctctcagaataaggagaatagaataggtcatcttaggactcatctcatccaacccactgattctgttgatggaggaaaccagggctgtggtttacatggagttgcatagctctagggcagagctagaattatatagcacagccttcctaagccccagcgccatgccctgtccaagagttcttagaccctgcagaggcatataattcatagactttgtcgtttgtcaccattcctcacccgcttaatgaggccccctccctcattactcagcatagatttcatggctcattttcataattgctctcagcacattccctcaattcctgggcccctctcttcctccatcatagttgcctggaaacgccctaaccttggctgaattcagccttctattgtttgcaccctctcacccaggggacttgaatgttgctgaagaaacacacacacttctgtggacgaatctcacttacagctcatgaccactaacctcaaatgggcattggctgccgcccggcaaccctccagcctttcctaagcagcgatgtctcacctttccttctcagtcatcatacctcctcatctctccctggcctctgctgagaatctggctttgtttttcactgaggaaacagaagtggtcagaagagaccctccacagacacccaccaccacatctgccaccccccgtcccctgacttctgccttcccgctgttgccacaggtgacccgtctctggccctgccaaaggccactgccatccctttgcactgggattacctctgttgcctgttcaggagcttcactctaaaatttttctcctctctcccctgaatcatcaatgtgcctcgctcctatgtcattcttatcagcactgaagcatgtcacgatttcctccatcttaaacaataaaacccgacttgaccacattctctcctagctatcaacccgttttctctcctcctttattttggacgtctcaacatcattgttcctttttattttcccccactcttttttgaaccactcctgctaataggtcatgcccatctttggaccaagcaactctttgcagggtcaccagtgggctcttcattgcccaacccaatgttatcctcatctttctctgtgtctcagcagaagttggctaaccagttcctccctccctccctatctccctcctttcttgaaactctcccttcacttggccttcacaactatgctctctcttgcttctcccccaccacactgggggctgtttcctcctctctctggctcgtgtagcccagaactcagtccacactcctcttgccttgtcttcatctcccacggtaaccacatccaagttcatggctttaaattaccacctacatctctctatcttggtcttatccctgagtgccccatatgtgtatatccaatcatctgttgggcatctataattgggaatatttgtaggcatatcaaatttaacatatccaaatctgcccccaaccccctgctctacccacagtcttcccccatcttggctaacagtagttccaaagttttagatgcacaggccaaaatatcagcctcatccttgactccccttttctctcttgccttgcctccaatccatcagcaaatcctgtctgctctaccctcaaattatttatagaatttgactacttcttaacacctctgcggctgttatcctggtagcagggtaaagagcattcccagagaagggaagagcatgtgcaaaaactctgatccggggaaagctgcaagagtagaaaatctcaaaagagatccaggagtgattcttgaatctggggagttgtctgctttcttggccgcattgtgagatgtcatggggaagaggtcactatagggatgcagctttggtgattgccaagtggtctgactgcctgaaatggatctggccagctctgaagttataaatgactattaacttgcatgtacattattatctgctgtgtgtgtgtgtgtgtgtgtgtgtgtgtgtgtgtgtgcacattcacatgcacgcataaatatgtgctttcttccaccctagatatgttttcttggagtctgagccctagtgtactaatatatacccttgtacaatcttctggggctccccagagacccatgcccttgactttagtcctagataaagcaacctattggctacggcctctggggttcccctgcattgttctgggcaaaatttacttaggcctgtgagtcagccatcctggaactagaggactcacagtgccttttggcccattctctgcagaaccagtgattttccacctctgtgtagacaggactcttgtccatcttctccctcacccccttcgtttctcctgaaatcaagatcttctggatgcaggggcatttgtgggcatcaggggcatatgggagtagccagggcaggggtcagaggcaaggcaggctcaggccattatgtactctacatttccctaacagccatgtcattggagaaaaagtaatccaatgtgaggtacaggaaaggtcaaaagagattgtttggtatgtgtgtgttgcgggcaggggtggggtgggggggctttgtgcttgttttcttttcatacttgagtcctgagctggatctcagtaggatgtgatcctgaccaagctcccagagttctctataaccacataaatagggcaaggatttcctgagactctcatagccttcttctgaaaccagagaggcatggccggcaaatattccttgtttctatcctccctgctgggattattgggcatccttctgtcaaccaaggctccaaaaagttagagaagcagaatggcaagggggttaaaatcacaggttttagtgtccaagagacctctgttcaagccttaagtttgggctgtgtggttttggaaaagctacataaccttgctgtgcctcagtttccttatcttaatgactgtaacagtgtctgcttcaagagtttctttaaggacgaagtgagataatacagataaaacacctaacacaacacttagctcatagtagtaagtgccctatgtgaacataaaaaaggaaggaaggatggatagatggacaaggacagagatttttattttattttattttatttatttatttttgaaataggctcttgttctgttgcataggctggagtgcagtgggatgatcttggctcactgcaacctccacctcccaagcttaagcaatcctcccacccagcctcctgagtagctgtgactataggtgtgtggcaccatgctcagctaattctttggattttttgtagagatgaggtttcactatatttcccaggctgctctcaaacttctggactcaagcaatcctcctgctttggcctcccaaagtgccaggactgtaggcatgagacactgcacctggctgacaaagagatctgtgctgttttgatgcttaaggcatactggtggttaagatagtcctcaacaaaatatccaagtgttcctgtagatttcccagcttcctttgcagctaggtttgtgccatgtgactagttctggccaatcatgtgagaagtggtatgagtcactgctgggtcaagggagttaagagctgatgtacttcctccttccttctcttcccctggcacagcagccttggaggccacatgttctctaaggtatcataccatatggaacaaaccctttatgtgagtgtggaataagtgtttattgtgttaacccactgagattttggagttcatttgttattgccttgctgactgatatagtcatctatgaaggagaaataaatctcctgaatttccaacctcttgggacatctagggacaattatactgataataacagtagctgtaacagctaccacttattgagcccttgagaaacattgcaaagccctttacagatgttaaaccattcagccctctcagatatcccatgaggtacatgttttgctattacataataattgtgttcctaaaataatctttaggttattttttaaaagggttcttgcaaacatcttcagtgagggtaaaaaaaactgcttagggatcagaattttaaagtatgaccacaaacttctttctcctatagaaatgtcaaaaataaaggggtttttaattgctattaggactttcagaacttacaaactaaaaaataactgatttcaaaactgatgtaagccagcctaaatgtcattgatcaaatactgaataccatggaagacaaatctcaggtcaacttgcagctaagccatcaaaataaattgtgggttggtccacacttactataaggaagctccattatatctcaatgaagctgcttgtccctccaaaaaagggaagcctcaaaggcaaagaatagcatcattcaactaaaatggccctgggtattgagtctgtaagccattagactttcctgccccacatatggggaccattcctgatcatgacactggtataaaccaacaaccatcacaaattagcttccttgctgaattgctcagattacatccagtttgcattatgaaaatttgcatagcaggaaaaaaaaagcctgaattggctgttagacaggtgaggaaaccaaggaagtaagaggccttcagtgactacagtaaacaactagtgggaacagccccagatcaaggatctctactcttttgactctccagagttcaagttttttgcccccgatttatagtgacatctgtacatcttcatagttgatgatgtcatctctgaactgatgtttgaggcctgtgaagtttggttctgcccttgcccggagtctgtagtcatcatccctggcgcttgctggcctggagcagcagctggcaggaagcattgtccctctccctctctccattgggggtgacttggagcttttgcactagataacaaagctgcttgggttcttgttgttgagacatgtgagtgtttctgaaagtaccagtagacggagaaagaattcaggctgcctaagaagctgcctggggaaggggaaacaattgagttcattactaaagcaagcagtcctggtgacctgtaggggttagcacactttgactttcttcctccctcgggcctgattgggcagctgacagcccacagctccctgaggaaaggaggggatttgatgtgcagtgggccatgcccaggccctagtggcccctcaccccttccctttcctgagggaggggaagtagtgaccccttcgccctgctcaccttgcttgtcagtgaggttgatacctctgaaagctgagtctctaagaagtttctgaatgatgaagacagactcaggtaggcaggccctctgggagccctgtttaccctcacacagtgtgacttcccggatcagcagggctattgattcatcaggctcccctagctggcctttcctaccttttgatttattcatgaaattcagcaggcccttctggaaggttctttgtgtgcctgatgctgtgttggctactgttgggacgcaaaggactttttagttgtatttcccacccttagtccttgaaacttagatgataagacagtttataatgaagggctaaattaagaattctcactacacatagtaggtaagagcacaggcttagcagcaggcacctgggttcaagtcccaccaactatcacgttggtcaagcttgactttgggcaagttcttaaccttcttaggccagtatttcctaaatatagggatgctaagagcactggcctccaaacgtttccatggagattaaatgaggtagtgcatgtaaagtgctcagtacaatgcctggctcatggttttagtattattactaactactgctattagctgtcaaaacatatttgagagatttcagcattgcagaaatcctgaatctaaacacaccaccttccgcacagtgttcctcccttctctattcctctcattagggattggtaatttgactgatcagttaccccacctggagcgacttttcatacccgcactcctgtaactccctgaatcctcacgtacatcctgtcacaaaacccagccgattatacctcacttctctctcctacacttcagccacactgttatccttaaccaggtcttcacgcagagaccaatcctcacgtacatcctgtcacaaaacccagccgattatacctcacctctctctcctacacttcagctgcactgttatccttaattaggtcttcatgcagagacactagttacccaagaacacttttaactggttttcctgcttccgatttcaacctcctccaaactgggcttactgctactcaggagacatgtgtatatgtatgtatgtgtgtgtgtgtgtgtgtgtatttatatatatatatataaatatacacacatatgtgtgtgtgtgtgtgtgtgtgtatagtttgtttgtttgttttttgagttggagtcttgctctgttgcccaggctggcttgcagtggtgtgatctcagctcaccacaacctctgcctcctgggttcaagtgattctcctgcctaagcctcccgagtagcggggattacagatgtgcatccccatgccaagctaatttttatatttttagtagagacggggtttcaccatgttggccaggctggtctcgagctcctgacctcgtgatctgcccaccttggcctcccaaagtgctgggattacaggcatgagccaccacgcccggccaggagaactttttaaaattcaaaccagattatcactcccttgctcaaaccctttctctggctccctcttactatctgtaaaaagccaaacccaaattctttattatggataaaaaggccctttgtggtatgactgctgcctagttgtacaccttcatcacttgtgttcgcaggtcacctctgtgttctagcagtgcaagcctgcttcccaaatgctcctgtctcctggccctccatggagtacagagcacatactgctctctcagtctagaagtctccacctctgtctcctaaagagttctagtcatcctttaaaactaaactcaaaaccatcttccttgggaagccttcttttaacaaggactgggttagctgctgctccattgtgttcccacgacaccttcgctttcaagaacatggcaattttttgttttcaggtctgtcttcttcactagcatatgacatttttaaaagaaggggctgtatcttattcatttttgtatgttcatattgaaaaactggagaaatgaaagaatggatggatgggtaaatggtggttggacggatgagtgaatgcttgggtagatgggttggttgatgcatagatggatggtggttggatgtacagataaatgaacagttggatggatgaatggttgaatggatacatggatgggttcgatgaagtggcaaaaacttctatttatatcttacacccaggtacatctagaaaggcctttagtggttccacaaagacaagggcctatttcttagtgcttctcaattcaggctgaaaagcagtatggctttgcaactcagcagccagttggttttttttttacctttatgctccccattgttgcatcaggaaagctgaggagttttgatcttagtgggagagggaatacctaggaaggccttatcctgtcattgccctggcccacatctcatttgctgacttcctcagttctgtcctcatatgagttccattcagtcctgttctccattcagtaatcatggatttacttccagcttgaactatggcaggagatctccacctctggacccagagtaacagaacagcagatggcatgagtgtaccatggccaatagccactgtctgcacccggcacttacctgtttatcaggagaacagcatgtctcattctgttcattttcctgttgaggggctgctttcacagaagccacatgggaagtgtaccttatgcagcttggagccttcatcatcttttcaaggaagactttccaggcccatatttactcagtaaatatgagtaaatcctggagttacctggaaatacagtatctagctccttctgatattgagaaccagcaggcgacctgctcgagcttaagtggaaaggtcccaaggcttttgggagcagagccccacccatctgtcccagaatcctcattcagggtttatgaagcagtgggcagcacacaattggctaaatttagttatatttttatttttgtccagccacaaataccggcaaaaaactgaaaatgattccttcccttccaggagccttggagccaagctggttttatttttagcttcaactctggtttagggttttcagcaaaccgaacaccctactcactgaagacagcagcaagctgggttttaggatttttgcctggaatggagtgttggttctctgaatataactcttaaaagactttgtacagttgtgacaatagagggtggttccagacagacccacatagagactcagttcttgccttagggacctccaagagagttcctttccagggaaggcaatgtacacagggtggttcattgccttggatgggttggaggaagtggcaactctggatgaaaagaaacagaaaaattaagaaagggaaagggagagggagctgttgtttattgaaaggctttgagtagcatggtggttcagaactagagctctggagtctgaccgactgggtgcaaatcctgccactaccacttcctgacattgtggccttggggatggcttgacctccccaggcttcaggttcattctgtatgagacaggattaataatgacacctaccatgagcactgctgcagttatgatcctgcctgtgtagcacgtggcatggcgtttgacatgcatgtagaactcaatccataccattatcatcactgttgtcatgctcttattgcagtgctgaacgcttgcgtagacactgtgtcatttaagactcactgtaacccattttgcagatctgaaactgaggtccaaagggctagatagcttgcttcagatcccacagcaagagcacaatatagccagacctgtgcccagccccggtgaatcccacatacatcacatcaagccttctccagttccaacggcttccacctgttatcgctgagtacatgggaactactcaaaacataaaaatagatgttgcctcatcctcctcttcctggagtccccctctttttttttttctactttagtgatgggaacacacaaaaagcagatactggcagtggtcaaagagcaccaggcaaaatcagagacagacagtggaacggtgattgccaggggctgggagaaggagggatggggagttgttgttcaacagggacagaatttcggttttgcaagatgaaaaagttctggagattagttgttcaatgatgtgaatatactcaacgctactgaactaactacacttttagtgtacagtttttttattgctaagaagataaatctcatgatatgtgattttactgcaattttttaaaaataaaaagcactggggtaagagtcaggcttccctcagccgggcacggtgactcactcctgtaattccagcactttgggaggctgaggtgggcggatcacttgaggtcagaagtttgagaacagtcgggccaacatggtgaaaaccgtctctactaaaaatacaaaaattagccaggcatggtggtgtgtacctgtaatctcagctactcggtaggcggaggtgggggaatcacttgaacctgggacatggaggttgcagcgagccgagattgcaccattgcactccagcctgggcaacatagcgagactccgtctcaaacaaaacaaaacaagagtcagccccagtggtggccagggaattagagcttatcttatccaactttccagcctttcctccttgcctcctcctcatcaggagtctcgtggatggcttccctgcccagtgcttacccactcgctgcatggctgtcaggctgagtagcaccctcttgacagtgggcttattatatgtgaagtcttcaatgcttctctatcacatgctttgtcctgcttgacctccttctagtcgctcatccctctaaagttgttgtccatagacctaggaagaaaggggggaaatgggagcaaaatcccaaataggaaatcatgtctgcttggtggcaggggaagggggccagggctttggggccaggagctagggagaagctcaccttttctattccttagttagctttagctctcagatggggatcatatagttacatcatgtaataggccatactcaattcactctaagtagaaaaattcatccaggctatgaactgctctttggctctgaaagattctgggggactgtggggtgtatgctttaatcatggtttgggtggcttcctgtttcccttgctaggctgtgtcaactcactagggcagaggggcatggggctagcatgcagcagggcgtctctcttggcccagtgctccgaagaaagcagccttcatggagatcataatgatggctctgtgtcacttaaaaactcaggtagcctttctgtgggtgtttagcattgaccatgcttaagagaaactggctccgttggccaacatccaatgtgagccatccctactgggcagattttgccacaagccatacctcatgcccagaccttggtccctgacccagggcctacttctccacctccagggatggtgataagggtctacaatactgttaggggcccatgaaaatgttttaatttcttctaatattggaagacaaaaatgaacttttgggtagaaatgttatgtaataatatatttgcatttataccgacatagttataaaatgtaatattaaaaaaaaatttgatgtagaaagcagcccacaaaggcaaaattgccaaggacccacaaaactcacaatggaatcctactctggtccacagagccaagatggccagaattccattttgttcctcagtccaaggtgatctgccatgccctcttctttgttcctgaagcaactactatctgctcccacaatcactgtttaggatcctgaatatttcctctgatatttcatttaaggtttctttttcttctttttttttttttttttttttttttttttgagacagagtcttgctctgtcgccaggctggagtgcagtggcacgatctcagctcactgcaacctctgcctcctgggttcaagcgattctcctgcctcagcctcccaagtagctgggactacaggcatgcagcacgatgcccagctaatttttttgtatttttattagaaacggggtttcaccatgttgcccaatgatggtctcgatctcttgacctcatgatctgcctgcctcagcctctcaaagtactgggattacaggcgtaagccaccgtgcctggcccatttatgtttttaggtgtgtatttcacatgccagtttcatcactcagtaatagctacacgaagctcatggtgagaaaagttcaaaagtcttgtctggagtccatgggaaggaatattgtgatccattagtgatgtctctccaagactgatggaggtgtggcagcacagcgcatgtgctgtatttttacttttgactgacctttgctttgcattcccaacctgactctaagccccgccaacagggaatataccttacatgtgttgagcagcccatactgaaagacgtagagagtctcttaatgcctattgattgattgactgattgattaaagtggtatctgaatacgtttgatctggtttaatgtccccttgacatccttccattctctttcctctttaggcgcctgaacaagaataagctgcaagtccttccagaattgcttttccagagcacgccgaagctcaccagactgtgagtagagttgccttgtgttctctaccttgtgccttgcctggcttgggtgatgtggaggatgtggtttgtggagcgccgtgccgtgtggagcttggcagttaggccctgacatagagacttggagcagggctttgacatgacgtctacccccaacaaacacttccaggcctgacttcttgctccttctctcagacatcagcggcttgcatgaccagtgaggactagtgatgtgtggtagtccatcgttgccttgcaaggagggaggcgatgcttccatggattgtgggtctgaacttacttcaggtaaattccctgaggtggggtttgagataggtttattcacacgagactgtcagtggtctcagaaggcaacggtttggaccgaacatggcaacctcatcaccttgctggttgaagcagctcctgcctttttcccacttcctagcgctgccagtctaggaaccctgggtctgggggtttatgattttgtgggaaaaggaagaaatgtgttgaattttgctttattctcttcagagatccagggtaaaatgaggagaggggagagttggagatacttctatttattcagtgggagaatttggaagcccaggagctggagttgcaggtgagggtggagactgtgattcatgtattgtagatgtcaggcaagtgctaattaaattatcgacagtgaacctgaaatcatgctggcagtgactcagttcatggggtgtactgaattgcctaaggtacacctttctgaatgaagcgacacagtcctggatggctttgcagtcaggtagcaagatttacagcctggctgggaaggctttaacattgcagggaggctccaacgttgtggccaccattctcattcccagtggttgcatttaatgcctacttgtgcagccaaacactgcatataggctctgggataaattgggaaacatgaaacacatgtcagtgtgtgcacttacgaatgagttctgaattaggaatatatatttctatatgtctatacacacacacacacacacacacacacacacacagagactatatacataaatttattttaaaagggcactttgctggaacaagaacaggcaagggttggctggtattccaatcatgcagtggtctcgcttgccttctctaggacacacctgcactttgtcaggtctcctcttgctgtgtgccccatctctctggctcagtcgccctagctgactttgctaaatgtaggaaaggctataccctcctttttactcttccagtctgggtctgcctggatgggcatgggggcggaggaaatgctgttcagcagcccgggggtccagaagagctggataaactatgccaaatgggcataccagaaacaccctggtttgtaacatcccctgcctttcatagccctgcccttagatgctcacgtaatcactatctctccacccagtactgcattgcacctttcaacctgctgttaactaagtactacagcagagtatatactattcatctgagacataagcatcaatttaaaggcaaagggaaggtacctgggaggctggaatgctggacgactttatgtgggtggggtctgagcatcccagctgctgcagcatgtcaggtgggctggttcttgctcacagaaaccttcccatggctatcaggtgatggccattttttgcagagttggtcttgatccaggcaaagtaggaatttcaagtggtgataacaggtctctgagattctgggagccaggcacgtgggcatggggaacctatgagttatgtcctctgccacgtcctgagagcttgagagagtcacttttccttcggtatctaaatatcatcagtaaagggagataccctctcctcccttttacctaccttgtagaggaactgtaagtatccaatgagatcatggtgtacttgtgttttgtaaagtgctgtataagtgtaagcaccaagacaactattattactcctacaattcctgtctttataacctcagtttctgatctcctttctctgggaggcatgaagagactaggagttgcaacaagcactgaggtaaattaccctgagcttttgcttcaagtcagagagctgcagctgggaaggcaggaatggtatttgactcattttggtatccatctcttgctgggtccgtgtccgggcatagctcggcacacataggcactccatcagtgatggttgaatggttagatgaataaatgaatgatataggcctaaagatataaacagtgcccttggtgagctttgattcttttatccactattcattcatttattcattcactcacgcattcagtaaggttttccctgggtgtctgttccagcatggcctctgttctgggtgttgagctgtagacatgaaggatgcccagttctctatgtgccctattatgacacactttgaatggctgccaaaaagctgagagctaaatataattttttttactgaagcagctatattaacccaagtttgggctataatcagcaatccctttttctctctgggcttgatctttgatttttcttaatggccctcttgtgtcattgtcttattttgtcagccactccagagcctttttggaagtaagcagggtacaaattagaaatcaatagctgtgcaatcatgagtgtgtatacatatgccactggctctgttttgaaagagcactgcatctcaatagacacagtgaggcatttttcatgctaaatgtggattctatgtgggtggctacaccagagtatgccatgtgggataaacaattcttgatactactttttttattagtcttataggcaaaactacttaatatttcgtgtttatctgaagactatctcttggaaagtctatagtcatgtaataaaaacaggctttgaatagtaatgaaaagggaaataatatttattagaacctatgctgtgactataacaccactcactagcaagtgacagaagttagtttagtgactaaagttagtttagcccaaagaggcaatatattgattcacataactgagaagagcagtggtagttatgaatggcttcaggaacagctggatccaggggcttggtgatgtcattaagtcttcatcttgctccttcactcccttggaaccgtggacttgtttgtgagctaatgcaaaagactcaaaatgcactaattcagagatcctggtgaagagggccttggtcaatgttcctgtcagaaagaactgagggtagacactgattacttagcttggtcatatatgcccatgtcccagccaaccaatgcttggtcatatatgcccatgtcccagccaatcaatgttgctaatgagatggtgtcctctgattatcaagctgtgttcatcccacttgcttagagaatgggttccccatagtagagagtaattttgttatcagaagacagaagaggggatgtgaaatgtaaaaacaacagatgtctgctagtgtattgagcatccactgtatgcagttccctgcgctttgagtactttggatccttacaatagcacttttagatagataatagcgctagtaaacacgttgagtgccaggtgctgttctgagcacttcatgtctattaactcatttaattctcctaacaactctgtgggataggtactatggttagtactgttctatagatgtgaaacaagtgcagaaaggttaaagaatttgaacaatatcatacaactacttagcggcagaaccaggattcacatttggttcacattttggtaaacctgactccagagtctgcatttgtctctactgggagttccctgcctaagcctcaatcaatgctcttattttatagaggaggaaattaaagctcaaagtttagattactgcatatatatatatatatatatatatatatatatatatatatatatatatatatcccatctatctaagaagcagtactgtactgggcactttgcctcaatgcttagacttaaccatcacaacaatcatgcgaagagaatcattaaatctatttctaaagcttaggggtatctaacttacccatagttgtataactaggatgcaatggaactgggactcagtacacatctgtgtctctgccaagtccttatgttttctaccataccacactgccatgctaattaccgtgggcagctgaagttatgctcaaaaggattggtgatggacctgtcatatatccaagggattcccttaggattttgctggctaccctccgtgcacccatcctcagagccagtgccatccgactcatgtgtgtattagtggggtgtctgtcctcttattctgtgttcaaacacacagaacatgagctatagaatcccagatcttggaagttccctgaacttatatcgctgtggtctgcaaaatgcccagtgaggtctctacgatgcttgggtcactcaataaatatttgtcccctgccatcctgacgtagatcatggtcaagtgtggagactgggcttctgttctttctaggctcttgcagcacctgacccagagcagaggacaggaggaggtagtcaagtgaaagggttaaggggctgcccactgtgtatcctgaaacctttggcaagttacttaacctctcttgtctcaggttcttatcagtaacatagacaatggtagaactgacctctccatgttgttgtgaggataaatgggaattatctgggggaaaataattggcattgaacaaagcacgtagtaaatgctccatggaagatggccacggctgaccttggctggtcagctgatgagagtagtgcgtatgctggggctttgggctctgtggtataaactttgtagcacctagggaaggagtccagtctccaaattagaggagggttggatgaacactgcacttggagtgggaagacctgagtcgtcatgctggctcttctacctgtaagctgtgtggccctgggcatgttacttggcctctctgggcttcatctagagaggacaggatggagcatgatcttgcatggcctatgggctattaatttctccctttgccatcctcttccaggtttttctttaacctactcatgggagagacaatgaaagatttctggttatttaaaggctgactggttaatattgccggaaattctttagaaggagcagaaggcaagatgcagacagtgattaaaatcctctgcgtggctggaaacagtggctcatgcctgttatctaagcagtttgggaggccaaggcagtcggattgcctgagctcaggagttcgagaccagcctgggcaacatggtgaaaccccacctctaccaaaaatacaaaaatatagctaggcatgatggcctgcacctgtggtcccagctacttgggaggctgaggtgcggggatcgcttgagccctggagacggaggttgcagtgagctgagatcacaccactgcactccagcttgggcgacagagtgagaccccatctcaaacaaacaaaatacaccttctgtcttttaccagatgtgagagcttgcggcagggcggagggtgagtggtgagggacacatgggttcacaacttttttttttttttaagaatttatcgttgcagctgggagcggtagctgacgcctgtaatcccaacactttgggaagccgaggcgggctgatcacttgaagccaggagtttgagacaagcctggccaatgtggtgaaaccccgtctctactaaaaatacaaaaattagctgggcgtggtggtgcatgcctgtcatcccagctattccggagactgaggcacaaaaatcactgatcccaggaggtggaggtggcagttagccgagattgtgccacggcactctagcttggatggcagagcgagactgtctcaaaaaaaaaaaaaaagaaagaaagaaagaaaaagaaaagaaaaaaagtttatccttgccctataaggatgagcagaccaaggggctccttttggcccacctatcccagattcaggttcaaatagtgtgttccatatttggtaatggtttaaaacttatagctgctgccggccgcggtggctcacacctgtaatcccagcactttggaaggccaaggtgggcggatgacgaggtcaagagatagagaccatcctggccaacatggtgaaaccctgtctctactaaaaacacaaaaattagcagggtgtggtggtgcgtgcatgtagtcccagctactcagaggctgaggcaggagaatcgcttgaacccaggaggcagaggttgaagtaagctgagatcatgccactgcactccagcctgctgacaaagtgagactccgtctcaaaaaaaaaaaaaaaaaaaaacctatagctgcataagcagttgtactcacagccagatggaggacttatttattctccattcagttatacgaggtatttgacagctttaaaaaaaaaaaatgccactgaggctaaacctgctgtcattcacttgggcagtggagttgcaagtgacttggaaagttaatccccaggcacccgacaactatatgcaatgtggccaaccaacttagccccaagtcactggcgctgttatcatggtatcatggtggagcagattccccaccaaaaagttcaaggctgctagactccagcttccagggaacttgcttcccagggctgagtcctcctctgaactctcatcttggctagtctgcgccgcctcttcatattcaccattttctgcttttatcacaggtgtcgcgtatacatgctccaagcccacacaaattgggagctgcattcagaaccattatctcatgtttctttgaggcagtccaatattagagcaaggatcagaaacttgggaaccagacagacctgggttggaattccaccttctggtgaccctgggcaagtgacctcacctttttcagtcttgtgttggttagctacacaataggaatgctaatcatagctcctataatagcttgctcagctaccatcacaaaataccacacaccgagtggcttaaactacagaaatatattttctcacagttctggaggatagaagtccaagatcaagatgctggctggattagttcctcctggtgcctctctccttggcttgcagatagccaccttccctgctgcctcctcacgtggttgtgcctctgtggtagcataaccctggtgtctcctcctcttcttatggggacaccagttatgttggattagggatccaccctaatggcctcattttaacctgatagccactttaacaacctgatctccaatatggttatattctgaggtattgggattagggtttcaacataagcatttcggggagggagggtcaggggcatttcagccttaatcagttcccaaatgtgtgtggtgaatttactaggggcaggtcctctgcaaagtgcttcacctatattctgtcacttcctctcagatttcagaggtagatacaatattatccccattttagagatacagaaacagaggcctagagatttagacagcttgcccaaggtcacagagccagtaactggctgagccaaagttgaaactcaagcttgcctgacaccagagcccacattcctaaccgtgattcctgtactgtactttggagaagttactaactaaagtgccaggcgcctagttaggaatttagtaaatgctagctcccttatctctatgaagccctaaaagagctcagagttgttgaatgactggagccctgtacctctaggtagtgctttctgctactcacagagccctttgcagtcaccttagtcttccaattcggcactaaactttaaaacataactacaagcaaaatgtgtccctataaaactctgcattgatgtgaaacagtgctataaaagtgaaaaaccagtggagaaaacaaaaaccatactacccaaatttccagtggagttattgtctgatgtggtgaaatgataatagcacaacagaaaaaccaatccatcaggctggtgtggggcttcagaggctgcccccctgcctgaagctggatgcggagacctgctcccttgtgcgctggcatggatttcagaggccgggggacggcaagaccagcctcaccatctcatacatggggtcacgttttttcagggacacagccacccaaagctcatggaaaatgtccctgcaaactgagtcccgatttcctgatttttctccttgttcccccaaacgctgaacactgcagtgaggccagccttgtgtttgctttatggcacatgtcatcaattccagagtttgtgatgcttttgaagacaggttttgctttaatctgtgtgtggacagagaatggattatggtggttgctgtgtcattctctctgtagtacctgaagccagagccagggatgaaggcctgggaggtgtcgtctctctcctccgataggatgtgtccagctgagcatagaagcctgcggacttgccacagagttgataacaaagccaacatttaaattgccttgtagattcttgcattacagaatttttgagctaggaatagcaatctagaccagtgcttctcaaactttagtatgtatctgaacacctaaggatcttgttaaaatgtggattctgattgtgtaagtctggaacacgacctaagaatctgcatgtctaacatattccgaagtgattgtgctggcctagcaccacagcagagcaaggacctaggctatggttggttttcaaacttagcatatagaaacaaatatcttgaaaggatggttaaaatgctgcatcccaggccacacagccgggaagtctggttcattagatttggaatggaccgggggatttgactttgtaaataggcaccctaggtgattttgttgtgtgtcacttaggggcatactttaagaaacatcgatctcatatagcccctgttattttatatattttgaaggaaggaaccaaacatcttttgagcacctaatgtgtgctaggtaccttatgttgatgccaactccttcagtcctcccaagaatcctgcatgaaaggtgtttttatgcttgctacactgatgaggaaactgggcttgagtttcactcactcaccagaaatgaacccaggtctctctgactttctcaccctcttactcctgtgagttttttccctaccttatgatgtgctttctatgcagaaacacatcttgaatgggagagggataacaatcataaatttatgaagctttcatggttcagtattttgaacttataagcgcatatgagtatatataagcacgtgctcttatctgagatctaggatattaatacttgaaacattgaaagaaaaagatttatagacctaaatacatgctagcaagtagacctttctaaattccctacaatttatcaaaggtagagttgggttttacattttagtctcttcagccctgtgggccagcagaagagttttctaaagtgatcgggcaatacttgtactgagaagtacattctgccagcttggaaattgtttttaaattttttttaagaaggaaagaaaaccaagctgtgactttacaatgctttggaattacagaatatgcttgtaatttttacaattctgcacagacttctttgccacatctggttgatattactggaagggatatatgggggaataaaccatggtctggaatgtgaaacatcccacaaaatgagtttcttataggttgctgcataaaacattttgaatctccttctctttggaagggtggcttaagtgatttcatggatttagtattttctttggtttgaaggtaagggcttttgctggtttacttggtgggccttccaagatggttttctgaagatgtttgtgtcatcctagagtcatgtcatggaccagagtgagaaaagccatcctttaaggaaatcagaccaacctttgttgaacagcactggaccattagagataatggtgaaatgtgggaccaactgaatccctcactgcaagaaaggaggcatgtagggagaaagggttgtatgtgtaagggcttcagaaaaacctcctaaatcttggccatggtggtacattgaacagctgatggcaagacaagctcacctcctcgcacatacagctgaaagccttcatacatcagtgtactctctttactacgtatgaaagtagtgagtgaggaaaatggaaaaataaaacaaacacccagcttatacttgggactcagtcaattccctgttgttaacattcctgccccctttctaggaagagaagtatgtgtccagggacaactaaagtattgttgaacgcctactgtgtgtgtcactccaatgtgctggtggttgggatgctgagtatagaacccagaaatgtctaacctgagcccggagggtataagtgtgggcttcttgccacctcgctctttctcagacttccttggctgggacccacctgtggagttgaaactgtgacagctgagccctttctgcacaaaatcagtgctgctctcagcaccctgtgacctgtggtggggttggccagcctaggcagggttttgtggcatcaccaagggtactcaaatagtcatctctttgttaagaacgagaaccagaagccagccttcacccataccattcttcattctctttatctggagttagaaactatccatggaattaaatattagggaaatactgcattgtatatagaaaaataacaaccttttgaggtgagcagaacccaaacacacattcttcagttgtctgaaagatgcaaatgtacccacatcaataatcttgaaatatttgttcctgaaccacattcagcatcaacagaaacatttctaaagagcctaattatctctcattttcaaccaacatttgggaatccctccaggggacaaatagtattttaatttgatgccccaaattctagcataatttcaaatcaccaaaaacatctgtaactttgtctttcttctggctttcctatggactcagtatcttggatttgaacattaaattccatttgtaaggtttgcagttcatttacaaagtccaggaggttgaggtctgtaatgaaagtgttgatacaatattaacaacagcaaagctatgataacacagcactgtccaaaccaaatagaaatggagacgtttaagtcaatttcatgctccttgcctaaatttggtgagctggacctgagtttttgattcatggtttagaataatattctgatgttttattcatgatgtttcttttttcccatcgttccttttctaattctcctcaccctacttatggtgatgaagcctgcttagaagtgtggcccgcccgccccttgattagcactgcctgttgcgtagccaaaaactctccccacggttggccaagtggaatatcctgctgttgaactgatggtttggcctcttgttggcgtgtctggggctctggacttgaatttttagtcaacgagtcagcttttgattgaaatatatgttgaatcatgccaacgtttctccagataaagggaacatcttgacttttggaggtcaaaatgctctgtctaaagaagaaaactggattttcaagagagtacaaggataacctatgactaatctcttctatctcagtctcattcaatttgggatttgtgaaactgtattgtggatcaagatactcagataaatctaacttcaataatttttttttttttttgagatgaagtctcgctctgtcgccaggctggagtggcagtggcacgatcttggctcactgcaacctccacctcccaggttcatgcgattgtcctgcctcagcctcctgagtagctgggactacaggtacgcgccaccacacccagctaattttttgtatttttagtagagacagggtttcaccatgttggccaggatggtctcgatctcttgacctcgtgatccgcccacctcagcctcccaaagtgttgggattacaggtgtgagccactgcacccggccaactttaataattttttaaagatgaaaaccagtggtagcaatctagagagaaatgaaaaatcatcagttttactgatattgctctaatagtcttcttcctatatctgtctcccactctgactcctttttgttaaaagcacaggcacatacacctaacgtaccacgcacacacacacaaaacctctctataggagaatcccagacagataaatgaagatcctttttgggctgctgaattaactcacagatataatttcactttagtgcaagacattgactattaaattagctcaaattattgggcaatgctatggtgagatattagggattagaaaggcagctgcagtgatggttgggggaagctctttgacttcttggctcataattggtgtttttggtccatagagatgatagtggcagatctgtgtcagagacagtaaattattactgtaaatgttttctggcctccagggagagctctcttttccctggaagagatgtgcatgggtcaggcttccaactgagaccttcagggactttcatttcatgttagaactcagaacagaccattgccaaccaccagttctcaagggcgtagccatcaaacaacattatcttaggaaataattgttaggggttccattgctaatggtattctctgcagatccttttcccttatgtgtgacacttcctttatttaaatgagagtgaaaggtgggagatcattaggtctaatggggctagaaaaagaagcagcagggaaagacagagttgctcagggaatattctgttctccagttcctccctgagtagagagctgttgatgtgagtgatgtgcatattgggtagaatttgccatctctgtcttcaccatgcattaccaatatgttcaccaccttttgtctctgttgccatcaccgtggaccagcagtccttctggctggatttcaaggacctcagtaatcttcctgctgtgtctcctattcctgtgttgttcattgtcaatctaacagccgcaattattgttttaagggaaatcagatctcctcttttccccagttaaaagttccaatgactttacatagtcctgagaagacatcctaagctcctgcactacatcatctgacccctggtacttgtcctagtgccatctcatgccactctccccacatccactgcactgaagcatcatgagccttcttcctgttgctccaacaattctcttcttggctttgctgttccttctgcctgggatatgctgacctcaaatgtcagtgtggccagatccttcctgaaattcaagtcctggctcagccatcacttcctcagagaactctctcatgacaaccctgtctgcagtcatggtccccttcctcattggtcactgtctacaagatgatcctgctctattttcttcatagcacttatcactacctgaaattctttttgctcatttatttgtttacttgtttgtattttgctctttcatccccccatagattgtaagcttcttgaatgcagggattttatctgttttgttgactctacagtcagttacctaccactgcatctagcacatggtgggtactagctacacactctggaaatgagcaaatgagagaaggaacctggtctctccaaaatctgctattccctctcactatatggtcaaaggtgccttttgttccaaaccagagctctctcctcattgccctgcaaaagccccgaatgactagttaacagcatgtgtgcacagacacacacacacacatatgctcatgcacactcacacaagcacacacaaatgagaataaaactaactcggtggcaggaggatttcatactccaacagtgggtctcccaccaaagagaaagaaacagcctatgctagaatctcttcaagcagatgtgagccagtgcttgagactgagagctggggaggggaatgttgtttttgatgcagtttcaaagatctgggaataatattctgtgatacagtgaaatggaaagataagctgtgttggcttcatctctaggcctcattgattttttaacttctaatagacattgaaagggattgtctagctattggaggcctcaccttagtgaaggctttacaaaaataacctgtggagactcaaacaaaaaccaagccttggtctggaaaaaaaaaaaaaaaaaaagaaaaaggaataggtttcactaatttattgaacattgacctaaacttccaaattatttttttttcttgatctgagatctaaaccagaggttgtttgaaagacctctggtgaattagtccagacctgaaatgaaccatatcttctaaaataattgaaccagaaccacactggtgcaacaaaatattaatgttttccaaactaactctgagactctggcttggtgttgtataaagctgtaccaccaacctactgtttgttcttctcctacatcctgcccccgcacccctacctgtcacttctcctttctgcaaacctaccatcattcaatcatgggcccgtcacccacattgcaccgaagaatgtgagctcttgagactctctttatttgctcaagagcaataaagtcaatgagagaggctgctgttaggaacaacctgacttcatcactatctttaatccatgtcacaaagaaatagaagaggtgtcttgtgagtgaggatatattcattaaatgaattgggtgggggaaggattatagaatggaaagaaaggaagacaacctgaagaatggaagaaggggaggaaggaagaaaggataacagcaacaataaaattaaacagggaataggggtgctaaagatagagatctggtaatagaaaggaaagaaagaaaataagaatcgtgtgtgtgtggtggggtgcggtatatctcaggtttgttttagtctttttctggctcctcccaaagcagctggaagaatctctgatcgcacgtgtgactctccattctgtgccaagctctgtgtaagctcttgtctctacagcaaccgttcagtgtgtaaggagccaccttcatagaatgccagagctgaatggcaccttctggaatttctatatcaatgccctcattttacaattggagaaactgaggcagggagcagtaggggactcacaaacctcagcactcagatttctggtttgttgctgtgggcacagcccaaaggtacctgcttaccttagccgtgatttttcattaagcgacaggggaatcacagaagacagaatcttagcttacaagaagtaaaggattgatgcttccctggtttgggccagctgggatagcagttacttttttaagaaaaggatgttgatgatactggtgatagatttgctgcagaaactaaggattagcaattctcacctgtagaaaaattgtgagtggttctaccaaagcactaggactgcctccacgtggttgctgtcatgatgtactttttttctcaaggaaaggagctgaaaggacaaacctcacgtgagagtgattccaaggaaagaaccaacagaagaggcaatcagaaggaaaaattggaagatgactccctaaggattccatcctgctgttgggagagtggcagtgccatccaaaggaagggaagagaaaggaagtctccttgaggtgggggtgacagtgactgcttcccagagctcacagcagttctagggaagacaatccattaggagtccagtctccaccctctaggcatttcagaagttaaaaagctaaagtcagctttgaatcggcatcattttcttttccatcccagatagttacttctcctttataaggagcctttgtatttaagaaaagaccccagcctggtacttagaatcccacagccactgaggacctgaccaggctttcctggtgggcagggtcactgcaccctgcttacctactatatataactcatttacctgcagctacttagccagactccagtgaggagtcccaaattgctatgctaatgatggtagccctcccctcccaagaagtgctgatttccccgctcagcatgagggacttcaataatatctctttccagtgatataatttgattcctccatgggatgctgctttggtcctagttcacttagcactaaatctctcgttagatactctcatgacttaatcttttcaggccccagatcagcccaggcctcttatttatttatctggggccctgtttacttccctgttgtaaattacttctggctcctggccgtctgattgctgcagtgatagactaatagctcagagctactgcatttgccttgtgtgatgaggcaaataatatgcttaacttatgggagagaaatgcaccctccatttatttcagtgggggaaaatattactcaggggaaagggccaaatcatttacctaatggctgctggtggaagtcgatgtaattactgacagaattatgtgaaacaaattgtcatgcctataaatctaaacctccagttctcaaaggcagaggggggatttcagtggctttcatgggctctgcctctggagccctcgaggtggatttctaagagggtgctggcagaaagagggaggttggccctctagttttcttcaccaggggcatgttcttcaccagctccaaacccaagcctgggcagactacagcctgtgagccagtccagcccactgccacctgctattgtaaataaagttttattggaacactgccacacctattcatttacatatgctatatggcccctttggtgctacagggcaacgttacatagttgtggctgagactatactggccctttacagaaaaatgttactgatctctgatccttattctaccagaagaaaaaatgtcaaatattttatatggaaatggagggattaatttaggtcactcctcttaacttctttcaaacaattcaatgccatagtaaggaaattcgaaggatctaggatggttatcacttactctgtattgcttctgcctctattcattgcatcttctctccacaatctggtggctagtaagtattagaaacccatttgacggaagagaaaatcgagactctgaaaggtgttttaggcaagctcattcagcgaagaaatcgcagacctggcattcataccttgcccgtcaggctttaaattctaccttctttcaggtaaacctcactgtttcctgagaaaaagaaggaagaaggcattggctttcttggggagacttatccaggccttccctctctctgcaaaagagctgctgagaggagacatgtgagcagtcaaggcagaggcacagaaagcaagaagaggagtggaggacttggtttccttcaatctgcactcactgtgggcttggtggtggagcaggcccagaagtactttagctgttgagaaacattacaaatgtttatcaaacaacaacagaaaagccaaagagaagaaaccctgggtgataaagagcttacttcatggactttgttgcctgagcggtgctgactgctggagagagagcaaggtccatatggcttccttatgggggacgtggaagtcaccagccctgctgcagccaacatggagacatagtcatggctctcaccctgcaggagcagctctctaggctttggggtagcctggggccagattctgttgccctgagcttcagaaacaggcaaaggaaagaaaggtggtgtgtaggaaaggcctgcagatattaccagcttgtctgtggaagccacagacatctcagggtgaaaacagagaccaaaagtacctcttgcaaaatagtcattaggctgtgaacataggaagacgagaagatatagtggaaataatagtcaataacacaaccacgaagcagcaactattatttgttgaacgcttacaaagcaccaggggctctaaatgccataatcttcagaatctcctttaatcttcataattatcctgggaaatgggtattaccatttcattttattatggaggaaatggggctcagagatgataaataatttgctcaagctaaaatttagatggtggcgctgataacccaaattgcctaacccattaacctttctgtgtactaggagtgggaagaggggaaaccgcagatttgaagccacactaccatatcccacctccaccacataggtccataattttgtttttctaagcctcagtattcactgtgtaaatggatatagcaacagccagagttgtggagacagtcaaggataatggtgtattgtaagtatcagtctattctctgactcatattaagggctcatctggcccttcttcattttgttccttcttcccatgactaagacacagacccaagctttccatcattgccgtcattgttcattgtctatggtattcctcagagctctgcaggaagtgggatccacagacccaccttctgcctttgaagtatttgccatctaaaatgaacatacatttatggaacacacagtcaggagccaagaacagcccaaacagttgtgaaaagagcaaagggtattttcatcatatgcatgtcaaagggagttgcattttagaggaagattttttttttaatcattcgtctttgttgagcttcagctccatgggataaagagcggagagagatctggaaatatgcaggtgggacaggtgaggacaggctgtcacttttttttttcttttgatcacactgggaaagctcttggctcagatatctcctctcctggatttttcatagattgtgacatactcttagatgagttggccttcagtagaacttaaaatgaaagaaaattagcagtgttttgtactgtactatgtgctgggcaggttctttctccagcatcctcaatttatcttcccaaccctgtgagggagggtattagtggtatcccatttgacgtcaagggaaagagtttaaagaacttgtgatctaagagttaagagatgaagacaaaaccagaacaagagtctttccaacttggaagctgatcatacatatcagatgctctgtcttcactctgagaaggagagatgctctcttcacttcctctacctttctaatgtcaccccagctgctggaaagaaactctaggaattatcgcaggggctgtgtgtggtctcatgggggtctgactacttccaccctagaggaactggtttttttaggactctcaggattatcattgacagaaattaaagaaatgcaggataagggaaaatgaaccaacaagcaacaacattggcagtgcagagccttgaggtaggatggcccgaaagaccccaggctcagagcccactaggtcttgtcttcatccacatctcacctctgcatcttgcagcttctttcaggtgtgcccttgtgatggagccctggcagattggcaccatatccttactggtttgtaaccagagaagggtcttctgtaccgtttgtaccagaaaaccctcagggaaggacttctgttgggcctggcttgagccacatgcctttccctagacccatcactgtggatggggcctggggtcttggatgagctgagtgtgcatcacatgtccacctttggtgactaaagaaagggagatggattctaggcatacagagactggagcaaacacacttcagccagcaggagcgctgagcaggatgtatgcaaaagatgacagtcagccttctatccagagtaccaggcttcttcaagcccaaagtcaggcctagagtgccatgcaatttaattcccttgtcctctgaaaatagggaaaatacatctgcagctattctcaagaacgacctaagggagctacagaggagcatttaatacagtggaggagacgtcaagactgctgtggtaactgcccagattagaacatttgcattcctaagactgggaaaataatgtgaggaaggaatgcacactcaggaagggtgtgcccttgttttcagatctaggagacagcatccttgaagcttggcagaactataggacaatggagggactcgatggaattctagatttcacctcttccttctcctcccgctttcactccttacgtactcctttcagtcctagccttttgcggttcagttaccatgttttctcttctctgcatctttatgccttctaactcatacctggaaccatcctctcactttctgctatccaactgaatctcattcttttttgtttttgagatggcgtttcactcttgttgcccatgctggagtgcaaagacgcgatcttggctcactgcaaccctcgcctcccgggttcaagcgattatcctgcctcaacctcccaagtagctgggattataggcatgtgccaccacacccagctaattttgtatttttagtagagacggggtttcatcatgttagtcagcctggtctcgaactcccgacctcaaggtatccacccctctgcgcctttcaaagtgctgggattacaggctgaatctcgttctttaaaattcattgctcatctctccacctctaggaagccctccctgactatgctggtcttatttattagaaagacttcttctagctctagcttccccagcaaactattattgagcatcagccatactccaactccgagactggtgctttaactgccttccccaccatgctatgagctacttgtgagcggggaattgtatttttattttttattagcagggtttagtacagcgctaaaatattttttaatggaaaaaatgcatgaatgggaagttgtgctgtaagagcagatgtcaattttatggaattcattacctcagaggtatttgaggcggaggatgtgaacatcagcttcccaaatgtctagatgtgcgtttcccaaatgcattcattttaatgggtgttcagcaacaaaaggatcctggtcaaataaattcagaaagtgttgtgctaaaggatgtatggaaggcttcttgattgcaggacttctcagggtatttaccatgttaatatgcaccgtgaatttccaagatgtgaaagtatatacgcagctagttcccaaacaccttttgactatagactgtgttttggatgcatttggtgggacttgagctttataggactggtgttaagaaaatgggaagttacaacttcttaatattaggttaattcataggttaaactgacataaaaggaccctgaaataagtatctgaggacaatctggtatttctcctgggaacccagtggtgatcaaaatgaaccaaagatttgtcaatgcaggttggcaattctgtggtcccatttcatttcaatctcaacatggcctttgagaaccttattgttattattagtccttttgtagcacccattttcctctccaggaccttttatccactaaagttgaaaaacatttccgaggctttcttatccccctacctccttcccaaagcttcctctgatttgctagaagaaaggtggcatttcccctccatgcctacactgtctaaacttgctggacctctttccttcactctttgtacaccacccttcacactttctcaactctatttctggcagattcctctagccccaagggggcagagaatagccgtaggccccttaggcattctgggtgggttgttggaactcaaatctctttctgaatccaacatccccattctccaccccaccccattttcctctagggatagagtgaatttttcccagctgagtcctccgaggtagatgtctgcaaatgttcagcaacttctccaaagcaatgaatattcatgtattcacagggtgggctgcattccagcctcagggcagggaccttgtttgctctgccatcctgtttctcaggactgaggtctaatctgtgtacctccagttgggagaccacatctttggctgaaacctctttcctgaggctttcaatctagggagtgctatacaatccttggggctgctacaacctctggaatcttgctgttggatatttgtgaaaaacacacaagcacaaaggaaacttgcaacagacacttgtactttttccctccacctccccacacacatttattttgcccattgctgctctacacttttgctcaagaccattctccctgcctgggataccttgcctttttttccaaggatcatccaagtctagagacagtgccatatggttcttaagagtgagggttctaaactggaaagtcattgcaaacatcacgtgaaataatccttacaaagtgttgagtacaatgcttggtgttcagtaaacactagctatgttatctaaccctcaagattcaaatcctcctcaatcagtgaaaatgctgcagccatctctcctcactgaagtctctctattcatctgtgccctgaattcctcagcatggtcagcagaaccacatcagtcacaccttttatgatgtctttggcattgttttaatggactgcttctcattttggtgttattaaccaagatgttccctctgtttctgccttttcttccccaactacatggttggtaaccatgatgtctgccaggtagactttgcacagaatagattgttaatttacttgtttttttaattgggctacctgattggtcaaagtcaaggatttggaaaaaccacccttgttctcccttttttgaaactgtcctttcaatgaaagagattacaaaatggcagtcccacaggttgattcctgccaataggaatgtttggcccataccattttttaaaaatgagctgactatatttaaaactggagagattttatataaaaattcagattgtttgttcctgtccccaaattgggcgctctggtggcagcagcaacacagggtttggtgtcctctaaggtagcagcctgcagagcccgtttagaggggcgtgttgtctccagcttgcttccattcccatcagtctcactgtcccgcatgggcagtcttttaagcttgggggacaaaaccgtcttcattccccaacagtgcttcacagaagaggtgactgaagcctgcaagcccaggaccaacaattggctgctgaggcaggctggctcttaggactcttcctcgctcctcaggaggaagagcaggcccctagcagggctctctcttccttggttgcctttggaagttatgactcttccggacttctgtttgatatttccgcagtcttttcacccctgagaagtagatgggaccaacatcatggtcttcatcccaaagaatagggtgcctagcaacattgtggtcctcagatgctcttcccaggatctgaaagccagtgggtgtggaggcggcatgaggtgttcaaatgtgggtgtcagtgtgatcagttgatcttcatagcacatttgttacctcccatccagcaaggccacatccctcatccgagtgcagtcaggaagggtctggaggttccctccttggcttccctccaggaagccttttgcctgaagggactattccctctgcgaggaagggcattcctgaactgcctgcccacatcacaggcttccaccccaggggagggctggacttgcgctctgtggccagtccctgcagcctctggcatcacacagtcaagatcaggacttgaagtttctctgcctggtggggctttgcaaatagagggtttggagcaatgggtagatgtgttttgaattgaagcagttacctcatttcatctcctcagtcaggtcgtgtttctgtggtgatgcagcttctctctcaagtttagtcttctcttgtctccaagtcttagttatactgttgctggcaagtaatttggggtgtgctaattaccatctgaactgagcagcaattctctgatagggaccaatttgtggtaaggagactttccttgccagggatcccctctctaattttcggaaccatgaaaacttctaccattctccccagtttgacatctcaagggcccctggcctcagacctttttgcatggaaaggctgggagaaaccagctaatttattttcctgagttatgttattgaaacctgattccattatttatttcagaaaaaaatgtgtgttttcatacacttcatatgtagacaagccatgtaatgatatattactctggaagcagcctttgagagcttctagttgaggcatggcaaagagattatgtcctggatgcccactcggattagataaatggtgctcagggtaatatattgaacatgactctgaggtcagaaaagctcagaaaaggcatctggggatatattaggcctggatgccgtggacccaggacagggaacggagcacattccctaggtgctgtcactcccatggaactcatgctcttcatctagcaggttaggagccggcacctagagattggaggcaactaggatgctgctgttgcttacaacacctctgtgcgagttagaaaaaggtgatcccccccccactctgggctgaccctgctctgggatcacagggcttgggatgaatcctaagtgaatgcctcttaagcaggctccctagtgctttggtggagggagaggagcatagagctgagtggtccccagtctgttgtcccagcagggtctctggccactggccaatgccagcaatcaaggaacttctccataatttgccccaatttgcccccatttccccttgttcctcctgaaggatgcatgcagctcagacttcagccatcagccatcagagcatccctgacagtttgaggccttgaaggggatcaggtgtaactgagtggtttaaaagtatgaaaaccagacagatctgggtctgaatctcgactttgtcactttgggtccttggccaactgcttaatttcccagagattcggtttggtttggttttgaagtagtgactcctactactttttgatttagtgacacctaaatcatagagccgttgtaaagattaaatgagatgctgcatgtagagctcccagcacagtgcacagcatttaattaacactgtctcagtaaacatttgctatttttatcatctgactagtggagtgcattttcccctgtcagaaaggcttcaaggcaggggagaacttaaagccagattgtgcagcagccccagagagctggtgttctgcagtcgtagaacaatagaagacaagattgtagaatatttattatcttttaaagttatttttcaccttattaagaatgatttgagtgagcggttttggatataatactaaatcacagttttgtaagatgcatagcctactttctggaaactgttttcattactgctagactgtaggaaggggctgacccgtgcttagagtgaagggcccaggaggatgtgagggatttgggttctgttgacctacggtgtaggagaaatgcttgaagagatggggaggagctcccacaggaaattctcatgtttgtgccagtctttgttgccagaaatctcaacagaacatgaaagttcagatccccagagtggacaggctaggaaattctcaggtagagttccaagagagatgtgtgtaccttccttcaggaggagtaaggggaaacgggggcaaactggggcaaattatggagaagttccttgattgctggcatatggccagtggccagagaccctgctgggacaacagactggggactaggtagtgcagccagagtgtcagtgaggggttgctgggtggcaggtgggcggggcagagggtgctaggaagtgggtagaggaagcagaagttcaggtaccagaagccagcctgcctgggttgccaccctctgctccttaccagtgcagattagcctctcagggtctcagttttgtcatctgtgaaatgggcatgatcatagtacttcgctcccaggattgctgtgaggattaggtgaattattgcttaaaagtgcttagaggccgggcgcggtggctcaagcctgtaatcccagcactttgggaggccgatgtaagcggatcacgaggtcaggagatcgagaccatcctggctaacacggtgaaaccccgtctctactaaaaaacaaaaaaaagttagccaggtgtggtggtgggcacctgtaatcccagctactcgggaggctgaggcaggagaatggcgcaaacttgggaggcggagcttgcagtgagccaagatcgcaccactgcactccagcctgggtgacagagtgagactccatctcaaaaaaaaaaaaaaaaaaaaaaaagtgcttagaacagggcctggaaccaagaagtcattcagttcatattggtcaatatcatcggttttttttgttttgttttgtttttgtttttgtttttaagagacagggtctcactctgttgcccaggctggagtgcagtggcacaaccatagctcactgcagccttgaactcctgggttcaagcaatcctcccacctcagcctctagagtagctaggactataggtgtacattatcatgtctggctaatcttaaaatgtttttcagacatggaggggtctcgttagtttgctcaggcttttctcaaactcctggcctcaagcatcctctcacctcagcctccccgagcactgtgggattacaggcgtgagccgccgtgcatggccagtcattgttattaacaaagggataggggaggtacatgggaaagtcactttggagaatattctacattctccaagtgacatgggatcatacacaaacctatctagataggaggcatcattcttttcatttcttccattctggagttactctcacctgtgctttttgggcaatgactgaagtaaaccagaaactggaaacaatgaggcctgtagcattaggaaggtgatattggggatggactgggtgggttgaagagggcatggtaataataccatggagcacctgtcgagctcccacccttttgttatgtgctgaatttacctaaccacaaacagatgccaggagaggtgaagtgacttgatcaagatcccacagctgcattataatgaggtctcactagcatgcagaccgagatgtgtgtgactctgggactctcgctgtttctgccacctcagcccactcccccattgctcaagatgatctccactgccctgcgaactgtaatatggctctcatgggccttgatgtgcccgctgctaaatgaagcatctgagcatgaacacgttgagagaataattcaccaggcagcccttttctcattaagaacatgtgtcagcaaacgattctctagcccagcatgaacaagaactttggggggagtctttggtctccatggcaaagacggctaaaaaacaaaggcagtgaccccagaagaggaggaggagaaaaaaattagtagcgttagtcttagatggaaaggtgaaagaatgtagtgcttggtttctggagtcaaatcctggctttgatctttactgtgtgaccttgggcaagttatttaacctccctgtttctgtttctttatgtgtaagataggcatgatgatatgaatagtgcctacctcttaggtttcatcccatcaacaaatatctgctaagcactcattcagagctaggcactcagaaactatttcattctaggtgctggggacatagctgggaatgaaagagcaaaatgcctctccttagagggctcatattctaatgggactcccattctagtgggggtgcacttgatagacaaggtaaacacataaagcaactggtatgttggacagtgatacatgctaaggagaaaaattacacaaagcaattgtctttgggggtggaagggtggagtgaattttagataaggtagccaaggaaggctttaataagaaggtgacacttgagtaaggacttgaagaagacttgaagaaggtgagggaaggagccatatgcatatttggggaaatattgaatgaacgaatttgtcaaatgaatgaatccgtgaaaaaatagggttgtatggatgaaatgtgatcacaataaatgtaacgcacttagaatagtgcaagatgcatagtatgtgctcaataaatattagctatcttcatatttagcagattaggcagtgaagttgttgctgtcactccccctacttctggctttctgaaagcattttcaagatacgcagaaaggaaggatacagaagcctcttctgattctattagcagactgcatacaataggatctctcttttaggttggcctaggcacaagttaagactcatcacacacacctggattataaaaattctcttatgcatgcagcccttctgaggtttctcatacttttgtgtaaattgcatcacttgtttcttccaacatccctgttgggtagcaaggcaggtgcctttagttaccccctcccctagcaaaggcaagggatctagcatttcctgagcacctactatgtgccaggcactctgctagttgttttgcctatatatgttggctcccttatccctccctagagtccgggaggtcatgcattatcattactgtttgaaagatgaggaaatctaggtctggctccccagattggcacagcaataagctgcttgctgggcctgaagcccaggcatccaacggcagggtatcttctgtggctcacgcagtgagcctgcccccatctttgtcccgaaaccttggcatgccaccccagcagggcagccttgcctgggaagcctgggaacagggcgtgttgttggcttgcagtttaattgaagtggaaagcagcccattgagacaggcccagatctgttaatcctgcttgtaggaatgctggagataaaagcagccatggacctagagaacaatagctccacataccagcaggaaagggcactgtcattgccccaaaccaaacaactgccagggcctggagggtctggcggggaaggcccaggatgaggctgactcatagagatgacagaacagcccggagagaatgggaaaatgtagaaggccaagtttaccccagtgcatatatactttggggctgagtaatgtggtagacaaatcactcccttcaccatcccacccagagtggaagcacaccctgaagcctcaaggataatttctacttaaaacagttgagtaaaatggaaccacagactctgctgcttcttcaggaaaaggggctgcggtcctgagactcccaacccgttgtgctagaatgggaccttgggaaggaaagctttctccgagggaattgaattagccggaaatatttaagatcccattttccctcccattggcttgtatttactggtcttgatggggagtccgaggatggtacttagaggccctgcaatggaaattctaaaacaattgaccagactttcgaatgtgtggttatgtttagatgtcttgggttgctttcccctgactttgaaaaggagcagacaaaacatgttgatttgcgaacatccttccagaacataaatcactggggtgagtgtggggttggagtctgtcatagctcactgggagatgggcccactgcctgtctttcatggtctcccctttgcactctgccctctgccccatggacattctcactgggggcccgcaagcatcacctctgcccaggcccaaaggaacgaatggggcaaaagtttgaggaatttgccttggtgagttttatagaaaaactagcctgaaagtggtaagattggaagagcgcaggagtggtcacgtcacccttccttccgttgtccagtagaatgacactagatagttcctgaacttccttagtatttcccgatatgctctctgcaatgataaaatatccagattttatctgggctgatagctcatgctatctgtctaatcgctttggtgaggttgccagcctcaaggagaaatcagggagaatcagaaattaaacatttttcagtcatttttttcacacatataagttgcattttggttgttcctctagagagacactagggaaaagggagccgctatgatgtccacagccctcattccaaacacccattgattaaacagagcctggctcagaaagcctgtgtcgggattaaggtactcatgtatcttaagtgcaacttggatttcccagttcaacctgggcttcatgcattggagtctgcacgttcaaagtgaaagtcatgtaaatcagatgaatttgactatcagcctggcacaccttttcatttccttttttttcctcgcacggtggcctgggctggaatgcaatggcacaatcttggctcactgcaacctccgcctcccaggttcaagcgattctcctgcctcagcctcctgagtagctgggattacaggcacacaccaccatgcccagctaatttttgtatttttagtagaggcggggtttcactatgttggccgggctggtctcgaacacctgacctcatgatccacccacctcgacctcccaaagtgctgggattacaagcgtgagccaccgtgcccagccccttttttaatgatcatcagagccattttcttctccctcctgtctgttattgagatatttactctgtgttggaatcaggttcaagttccccattctctgcaggtctttctcccttagagctatctccctactcctaccttaccttcctattatgatttggcagtgaatcctgtatcacctggctgacagatcttaatgatgaccctggccatttagcaactaagcctcctaccatgtgccaggcatcatacaaggtcattgccctaacttcattttatccttacagcagcctgaaaaggtaaggggagccaggcccagtgagattaagtgacttcattaaagtcccactcataacaatcggggtcaggaatggtgtgagctctgtttgaccccaaacctctgaacacggatgctttgactcatggtgtggtcagtgctgttggataactttgcgcacatgcttgtctggttttgataattagggaatatgctttgcagggcaggaagctcacatttctttgtgtccccatggcatctggcacagcacttttcactccaaagacctgcatgactgtgtgttgcttgagaggtctgagcagctcatgttcactttgtgctgataacctggagacaggaaggaaaggaacttcttctcctgctgtaagggcaacatggcgatacacagcacatctcaaactctgtgcatcccagtctcctggaggacttgttaaaacaaatcgctgaacctacccaccagtttctgagccagtggttctgcatggggctggataatttgcacatctaccaagatcccagctggtcttggaccccactttgaggatgactgtcatactgggaagtacaacccaaattcgaatcccatctctgtggcttactaaccacgggcaagtttctagaactctcaaggatccagtagcaccctctgtaatgaaagcataataacatcaacaagttgttgtgaaaattaactgaatatcccatatatacatagtatttctttagcaaatacagatacagcactttatatgtgctaaacacgtgttggcaccctttacaaacatgaacttaattctcataacaaggctaggtagtagtccctctgttttcttccttgtacagagaaggatactgaagcccagagatggtctatgacttgcccagggtcacccagctagtaagtgtgcagagctgggctataatccagacagcctggctcctgaggccccaccctcagctaccacagtggacagtacctggcctgtctcttccccattcccaggttacactaagaatgggccctacaaaagggcagagattatttttctagttcataggcagattaaccatacatgaaaaaaaaaaaaaaaagactgttttatgaccacagctttgaaaccacatggttggcctcccttctgatatcagtatggtcagccgggagtgactgtttctctttaaacatctctggcaccgaggtttatcattgctcaagaggacggtgctttaaagaggccttcaggctgaaggagtggaggcggcaggatgcgggtcagtaataaaagtgaagagagatttgcagctcccccatggagggcctcaggagtctagccagtgggcgggtacagaggctcggcccaaggaaggggcagtgatggacagggtgggaggggagcaaatagtttcagcatggcagagtaactgaagctgagagggcaggcagtgggagaattccagctatgtcatgggaaatggctatggccagggctctgaattagcggccgaccacaaatcccctgggaccctgccaggggtcaggagactggggcaccgctgggatgccaaatggtatgccatatttcattgtcagaggaggaggaggcgattttaactgttatccctagatgtgagtgctggcactgccaggagctgagagctgggtggggacgtatgtaggagtgagagagaagctagaaaaatccgcttttcattccaaggaacaacatagaggaaagaccaagccatgccgctggggattcgcatgatctcaaagcttttttggccaccatctctgaaggctttctgcccttttttcttttctctgcaaggtgagacatcaaagtctcccattgccatgttagagagctaaaagggaaatgctgacctggatccctcaaagtgtaggtggatggaacaatggggcttctgggagaatgggcttcacgtggttggcctgtttgacatctttggcttggagctgagcaatgaaatgtggaaaaaaatcagctttgaaagtaaacgagctcagtgcccagcccacgctggggatgctgggagggatagggttgtatcacttgattcattcctccagcttatctcaagtcctggcaccatgaggcctttataaatgtttgttgagtgaatgaggggactgattgattaattgcttaattatgtccaaacggatgataaattcaaaaagaatcttggctaactctttagaaatgcttgatgaattaaaggtttttctgaactcatcatcgccccctgtgactgtgaaaggaagcctttcacccaggctaagaggaatggacacgtctcttttttcttaggtatttcactggatttcatttacactgtaaataaaggttaatagcctaggccttaaagttagacaagtgaggttcacactgggcaggtgagatgtgtgcccttaggcaagtcacttaacttctctgagcagtaattttctcattataaaaggaagataatagtagtgtcttcctcctcagaccattaaaataatctctctgaatggcatggcacagtgatagacatgtaatagccttcagtaagtacaactctttgggatcagtgaggattaagttcaactaaaggaacataaaaccccttagtaatggcttaaacaaggtagagatttgtttttctttatgaatctacaattaggaaatctatagttggtatggtagttctgctctaccaagtgctcagagacccaggttgatttggctttgttctattatccctatgttgtggccttatcccagtagtctaagttggagtggcagccattatatacattttctaagaggcagaatgaaggaaaaacaaaaaatgggaaagggcatgtgctggttgcattttaagggaagtagccatgtagcacttttgcttatatcacgttagcgtatagttgggtcatgcttttttttgtttgtttgtttaagagacggagtcttgctctgtcacccaggctggagtgcagtggtgcaatctgggctcactgcaagctctgcctcccaggttcacgccattcttctgcctcagcctcccgagtagctgggcctacaggtgcctgccaccacgcccaactaatttttgtgtatttttagtagagacggggtttcaccatgttagccagggtggtctcgatgtgctgaccttgtgatccgcccacctcagcctcccaaagtgctgggattacaggcgtgagctaccgcgcctggcctgggtcatgctttttaaaaaaatctaccagtctctgttttttgctgctgttgttgttttgtttttttgagatggagtttcgctcttgttgcccaagctggagtgcaatggcacgatctcagctcactgcaatctctacctcccgggttcaagccattctcttgcctcagcctcctgtgtatttgggattacaggcatgtgccaccatgcatggctaatttttgtattattagtagagacagggtttctccatggctaatttttgtattattagtagagacagggtttctccatgttggtcaggctggtctcgaactcttgacctcaggtgatctgcccacctcggcctcccaaaacgctgggattacaggcatgagccaccatgcccagcctcagtctctgttttttaattggtatatttagacctcaggtgatctgcccgcctcagcctcccaaagcactgggattacaggcatgagccaccatgcccggcctcagtctctgttttttaattggcatatttagaccatttacatttaatgtaattattggtgtgccaagtctgccattttattttttgttttctgtttgttctgtttttagtttccttgttttcttgtgggttacaagaacattttttagaattccattttgatttatttataggtttttgattctttttctgtatagcatttttagtagtgcctctaggtattatatgtgcataacttatcacattctactggtgttgacaatttactagttaaactgaagtgtagaaacctcacttccctttatgttcctttgccctcccctattacaatataattgtcttaaatatttctacataaactggaaaaccacaccagacagtagttataatttttgctttaatcaccaaacataatttaggaaatttaagaaggaaatatattttcccatatttttactctttccattgttcttcctttttctgaatattctaatagtcattttctttttgtttagaggatttttttttagccatcttttaggggccatctgctagtgacaaattttcttagtttcctttcatctgagaatttcttgattttcccttcattccaaaggatatttttggctggatatagaattctgggttgacagatcttttctttcagcccttgaaaaaaaattgtgtcacttccttctggacttcatggtttctgatgagaaatatgcagtcatttgaattctttttcccctgtaggtaagtcagtaaagtattgtttctctcttgctggtttcaagattttgttatttccagaaatttttctatggtgcgtcttggcatagatttctttggatttatccagtttgggatcttctcaccttatttaatctgtaggtttctgtctttttccaaatttagaaatgtctcaaccattatttcttcatgtattttttaagccccatcctttctctccctcttctttttgatatctgattatacaagtgtttgatccctggggctctgttcattttttttttttaattctgttttctctctgttgttcagattgtgtaatttttattgttctacactcaattttacggtggaacccattcattgaattttttattttggctattttttcctgaaattttcatttggttcttttttctttgttttttgctgagacattctagtgtttcatttctatcaaacatgttccttattgttcataaaaacatttctagcatggctgttttaaaatccaaatcagtggtggcatcttttgattgtcatttctcatataagttggttttttcttattcactgcatgatgagtggttttctattgaaactggacattttgagtattatgttgtgcgactctggatcttattgaatcttctgttttagctggcttttgatactgctctgacatgggaaggggaggcattgcattgttatggccagataggggtggaaatccaaattctctacttggcctccactgatacctggggggaggggatctttgttactgctaagtaggtgtgggaatttcagctcttcacttggtgtctgttgataccacctggctgggagggcaagcatgccttattactgtttcccacatggcctcccaacacctcagggtagaaggggcaggggtggcttctttactgctgggtgctggtgaaagtactgacattccatagaactcctctgacatcactcccacaattatgtcacaggggaggggtaccttttatctgttgccaagtgggcgtggaagaccagccactccttacagtctctgctgacattgtatggagggacttcatcactactcagcaaagttcagagtcctagctccctacttggccttctctgatactactccagcagggacttggggtactttgtctaggctccctattcagccagtgctggtggaggtggggggggccagatttttttgtgtgtggtatctcgttagagtcaagtgattattgtcttcaagttttctgtttactaagctgccaggttggagatatatgaagcaaaaggaaaacccagagaactcaccaccatctgtgtcattcctgaggtcccaagtcccttgccagcctgccttctgctctcctgcctctgagagtcttctggtgtttgttttgtataatgctcaaggctttaaattcaactcagtgtgatgaataagcaaaagcacatctacgccatctttccataagtagaagtcctctagatagctttttatgtatatcatcaggtacctcaatggttctgacagagcgacttgagccacctggtggtttgcaccatcgtttgctcatgtatgattacctttcaatctcttagtgagtatttttagtgatactgcctggtgcccatcagtaatgttgtagaagatgctctccaccaaggggaaaaaacagcccagacagggcaggaaatgggcacagatgtgccttcccatctccacagccagggaatacgtctgcagatcctagaaccaggcttctcgaacacgaggactattgacaggctgagagttcacttgtcaaattagccattgggggtgagagatcaattagggaatgcttcattagggtgataaagggcattaaagaggatgttacttggccctgtacacgtgtgcatgtacactgtggctttctgggaggcatttatcttagaggaaaaggtattttcagaggcttccctttactccactgtattgatttctcactctttgtcagaagggaatgagataggaagaaagttgttcgttttctctttaccagttaggagaatgacctgggcatctcatagtagtgagcctgacattctgcagaatgtttcctgaggcttctatggggtgagaagttaataagttttcatgatcaaacacatttgagaaatattaggttaaaataagtaaaataactttctgtggaacctttgaagaacctttaatatgctgatgtacattgcaaatcttcagtgtttttcaactttaccccgtcacggatccattttgttatggagcactgctctctggactggtgtcctgaagaggcagcttatgggatgtgctactgtaggcgaggtggagcagttcatacgttgaacagaaggagtagtggtggtccttctaaccagggtgcacaggcaacttttcttactatctgtggccacttctgtccctttagaaaagataaagccaatttacatttgtcacttggagaattggagggctatgccttagtcagatccatgtcccctgcaaactcttacttcaaaggaaaggaaaaacctcagaattctgccttgggtttcctccaaagagccaagtcccccaggttacccagaagcatagactcactgcagtgagcaaagactcaggctcatattttctctctaccttctcccagtcccagccttgtatctacgttagaattgagatctctttatatttggggatcttttgctccaagtgctttgatttttacctaggacaaaaggtttatacctttagcagcttgtggggcagtggggttttcaataaattaatttcagatccaaattatgcatgatgttgcattatgtaaatgtgacttaggccaggaaaaaggtttggatcactattagctgcagacaccgaggtgttgacggtggttggaacagtcttgctttgtctgagtaggaatgcagcctccaaaagctgactgttgatagggaagacttcagtgtattgtccttttgttaaggaaaatatgtggatgtgcttggcaaattggtccctatctgactcgcagacacagggttgattggctcaaacactagctgctgacgctaggttaccaaaaactgcaacttattgtgcacactgtcattactttaaccaggtcttggtgaagctggtaagccaaactgactgtcttcaactttgtcatcctatctgattcttagagctgatttttagatgattccttctgttgatgttcctgaggaaagcattctttttaccatgagatgtagtccaaagatggcttggtctgagattgctttgaaggttaatttggaaaagcctcgatgagcttataacattcaagaagaacgttctgctgatcatgcttattttctttgatccttgttctcagtttgctacatatttcaaactaagttttagaattcctgaatgtccacaccacccaaggtaataactaacatttatagtgcattttaaaagtaccaagcattgtgctagcctttatattcattacaaatttacattcatcacaaatttaattccctcaataattccatgaagctgtcttgactttattaatgaggaataaagtgattgaggaacatgttcgagtttgcacagccaatggagctctggggctgggatttgacccagagcctatgctgttaactcaacagtccctctctcaggatgcacctgagcatggccttgttctcagcaatgagatgtgtctgccaggcaggagctggacctagaaccctaggactaggcagaaggggtagagagtcatgcccacctataggatggcagcaggcagaactcaggaagtgcagggtatggccaaggagccagcagcatagggaagtacaattagaagtaatagaagcagaacaaaatgatggaaacattaagagtctatgttacccagagctctgaaaaggctggcagcatcggccaggcacggtggctcacgcctgtaatcccagaactttgggaggccgaggtgggtggatcacgaggtcaggagatcgagaccacggtgaaaccccgtctctactaaaaatacaaaaaattagccaggcttggtggtgggtgcctgtagtcccagctactcaggaggctgaggcaggagaatggcgtgaacccaggaggtggagcttgcagtgagctgagatgacaccactgcacttcagcctgggtgacagagcaagactctgtctcacaaaaaaaaaaaaaaaaaggctgggagcatcaagggagtctgtcaaggttacagctgggtggctggggttcagagtaggaccccatgcatgaacttgaactaaggggccaagtagttcaccttgatggagtctggccgaaggaagacatctgcagccaataaccagaactagagttcaaggagagactccacactgaaggcaaaagttgagctaaaaggaaagggttagaatcagagtcaaagcaacattcatgttggggagtcctggcctgcaaggcagaaatcccaacatcccctctgcccaagagataattaacttcttgtgctgatttaggacaagcccttcaggcagactactagcagcctgtgcctgacgttcagcctgtcctagagccaaagataaaacgcaggcctgcatatttaagaaaagccaaggatctgagtattgtctgacagtctgtttgtagagagagtaagacagcaaacttgggttttgcaataccactttgctgctcaaataaaatacagtccactgccacagtttacaggttgtaatatttgttaaaagaatttgaattctgcaaaagcacctgaaagctgcccaatatgctttccattgctgtgtgaagcctgaagagtgcacatggcagttgtgaatttcaagggttgttcagggagagaaaatcgttacttgtccatttgccaaataattgggaatttagctaagtcaaagtagcgggtgggggtggggtggggctgaggattcctcctcccctccccattggcccaaatggagtgaggggtgggcgacatagcttgatttgaggcgacttgtcagtatcctgctgtgcattctgaacctggcccacgtcagccgaagtgatgtcttatccagacacacactatgggaaatgtgaactggattgaaatcagagcagggatgactatggggacattcagagccttctgaaggtatttttagaatgcttttaacctgaaaaagggaaagtgccacctttctggagaccgtagagctgagaatgactcacagcgaaaccaggctatacctaatttgggggaagccccctttggctgcttccttgggtccaggtgggagtgcctgttcttaagctctgggaatgtgacataccggggtaggtgtcattacagcccctcacactctgagtctgaaactaggacactcacagtgtcagggaaggaaataattattccctatatttctgagtatggtttacaaaacacatggatagattttctatcactgatggtattggatacactgggcaggcctgctgtcttccacttttctgataaggatcttgacgttcaccatgtgccacgcccacacagctctagagtagactctcagcccatatactcacctgtaagccaaaaaaggtacacgtggtcaaaattaccccgcaaaatgctgcaagtcatccccacgaggcggtgcccagacactttgcccccgaagagctggaagagattagttccttcagtggactaccagccaaattcaggtgacttacatttagaggtcaagtttcttaatactcagcctgctgagatgcatgcacgcgggacacctgcagaagctgagggatcagcaggttcgagtctccccttccacgctcactgcaggtatttgctttctgagtgatgtggcaggtgaccatttcagttgttgactttctctttcttctttgtgagaaatgcacatagttgaatttgctcaatttaaatttgtgtgtgctgtggttttcctggaagttacagagcaagcatttgagccaaggccccctgacttcaaacctggggctctttgtaccataatcacatgacctctctgggtccagtgttgcctggtcaaggaaacattcatctactaacctttcagccataataacaaaactaataatgatgaggatgtcaacagcaagtattgagatctcattttgtgctaagtgttgcacaagctttattctatttgcttttcaaacaacaccttgagacaggtgctctgatcatcctcatttcataggtgggaaactaaggcagaatgattgaatagggttgctcagcttgtaagaggcaggggcaggatttgaagtcagatctagcatctccaaagccttcaccagtttgctcttctgcctctttctctatcttttcctgaccactgagggatgtgcccacttactcgatgaggaaggcaggcctttcagaggctaaaaggagccgaccctagtactttacagggctgggctctctggcttgctctcatcacaagcctgggaagttagtagcaaatggccaagtcatctcactaaataaagtttccaagaaagatgacattgatgccaagtgaacaggcagccagcatgtcttctcccagggctgacaaagtactcaaattctttcttgtgtactctcaaggaagctcattttggtcccttacaggagggctgtcccagcattggtttttctccctgccaaagctgttattccaggctggcttttaaagtgagtgagctctttggagtattctgctttcagtgtgataggccattagaacccagtcgcagtggtactatggatggagctcagggaagtctcagaaatgagggcaggaggtttgatccctataaaaggggaagcaggaccactcagggtagagggaaatacactcccaggcggcaatgggctgcaaatgatgcatttaatgaaagggccacctgctgtgctgagagagagatggtcaaggcaaggcaaggaatcacttgctcagtgggaagcagggggtggtcactgcttctgtttcaaacgtcgatcctggtgtccctttcacttctcttctgtgttccagccctgattcctgaactgccacctgggtcccaagtcccaaattgtatttttagagtttttttttcctcactactagatccttcttatctggaagtccagctgtagggagcttaggaccctctttcttagggtcagaaaaggtttgagttttgatctttccaaattactggagaattaatttcagcagatgtttccagcatctcccgcatgaaatcagattgctgattcccaagctacgtgtaagggtgggtttttaagaatggcaggtaatttacagggtgatggctggatcctgctccatatccccagatcctttggagaccagtagataagacctctcttatgcagatgtgaactcttgttcaagttcttgttcaaggtcacaatgcattagtattaaaacacagcaggaggtagtttacctgactcttaagtcagcctttcacctccttcatcctggtgcctccataaggcaaagaggggccagggcgattaaaacagacattactgctccattactccattcaaagtttgtacatccctatgtgaggtaagggtgtgtgtgtgtgtgtgtgtgtgtgtgtatgtgagtgaaatagaatgggatgggaaattgttcctcgatcccagtctgggacagagaccattttttcttccttagttagacctttgtttaggcccaagtgttctgcatgtctcagagaacctgcacagcctcacagctttatccttatcttattttgtatttaacctcattagccatttgtggtcctggcctagaccagatcatggcaagcacacaaggcatctgtgatgtttttctctgccgtgaagtgcctggtatagtaattaacttagagatctggactacaacaggatattaggggttggagcggggagcagattcagaaaaactcttgctaatttgcagaggtcttcataaaacagaaactaattatttgttgatttgttgctcatataaggcatatttataatatccaattgcccatcaaaatgtaatggtgtgaagagcctggttttggcatctaacttccaggttgaaatcccacacactggccacgtgatggtgggcaagttattttatcttccagaacctcgatgtcttcatctgtaaaacaggaatgatcaaatgagaattaaaggagatacgcagtgatagtacttggcatagttcctggcatagagggaagtcaacaaaagtagagggtctcatctagcctgctgcagccatctcatgccatcacatccactgtggctagagcttagattctgctgaagtaaggaccagctaacattgaccatctcacctgactcgggagagaagaatctgttggaatttgatcacaagtgtgtgctgtcagatcgtcctagttcgggacacttttgtgtaaccagattttaaaaaccattttacgttattcatgcccttgatctttcaagctgtggaacatcaatttcctcctcttcactttcaccactgttcacaaaagtaggtaaacggtggccccttttcccctcccagtttctttgattctgtggacttgtgctgatagccactagagggtgtaccaggggtctctggagtctgggtctcttacagatggatttgaaaagtcaaaagtcaatcattgcagagccctcagaggtgaagagccagactgcagtgcagatgcaggaacagaattttagagctggaattaatcaaggagaattaccacaagttgaaaaaaaaaaaaaagcccatgttgtattctctcataagtttaggctgtatctttttttctaacaagaccatttacaataattttaccgccaaacaatcattgactacaaaatgcctttctataagcaatcaaataaaatctgttagcgtcatttcctcttaatttgtcatgcaattagtgtgtgattagaatttcccaggctgtgtttcttctgttttaggagatcggactagcttgtggccatggaatttagagttaaggagatctggctttcaaatctcagtttcctccacttaatagctctgtagcttttggcgggtcatgcaggctttctgtctctgttttctcctctataaaatgggaataacgatactgctttaaaggacttctgtgaatagtagatgtacactgagcacagcgtctgggataaggttttccaataaatggcaggtattgtgatttttttttttttaagtaacactgttagtcacaaacatcaccgatttgtcttggagagcagtttatgacttctaggatataattaaatgtgtcagctccactactgtttaaattttatccactccgtttccttgttaaacatttattacattatttaaggaatatacattttatactgagcaccaatgccaaatcacaattagtaacaatttttatacaacacataaccgaggtcagggattgtttatgcgagatgacgacagccacagaacaacgtgcaaagaaaatattatgcctgcttggccattcctaacatttcaagtcaaggtgttgcatttaattactctctagaaggtttaatctcagacttattaagagcatgattttgtgaaggcaaacaaacacctctgctagcagcaccaaacatgtttattccaaatagttaattaaattgtgtcagttcctgccctggagctttcaggctattctgttttttctgcccgtgtggacgttttgtcatcatcattcatttttatttcctcttcggccttttaaaaagagctctgagcagcagcccaagcatgtgtatagttggagcattttgcaaagttaaattggttaaatacgggcccggcattggctgctgggaccatctacatttttcaaaatccactgaggtttttcagtggcatcaaaacaaacgtgaacaattctgaccctgaacataagcagcaatagtgactgaggcctggattactctggaaggacttggagctgcatggaaggaggacctgagattggaacctggtacgtggagatatgatggctgacttccaaagctggctaacccacacctcatcttctttccctgacctgcaaaaacagacaggaacgaatcttcttggaatctttctctaagaaaaaaagggggcttcctttttggcttcaggcgtacagggcaccagccaaggagggggcagagagaagacggaggaaaagggaaaggcacacagctctgttttcatggcagtaggtggggtactgagagagtcaacatcaggagggttttacttcttagacatctaaggcccagggatacttgacagctggcgcaggttgcaccagacaccctctactgaaaagcaggaggcccctggtatctctatactctcatcctggccctcttcagctggattagagagaaaggggcagagggccaagaactctcagatcagtccatagaaagataaatacttgcaagtcaatactaaggataaaaccacctaacctcgtggatagtgctgtaatgtacaaagcaccatcaaatattgatttatggccaggcgtggtggctcatgactgtaatcccagcactttgggggttgcagatgggcagatcatgaggtcaggagattgagaccatcctggctaacacgatcaaaccctgtctgtagtaaaaattagccaagcatggtggcacgtgcccatagtcacagctgctcaggaggctgaggcaggagaatcgcttgaacccgggaggtggaggttgcagtgagctgatatcgtgccattgcactccagcctgggcaagagagtgagactccatctccaaaaatttttaaaaatattttaaaagatggatttatgtgtttgtcaaagtcctgctatgtgccagaccctctgacatttttttctgatgtgtggctggaacaaatttggtgaaaggtgtatctacccaaagatgtatctagcctcagaaatagccctgtgctggacccactgtgggggctgcataggagtatcagatatggttgcatcttcaaggagctatcaatccagtatgacagacaataacaattgacatttagcaagcacttactatgagccagacactaggctaagtagttttcttgtattaactgcagaccacactgtgagataggcacaatcactatctccatgctacagatgaggaaacttaaggcacatagaagctaagcaacttgtccaagttcacacagctagtaagtggcagctccagcattctgctgcataaaaagataatgggttggtaccctgcatttaaaaatgtacttgtaaatatcagctaggcaaatatatgtgcaaggtgaggcctaaaagccctcaggattatattggtttgaaggaagaaggggggctctgtgagctgggtgtttggcacaggtgtcaactgggggtgtgacttgggtttggaagagcttagagaagcagggagagcatcctggtgggtgagaggtgtgcaggtagcagtggaggcaggaggagccgggtgatctgagcaggtggataacagagaagggggtgtggaggtcagaagggatggctagagccagctggcttgtgaagggccttgaacttcaagccattgtcatcaaaccagaaccaggggaaatgaagtgatgaaagccctgcagctgatggaatcccgggaggcatcaggctccgtcagggcagtagattccctcgtttgaaagagaaaaccgccattggttagcaggaacatgggccaaacactgcgtcatgtattattttgcaacatcaccagcctgtgcttaagagggaatacgttttgcggttaagaacaaataccttgcagcctggctgcctgggtttgaattcttgttttgccacttattaattgcatatccttagagaagtgactcaacctatccgtgcctcagtttcttctcagtactgtaaaatggagagatattcgtaatacattcctcatgaggttcttgtaagaatcaaaagtgcctcacatgtgataggatctcagtatgtgttagctattattttttttgagacagagtattgctctgttgcccaggctggagtggagtggtgcgatctcggctcactgcagcctccacctcctgggtttaagtgattctcctgcctcaacctccagagtagctgggactacaggttgtgtgtgccaccacacctggctaatttttgtatttttagtagagatggggtttcaccatgttggccaggctggcctcgagctcctgacctcaggcaatctgtccgccttggcctcccaaagtgctgggtttatgggtgtgagccactgtgcctggccagtgtgtgttagctgttattgttgttgttgatatgttatcatcttcagctttgagacttgagcattattccagagcccagaagctggcaggaataggttattactctgcatgtatgagtatgcagttttatccatacagagcatccctctctgtttcttagccatctgaggtcattagctctgttaacgggtgacaaggagcccaatgtatgtggctgggccccttagctataaagaagttaattgtagctgatttactagaaggctaataacataggtgtgcttccttttacatggagagcctcattaagtggaggtctgtgggctttgcctgcagctttgggcatctctagcatctgcacatgtataccttagaagcaacattgacctgggaagaaactgacacgccctgcaatgtctctaccggaaaggcccctgtcctcagcagacctagtgggcatcgagcaataataaattgtgtttcctctgtagtccaggagacaggaagctccaaattggactctaattaactctgaagaaacaatgggtttctccagagcacggcaattctggtcaggtctaaggaggtgtcacgcagccttggaaaataattacaaccataatgacgatgcctccaaagtcgggcttctgatgatgcaccttgaacaaatgtgtgtttctccttcctcacaaggttcgctgcccttaattgctaccctccttcattaaggggcaattaattttgtgccttggtttaaaacggcggtaattataaggtgaagacaaaaagcccatggttaaacataatcaggctggatgtaaaaggtgctccctggcagattaaggaaggtgggagggaaggagcatgcatcgtcccaggcaggcaacattttccgtcttgctacttcttttctcaattcgtaactgctgttgcagggtagggcttaggacaaagcccgtctttttctgcccaggttgcaggactttgcgtcttgcgggtcttgggttttgaggtcttggccattgggcattctcctgccatagaagtcagcccgaaggcctggactgagctcagtggcccagggccttgggtggtggacatggcttcccaaagagaccagacccttcctgaggattcacatgttaggggcactttttatttcagtgtcattctaaacacaccttccatcattcacttacttgtcaaacatttattgagagcatctagacgctgtgctagatacttgggatgaaatggtgaggatgacaagcatgttccatgcctttaagagtttatactcaggtgggagagccggatgttaatgaagcaataacccaaataaataattagaagcagtgaaacatttgcaaaaggaaaagtacagagactatgggaacgtaaagcaggggccatgacagtaatgaggaaagatggccccgacaaagggacttgggggccgagatcgggagtggaactcagcaaggtaaacatgggagggaaggagcattctgctcctagggaagaacatgtacaaggaccccaagacaggaacgagtgtgaccttcaaagaatggaaaataaagggcacagagctgggcgaggtgagtgtcacaagacaatgggaagaagcagagataccataatggccctcatttttcccatccataaaataaaaatggtattcccttgtctcatctacaccatggagattctactatgcaccttgcttttctcttacagtggagagtcaaagctggaatcatagtccttaactcacactacttactgttggcagctgagagaataggacattctactttgatatttctgtattttctctccactttttgccatggagccatgtgactctgcccattgtgagtgctctctcactttctctctccctgatatatattaatgcatgcatcacacacacatgtgcatacatactgtttttgttgttttttttcgttttctggctctgtcacccaggctggagtgcaatggcacgatctcggctcactgcagttccacctcccaggttcaagtgattctcgggcctcagcctcctgagtagatgggattacaggcatgcaccacaatgcccgactaattttttgtattttttagtagagacgggttttcgccatgttggctgggctggtcttgaactcctgacctcaggtcatccacccacctcggcctcccgaagtgctgggattacaggtatgagccactgcacccggccaatgcatacatactatttatgcaaacaaagttgaaatcatactgcagcaatgtagtgtgagggttagggcatcgactttggtgtcagattgagtttatatcctagctgtactaacctttagccacataacttgatgatggtatttaacctctttaagaatcagtttctacatcttcaaaaggaaggtgagactgtctatctattggtggtgtttggattaaatgacattccatggaatgcccttagcaaactgtaaatccagaataaatagtaacaacaattacattgttattactgaatggcatggtacagtatctggcacctagtaggtgctcagttaatgatgatatacttgctaaatgtttcataatctgcttttcagctgaagatagtattaataaggtttatttgggttaaagtggcagagacacaacttacattaaaaatagggacttactggctattaggatccaccctcctttcctatctgcttccttttgcatctcagcatcattctccctggggcagatgggctcccttcacatagcaagaaaggtggcctctggcagctccaaagatatattcttttattactgaccaacctggaaagaaacattctcttccagctccaatttgaacaatctccatcacagattattgactcagcttggagtacatgcctatcacgtggaccaattactgtggccaagacctgagttggagctattgacagtctccacctcatggttggagtgaggagtaggtgtgggggtaggagcaggttttcccatagagggtggcaaagtttagcagagacatgaacattagtgaaatcccccagttagggcttatgtccagagtgtagcacaggctcaccctatgggttctgttgacccagcttggccagccatgcaagtgccaggggtggcgcaccatagtttgacttggaacctagtcattccaggagtcccagtttatactctcagtcttagagctaatgaactgctttgctatttcactgtgtctctgggctgaatccagtgggcagtgacccaacacctgagtgatttgtgggcctgaaggaagacgagagaagctgattatggagtcagcaattactctgcccaagtccctgcttggcagggccttatctttatttatagctggctgagctacccagagccctgtttttacccttgagtgactagtgcactgcagttttagttcataaaacactgtttgtttataatccttaacggattctgttttattaaaagagaaggctccatccagagtataaataaagttaactggttaagttttagcttctattcacagtgaatgtgcaatggatgggaaatcaccgtggaattatgcaccctcatgacctgactttatttatttatttatttatttatttatttatttatttatttttatttttatttttatttttattttttttttgagtaggagtctcgctctgccgcccaggctggagtgcactggtgcgatcttggctcactgcaagctctgcctcccaggttcacgctattctcctgcctcagcctcccgagtagctgggattacaggcatgcgctaccacgcccagctaatttttgtatttttagtagagatgggttttcaccatgtaggtcaggatggtctcgatctcctgaccttgtgatccatctgcctcggcctctcaaagtgctgggattacaggcatgagccaccgctctgggctgagatgttaacttttttttttttctttttttgagacagagtctcactctgccacccaggctggagtgcaatggcgcgatctcggcttactgcaagctccgcctcccgggttcaagccattaccctgcctcagcctccagagtagctgggactacaggcacccgccaccacgcctggctaattttttgtatttttagtagacacagggtttcaccgtgttagccaggatggtctcgatctcctgaactcgtgatctgcccaccttggcctcccaaagtactgggattacaggcatgagccaccacacccagcctgacctgactttatcaaaaaacaaaaaaaaaaacaaaacaaacaacaaaaaaaaatcttacagtctctgaggtctcaggcctggacaaaaccttttcaaagatggggaggtggcaaggaaagaggcagaattaagatcctaaaatcagctttgttgcagtggatttgctttaagtttccttttgtttttgtttatttgtggggtgatgtcgtagtcagtatgtctttgtgtatagttccatgatttgggggtcatgtcggggtagacctaattctatttctattctattttgagggagaaaggatccccaaagcaaagggaatagtgaaatcttcttggaacaggtagcatcgagctgagtcttgaaggataggtcagattctgatcaatatgggagcaaaaagaaaggaaaaaacgtaagttgagtttatcgcattgtgaaaaggaattgttttggatatgacaagaggattagtttgcatagggcatgaagatgacaagatggagattggattcaagggtagggttctactgtagggtgatggccagatttaaagagttttatatttaatttagaaggcagtgaggaaccactgaggttttgaatgggagaggggtatggttggtctaaactttggcctgcattattcttttttgagagagggtctctcactctgtgacccacattggaatgcgacggcgtgatcatggctcactgcagcctagaccttctggactcaagagattctcccctcagcctcctgagaggttggggctacaggcacacagccatgcccagctacttttttctctctttgtagacacagggtctcactatgtagtccaggctggtctcagactcctggcctcaagtgatcctctgcctcaggctcccaaagtttaaggattacaggtggatgtgagccaccgtgcctgaccgcctgcgtctttttttttttttttttttttttttttttgagttagagtttcactcttgttgcccaggccagagtgcaatggcgcaatctctgctcactgcaacctccgcctcccaggtacaagcaattctgctgtctcagcctccgagtagctgggactacaggcacacaccaccatgcctggcttttttttttttttttttttttttttgcatttttagtagaggcggggttttaccatgttggccaggctggtctcgaaatcctgacctcgtgatctgcccactttggtctcccaaagtgctgggattacaggcgtgagccaccgcacctggccccggagctctttgtgagcacaccttcgccccatctccagctgcctgtgccacttgcccaccgtcaggactttattttagtattccctggactcttgctccccagtcagccttggttctagggccctgcagagattcctccaccaggaagaaggacccatttctggctgtgatgaaggccttggagaggtggcagcaggccagcccgcccctccctactgaggcatgttagctgcacttacagtgtctgagctgcggttaatatatcaatatttgctcgcgagggtatctggcacagaacaggttcctgggatgctggcagatagattgctttctcttgtagcattcttcagcggcattctgttttggcagggatggaaggggttactagctgctggcaagagtggaaaaggagtccccattcttcccagaagtgcctcagtctcacaatttggccctgtatgatattgtcagcacctcgtgttccctccatcactaactatttcctggtgtattttgctcattgcagtttttctggaattctgttccttatacccatgttttgttttgattgctcaactaggagcccctgggggggtgggctagtgctggaaggagtagagcttagtagctgagtgtggggctgggatcagatggcctgggatgaatcctgctgttgctggctagctgtgtaacccaggcatgctccctgacctcttgatatttcagaggtctgagaaactaggatgatgatgatgctggaagagctgtaaggattagataacatcacacataaaaagtagtttgcaaaaacttgatgcgtagtaaattctcaataaatattccattttgttaatcaccattcttctcattcaataaatagtgcttcttggatcctttggcctaccctaagtttcttgaggacaaggaccaaaccttgtatttttctgtagttctgtttctaagagcacagtgctaggtacacaagaaagtcttccttcaactttagggctttgagaaaacaatcttacccccaaggctggtgctcatggcactgggcagtagtacccagggagaaatcaccagtgacagaggacttgtctccagtcttgagacatgctggtgaaaagtgagggaaggaactgtgatctcttcaggaagctgagaaaagagggtctgggcctggagaaggtctccaagaaaggctggagcagtggggctggatgtggacatcagttgtccactgccatcagtcatgagcaacctcttaggatagtcctggagctttcaagtgatcactttaagacttcgaacaatttccccatgataatatcacttagggcattttcattgcgaagcacttgcttgactcgcaagtcagagattgtgggatacccagaatgtgttgctggatatgccatgcaagtgtgccatgcgtgggggcatgagatagcacgagtggaaccacagaggggagaacacgcaaggctcgcagtgccatcggacaagctctatcccagacgtcaggacagagcagttgcaacgtgggaacttaacatgtgccaggctctgacataagcattttctggacattatctcatttaatcttcccagcagttctataaggcagttgtcttagatcactttcccagaggcagaacctgaaccagggattcttgtgcaagggatttgtgtaggaagtgctctaggggggaaggggttaaagaaatgggggcagcaggagaagacaggggaggaagccaggcagatatgtggctgcaggaaaagtctagccttagcctgacaccacaggaggacccatgcgaatggcaccacagatctgttctcacttgaggcaagggggcagggcttccgctcttttccgtccaccagtcattggctgtaggtcacatcgcccaggacagggtggggtataagtcccatgcgtttacgggagagctcccatattgcaagggctatattgagctgttagcagccaaacttcacagcagccagggtcaaatgcaccaacacagaaaaggggaattgggtggtgtaccaacagcatctgctgctattgccccattttccagatgagaaaactgaggcctagagtgtttatgtaattggcccacagatgtgctgagccaggatccaaacccaggcatctatcttgatagtttttggttttgcatgactcccttctctgttaaatcacatgtcccactcaggggccaggtgagatctagtaaatgagagagaggtgagacaagggcccaggagtcctggagatgaggaaaaggtcataaaaggagcccacaggtcaagaccagactctaggctgctgtggtgtgaccaactcatcttgctttgtgagggactgcgtgtttggctctgaaagtctcacatcgtgggaaccccatcagtccttggcaaatggggatagttggtcaccctaggtttctgggtgggagcaaggcaaggatgtgagggtctctgtggcgctatgtggcaccgtatgaggcagtttaaaggtaatcacagttgtcattccccagggcaccaaagtcagagccacctaagcaagtggccatttgggggatgtggatgaagggacgtaagccaggaaaaacccctgtcaggagggtatcctggccaggagctgagcagagaaggtggtctaagatccagggtgggctaatgagaggagagatttgcattgataggagaagacgaggggaataagttaccagccccctgaggcctcctcagggatcttgccggaaatagatacccttcccctgcttcccgctgtgaagcaaactgtttctctctctctctctctctctgtgtgtgtgtgtgtgtgtgtgtgtgtgtgtatgtagatagaaagagaagagggggagattaattgagagagagaaggggagaatgaacattggaatccaatgaggaaatgtccttgtaagttcctatcccatccgtagagttgggcgaggtaaagtaggttcctgtgcttttgaaaggcctgatggtctgaatctaaggagtcttccacagaagacctgtcatgagaagctgtcgggaagtccagatttaagaagctcatgcataatcatgctcgccccttggtgaagctttctgggtaagagacaaagaaactggccaggtgtggtggctcactcctgtaatcctaacattttgggggaccaaggcaggaggatcacttgagtccaggaattcaaggccagcctgggcaaaatagggagaccccatctctatttttaaaaattaacatataaaagaaacacatagggtggctaggatctaaagtccagaggcctaaaagcagaagtgggtcccagatccccagtcttgctccttgcgttataatggttcaactcatacacactccccacccccaaacacacacaacctcctcctagccagaagaataccctggcccattctccaatgggaaagcaaatccaggcccataatgaggcattgaggcattgggcttgtttttaggcgttgaaagatggggccagaggtcaccaagtttaacatccatgatggtcaggttagcagtttccaccatagccttgttgacatgtgatccagactgacccacgacgggactattgtttcctgccatttctggagcaaggttggtcaagggaccgttcacagtcataggagcggtaacagcaaagttctggccaccacctccaccctgtccagaatagaggagctgctgtgcttagtggcaggagtcctttgtgagggagtggctggggctcagctgtgtgggtctgtgggagatgttgggaaacacctgccctttaatgggcagggtagcaggcacttcaaaaaggcaatgccctgactcccttttatttgagtctttagaatcaccactgctgtttcagtctcgtagttcatgctactttttcttaagtttcccatgttgacggaaactacccacgatttctgaggcctgatctggagaggcgattgtccccctcccctcaagctggcttctgactgtgatgtccagtctagctcctatttggtaggaaaagagagaaacaactttatttctagttctccccttctggttttctgacctatttccttatgttcaagagactgtcccaggagggagcagggttggaaaagaaaggagtttgtgtatccgtgtccgtgatatagagaagtgatctgtaatgtgaggggtggtagagacaggacgagatggtgacactttcttctgtgtaccaaggctgtggcctaaagtttcttctcaggttccttggggcaaagtgattctatcctacttagaaaaaccttcctggcctgccattggtggtgaaggggttgtggggagaaggatcttagaaggacaaggctggaagcaagtttagagctcatggagattgcctagttctgtcattttccagcttccagtattttgcgacttcctgatgttttttgtgtgcatcccacagaaagagatatgtataatttatatcatgactcaggaaacagaagcatatataaatattggaagaagagtgtcatgaaacaatacttgtcctcactaccactgataaaaggcatgactgatggtgagggtaagtattgtttctgtgttcctgctagtttctgtgctatttcatgttttgaaagtatttgtgctaacagctgctaaattggtcttatgaacccaggaaaagagaacaactcatggattaaaaaaaaacactgatctgccgggtgtggtggctcacgtatgtaatcccagcactttgggaggccgaggcaggcagatcacctgagggcaggagttcaagaccagcctggccaacatgctgaaaccccatctctactaaagatacaaaaattagccaggcatggtggcgggcacctgtaatcccatcccattgactcaggaggctgagacaggagaattgcttgaattcaggaggtggagattgcaatgagctgagattgtatcactggactcccaccctgggcaacagagtgagactccgtctccaaaaaacaaacaaacaaaacacactgatcaagtccaccctctcatttgttagaggggaaaacagatgcgtggtgaagggaagtgatttacccagtgtcacaacacatagtccatgtatatttatagagcagctactatatgtcagaaactgtttggacactggatatatagtggtgagcaagacagctgtgctctgccctgaagatgcttagtcttgtggaggaggtaggccttatgaaaataaaacataacaaaaacctacatataaaattctagtccaagctgcaataaatgccacggaggggcctagccaagagctctagtggaccagctggggcatgaagggtcagggcctactttttttattattagtattatactttaagttctagggtacatgtgcacaacgtgcaggtttgttacatgggtatacatgtgccatgttggtttgctgcacccatcaactcgacattttcattaggtatttctcctaatgctatccctcccccagcccccagccctccgacaggccccagtgtgtgatgttccctgccatcagggcctactttttatagggtggtcaagaaaggtgtccctgaggatgcacagtttaagttaagtcctatggaaaagaatgaggcagctatgggggagtgggagaaagggaggacagaaggcaaaggagtaggggaggagtgttttgggcaaagggagcagcaagcatgaagaccttgggtccaagaagacttgaacttaagctgaaagaaagccagtctggctgcagcatgtgagagggacagaggccccaggtggttgcaaagagaccgaggggcccactcctgttagaccttattggacttgattctaagctcagtgagtagccattgagaagtcttaaagcagggacgtaacatgatctaatttatgactttaaaatatcctgttggctaccatgttgagagaagatttgagcagataagcgtggaataggggaatcagttgctttttatctatagtctctagaggaaggccagtggatctgcctttgcaatggcccaaagctttgcacatttagaaaacctgcattattaatgaaacatttgcatcttaggaaatgataaaacaggctgctacatgtaaaaattaagtaactcaatttgttttaacagcttgtgctctagtacagcaatttgtttggcatatacacaagactccatcggaacagtaattatgccatgctaattattttactgcattgtgtacatctgacgtttaattatgggaaagtatgtgagggtagattttcttcctccctttgcctgcctgacaggtagttttgtttcccatacctcttttgcacctacattgtctttatgccaacttgtcatctgcagtgaaattgtgtttccatgacagctttgctcagccatgttgcctgcaagttgcagacaatcaccaaaataaacagttgacacagatgtcattctcaccctctcattctgcctctccctcccccttaatctagctcctactataaagattttatttttctcccacctcgagaaggaaagtgatccctgacaaccttgagcatcctttgatacgtcagcatgtcgctcagtgacttctcttgtaaccagtgcccttctccatggagactgttggcaagccaattcccatggctctatgcatagatgacacagctcaacggctatgggctgtagaccagcaggctctaggctttacattcatggggaggtggcaaaggtgggctctcaccactcaagattccaagaagttgaaccacagctgtggcatgtccttcacagagtgcattgacaaacactgtaaagtgaagcaggcttgtgcctgggccgtgcccacagagataatgggcttgagggatgcaggtggggaaagggaatggagaaagaggaagttcctgcctacaggtagaaatataatatctcgacttggataaaagaaggaaaagaaggataaggtgcagatcataaactacaggcacctcttgctagccatcatcacagctaatgcacctgtaaccgcctccccacacacaggaaacagttgtctatgtctctctactgaagaggtagttgcaaagagaaaagacattgtgagagtagaataggaacaaaagcaatggcttgaaaataaaaataataccaaaagtcatcttttcaaaaaaataaatgcctggcaacaagactgtacacctcaaaatatagcaaatgcccattaaaatatttgcacaaccctgttatgagtataaaataaatgtccagagggattacagatcacgggaatcttcccagagctagacaggagtcattctttcttcttggtgtgcaccgtatttccttgtatacttggggttagccaagaaatttagtgcatctcaggaaaatagaatagacatacagaccttcagcttgatacggaacatgctttttgagaagtcctggttcctgcttagttcatgcaaacttagatttggatcattccagcttatgttttgctatttcagatctactgaaactgcaaaccctctggcccaggaatttgcataagtcagcctttcccttgagtgccaggcaaatctctgttggttcacaagatgatttttggtggcacgtggaccatgtttaaaaaaattttaatagttgtatgttcattttaatatgtatcaaaatatgtctaactggcacctcaaccctgtgttttaatggatataacacagtttcttgtgtaaatacagacttggcatgccttctttttcctctctttcaggcccttattccctttacaaacttgctgagaacttactactttgaggttcctgtcttctggaatttcacttggctctcttcagccctctgtcatacctctctatttcttcctccgccttttcccccttcctttttctttaccccgttatcgtccacaggcattccttagagcatagtgtgtgctggacatgtggggtacttcaaacaggaatgtgtacaactatagtggcttaaagaaacaggactctgagtcctgaggaaggcagaatagagctgatgtggctcttctaggatggtgtggaagacccaggctccttctgtctgcctgggctaccatctttaccatgtggcttcatctttaggtttgcaagacagctgctacacaaaagtgatacttgtgaagtgccctctctctagactttgtttgatatttaagaagctaaaccctttccttcagatctccaaggccagtattgcttcacatgttctgcaagggaagtacagggagttcatgcttttgctttacagcctcaattgtagaggaaggcaaggaagaatcgggttatgaatggtttaggcatagctaagccacagagtcagccaaggaggaggatagtaagaagtacagataatgatctctggccttccttttccaagctgaaaaagtaggtgttaaaagttaacagctttctaagttggtgcatgatcgtaaacctgcagaatcaggaaagaatttagaagtcgtttggatgagatttatattttaaaagataaagaaactaattcagagataaaagggacttagggctcagtgggacaagagcccttctcagaagaccctgctaatttagtggttctcatctggaagtaagcatcagaataaccggcagtacttgttagaatacctattgctgggtcccactcccagagttcagaattcagtaggtggtctggctggggcctgagaacctgcatttctagcaagttcccagatgatattgatgctgctccaggtactgcgctcggagaaccactgtgctaacctattccaagcatgtaatttacaatcagtaatccccaaacagattttcgtatgttttactattttaacttgtgcattgttgtgtgttcgttaacagctaagtaatgtagttgcagataattaatgcagccaatgggtgagctaacttaatcttagacctgtctatagctatgttatttgaaacccagagggtctttgctcctatgacctggctgtgcctcaaagggcactctgcccttttccggagatgaccactactgtgtatttagtgaacctctgtggtccatgtttcttgattttttttcaccacttaaatacgtatctatatgtggcacatattgcaacattttgtatattttcaaacattatacataaatagtatactctatcattctgtagcatgcatttttcattcaacattatgttgagctcctcatgctgacacatgatcagtctagtttaactaactgctttgtagtattccatattcatatactagaatgtatttttccttccctcatgtttcagattatttttaagcagattaatgaggcttcgatattattattaacagcaacaatatattgaagtggatgacatattgaactatttccatatatttgctcatgtaacaaatatttatcaggtgcctactttgggctaggcactgttttaggcagggaggatacagcagtaaatgaacaacctcacgaccctgatgatgcttattcatatgacacctgcaacagctctgtcaaccaggtgttattattttcatttttacatatgaggaaatggacattctgtgaatttaagtgacttacctgggtcccaccaaagagaacaagggagttttgaatcagatcatctcactgttatctcagctctttctacagttccaccaggatgtctgctgagcctaataacaaacaccattccttatcttcctaattttctttggaggtcatgacttttgtttaaatatgctttttattttggaataattttagatttacagaaaagttttagagatagtacagagagtactcctaaacctctagtctggtttccttcattaatagcatcttacattactatggtacatttgtcaaaactaagaaactggctgggcacggtggctcatgcctgtaatcccaacacctggggaggccgagatgggtggatcatgaggtcaggagttcaagaccagcctcgccaaaatggtgaaatcctgtctccactaaaaatacaaaaattagcccggcgcagttgtgggcacctgtaatcccagctgctcaggtggctgaggcaggagaatcgctcgaacccaggaggtggaggttgcagtgagccgagattgtgccattgcactccagcctgtgtgacagagcaagacttcatctcaggaaaaacaaacaaacaaacaaacaaacaaacaaacaaaaaaaaccaccaaagaaactggcatttgtatattactattaacagaactccaaactatattttggtgtcactggttttcccattaatatcctcttctcttttccaggatttactccgcagtgccatgttgcattcagttgttatgtctcctcagtctctttactgtgacagttttttcagtttttttcctggttttcatgaccttgaccttatttttagtttatcccaaatgtccaaatgaggcagtgtcaagaatttagagaacttttttttggggggactgagtctcgctctattgcccaggctggagtgcaatggcgcaatctcgtctcactgcaatctctgcctcccgggttcaagagattctcctgcctcagcctcctgagtggctggtattacaggcgcccaccaccacatccggcttatttttgtatttttagtagagacagggtttcaccatgttggccaggctggtcttgaactcctgacctcaaatgatcctccccacttggcctcccaaagtgctgggattacaggcatgagccaccacacccagcctagagaactatcaatataagtatctcttaagagagtttggatttgattgccatttcagcacattagagaggggcatcttactcacacgtgctctcctggtgcaaaaacacagggaaacaatggagtgacgcatggcctttcgggccaggtgcttgcagagtatggcaaattgtaggtttcgatgaacaagcagcttaccaaggaattataacccccgctcccctgccgtgtccaagtccaattccaagtgtcttataaccacagtttgatgctgctggctcctcccccagctccacctttgcctgtgagtatatgtatctttcaaaagtcatctcttatttccagtaactccaaatacaagccgccttttagtgacaagcagatgagcgtgagctgcagtcgcctggagtgtgcaatgctgtcaccagagagaacttagtaattacatttgccaggctcaccgtccatgttggctggcaacatgaagggatcagagaattctttgaaacaatatccaagttcttggttaaaagagatacaggctgggcgcggtggctcacacctgtaatcccaacactttgggaggccgagacaggtggatcacttgaggtctggagttcaaaccagcctggccaagatggtgaaacctcgtctctactaaaaatacaaaaacattagccaggcgtggtgttgggagcctgtaatcccaactactcgggaagctgaggcaggagaatagcttgaacccaggaggcgcaggttgtggtgagccaagattgtgccactgcactccagcctgggcaaaacagggtgtctccaccttaaaaaagataaataaataaagatatatagcattacactacaggatggaagagcccagaaaaaggattccttcttagaagctactgaagagcgaagtgatttcttagggcagtgtttcagacaaatttaaaaaatttatatatgcacacatataaattatatatatatatataaatatatatatgtatatatatataaatgtgtgtgtgtgtatatatataatccatgacccgtgtcccaaagaaaattattgacattttgcctattttcttctatttatgctttttaaagaacattatataacatgctttttaatatgctttcattcaacatcataagcattttacctgtttcttttaaataattattaaataaataacagtttttcatttaaataatctttagttcacctaatcattctatggtacatttggtaagtttttaatgccttgagaaataatttttaaaataggatgcttccctccttatttattagattatttctgtaagttagattcccaaagtgggattactgggtcaaatgttataaacatttttaaggcttttgagccattttggggttgaggaaaaacccttcttgttagagctctacagaagccaagtaatgatgctaaatttcctaatttgccgtatgtcactgtttgctctctgaacttaagtgaactttgacttggccacaaaactacagttctgatttaattcattcattcactcacacaggtttaggtgtcaggtacagtgccagatgctaaagataagagaccaagcgaaaccagagcccctgctctcatgtccagaatagcatctgacccagaaagaccctgatttgcttgacaatagagttagataaacccatttgaaagcatctatttttaccagagacttgatgcttgaatgctgactatcttcttccggttttgttcttctaagttgctccgattttagacaaagatgaccactccacattctatttgaaaaccattcaacttgagttcagggcacaaaactaaaatattttgtctgtgcctgggcaaaccattttgtgtggagcctcatgggcctagcagctgctgcttccttttagtaattgggaagcactgggatttctgataaataattgaaagtgtactctggcaagttgctacagcagttttaagggcagtgcctattttaccattctctgcattggagagtaaagcccttgattttatgactcgacttttctgattgtcctcattggtactcttagcctcatataaaacattttctttttcctttttttgtgatgatgactgagtgtgagaggtaccatcttgaaatggcttccttgtagggatggaagaagaaattgtctgatcaacaggagtaactatcagaccaactctctgatgatgaaaccatggtaagtcatctggggaatcttttggataaattacttgaggccttgaagtcagtgcagacttttcattgtaattatgtggatcgtgaagtcctgatgactcccagtggatctcagtaaagagtgactaatggatcatggggtcatttggttaagtgggagagaaaaatctgggcaaccaaggatcaggtttgaagtgatccccatctgtggcctaacctctggcaaatgctgtctcctcctgtcacctctgggctctgactcagcagggcctgcctctccagcctgattagaagaaagatccagacaatttggcagactcgggcatctccagcattgccccttgcaccctggtgcctccactggttaatgttgtcgtgtcaagggagcagagcctgtgtctgagcaaagcagatgatgtagtgcttgtgagaggcagtgctctgtgtcaaccatgatgtcatttgagagggccacccagtccaggtctaagttgtgcttttcatgatgtcaccactaaagtcccttgactatgaatcaaagacatttctcttatgctgacttcttttgttaattggtagtaagagaggaaagaggctctgaggattacaaaatatcttaccctttagcaacatcatggtgttgcctgcgtgaggtctcacatctctctctgtctctctttctcctttccctcttcctctctctctcctgctttccttctctctgtctcttctttatttaaatacatttgctttttaaatttttccagagcacttgtcacttcagaacataaataggatgtctaaaatacatgatttttaaaataaaaatttatcaaaggatcctgcaaaggaagatagtcctacaaggtcctttgatgtctaacgatgtgccattggagagctagaaggcagcaaagcccgactttctaagataaatgtagcatctcttgcaataattccatgggccgcttctgtctgtgggtctcagtgcaaacctgccaccatgagatgagctaaaaagcaagcttgcaaaatgaagttcctgaggagtgtgatctctagggccctagttgaggtactcttactacagccaggctgaaagcatatttcagcttgtagcaagctggtttcgtctctacctgaggaaagataaagaactttgctcaggaaatgtgagcccctgttcccaggcttcattcctctcaagctgatggacaggtatggaaggaatgcgttcgttggcaggaattagataatgcccaggcacaaatggcagtcacgttcttttcctccctctctctgctttgggggaaaaatgtggtaggaggggatgctctgcagggagaggggtgcagaacaagctgtctcagcttcagccagctgccgtttgtcactggattctgacaatggcatctggctccgtgagtgtggaagccagggacctccctcacggtgaaggccgagtgaccagtgggagtcagggtaaaccttcactgtgagtcaggaacaagctcccctggatatattttcccaaagaagggcatttctccacctttttgttaataggttatatcttcatcctaactacaagacttggtgattcctttgcttttgtttccagcgagaaggctttccatggcatgcaggtggctaagacaggaattaagaaacctaattgcggccgggtgcagtgattcatgcctataatcccaagcactttgggaggccaaggcaggtggatcaccacgtcagaagatcgagaccatcctggtcaacatggtgaaaccccatctctactaaaaatacaaaaattagctgggcatggtggcgtgtgccagtaatccaagctactcaggaggctgaggcaagagaatcacttgaaccaggcagtcggaggttgcagtgagccgagattgcgccactgcactgtagcctggcgacagagtgaaactccatctcaaaaaacaaaaaacaaaaaacaaaaacaaaacaaaacaaaaaaataaaaacagaaaaacaaaaaataaaaacagaaagaaagaaacctagttagcctgaagttccaaccataggattggccaaatgtgtaataggtcaagagaatgctacatttctgttacaaggggatgcttgaaatatatgttagctcatatgtgaagagggcaggatataataggctaaaaacaaaggccatgaagtagaaggtacagcacaataccacatcggtattctccatatgtattcattttaaaaagaagaatagaaagcatcacaaccaacatttaaatagggatgatctctcggtgatattattggtaattacttttcctttgaggtttctctgttttccaacttatttccttgaaacgataaacatttaacttctttctttagatggcttttaatcactctatttctcacaatcttgacctatatccatatctacatctatacttctctctagagttgctgtgtagagcactgcaccagcacctagtttagaaggggtgaagtggtatctggaatcaatcccttctttgatcagcttgttaagtcatccctgacatgggtcagtgtctgcccagaggaaagggagctcttttccaattttccccaaaggaatgtcttgttctagtccacacagtgatactggatttgctcacagcaaccctgcttgtctatgtgtgtgtgtatgtgtatttaaggggacttcaaaaagttcataggaagatggagttaaaagatacaaaataaagtttatttcccagtacaactccatcaaggtcaagatacttttgtaagcaatgatacctgccattcagtctattcctaaagaactgagggtcctgggaatttaaccatatcaatgccatcttttttacattaactgaagaaaaaagggggccctttacagattttaagactaggaagtaaaaagaagtcagaaggagccaaatcaggactgttaagtggatgcctaatgatttccgtctgaaacccttgaaaaattgcccttgcttgatgagaggaatgagcaggagcatggttgtggtggagaagggctctctggcgaagctttcctgggtgtatttcagctaaaactttggctaactttctcataacactgccatattaagcacactttatggttttttggccccctagaacatcagcaagcaaattgcctggaacatcccaaaacactgtcaccatgacttttgctgttgaccagtctgcctttgctctgactggaccccttccacctcttggtagccattgctttgattgtgccttgtcttcaggatcatactggtaaaaccatgtgcctcctcatttcaattcttagaagaaatccttcaggatctagatctcatttgtttaagatttccactgaaatctctgctcttgtctgcagcctgtttgggtacaacagttttggcacctatcaagtaaaggcctcgttcaactttatttttgcagtcagaattgtgtgagctgaaccagttgagatgtctgtggcattggctatggtttgcgcttttaattatcagtccttttcaattagagcacaaacaagttgaatttttttttttggaaaattgatctagctggtttattgtgggcttcatattcaacatcatctcattccttcttgaaatgagttacccatgtgtaaactactgactgggaggtgggctttgtccccatcaacttttcataaagcatcaatgatttcaccattcttctactcaagctttgttataaatttgatgtttgttcctgtttcaattttagcagagttcatgttgctctgatagagattctttacaaactgaagtcttacctttcttagtacctcaaactagatcctgttcagacatgtcataacaagctagtataagttgattttggtgcagttttttttttaatccatgcatggttttttcatagtaaacgttttccattaagtttttgaagatccctcatatgtatttttcccattaatcattttggtcatttcataatcaccatattgtattataaagagtaattatttctcagtctacatgtatcaggattctttttactcaggcctagattttagaactagctttctgtaggggtaggtaaagttcaaggattttgtagaagaatgagcttctttggacctttctactatcctattatgtgcctaaatccatatttcctagggatggggatgggctgggagagaagcaagaatatttgatgttgaaaggtcggtcatagacattgaccaatgggagacccaaataaccctgtggtgccaatagaatgcagggagcttcattgttctaggaggtggtgatggtgttaccggtaacctaaaataaagggacactgtgaccatgtggctatgctctggggtgaaagatggtgtcatcctcttttcaatctgtatccctttgttgtgtggggggaaactgatatagctttacagagagaactgcctgtaagccagaaacacctggtaaacaaaaagtgatggaaccaaatggctcccagggttcttgcctcaagtcagagaaaagctgtgatgagccaaaaaatactccaggtaccagagctcagggccttgatgcacatgtgaaaggcaggcaccttccagaaatagcatccctgaccccagagacttggatggccttgttttaatttcagggttagaataatgaccattttatgagcaaccaaatagttattcttggttctcctctcgagagtgtggtctgagaccttggcttgtatagtctaagtatgtaataactgagtgtgtttcccatgatcctgtgacagccttcactttgagttctatttcagaacatcctctttctggagacacctaaacataggccctagtgaaatggaatttagaagcagcattatctgcagggcagtctggggccaagctggccaactcctcaccctcagttcaatggaaagcaaccggaagttgcccctacatttgggggatggtaaaaggagctaccatttggtaaaccgagtgagtgtcccagggcagcttatgaacaactggaattctctgagaaatcagtcaaattggagtgttgggcggtgacttggagttgagaaaggagcactaaactggaattcacagcagctcctgcataaccacatgtgcgtcattatcctggatactgtcatctctgggtcatggccagggcccttcctgctcttaaaccctatgcatggttttatgcacaagaaccactagctcaggatgccttacagaaaacttttttgcaagaggaaaagccttcaaaccaggaagaagtgttgattgtcctctctctgtcataaatgcctccattttttatgataatggcattttttaaatgttaatgatgagattgttttcacctcatagaatggcttccaaaactaaatacagagcaaccaggaatatcggaatgaatgatcccttgaacactggttaactatggaagtgaaacccttctgagttttgacaggacgcagcagcctcagtgtcagtaaatacttaggacaggcaggatattgggttcaggggaaccttttggaagagtcaggtgatggctggttgcaggggcgggttctttttggaaccccagtggccgatgggtctaaagccacacaaactatgccacatgagaatgtgactttaatctagccctctcttgaatgaaatcaagtagagattaagtcagttttgactctcatcagaaaggtttaaggtattggagttcctaaatttcatcctatgtctttggggttaagaggtgaggctctgggccacagctcctgatgtctcctggaggggtggttcatgagaatgaccatatcgaagagtccttgagaacatagactttggaattatgcagatctaggttataatcctggccctaccatgtactaggtgtgtaaatttggccatttaatacctctctaactttagcctctgtattgctaaatgggaaaaatatagtatgttccatgtagtgagtagttaggagaaaggaaagagatttcatgataaattaccaaggaatgggggctgggcttataagaaagggtctggcatcaatcctgtgaacaaaacactaggattagacccatcacctctaaagcaggaagaaggaagttagctgggatatgggtggtgggccagtgattgcagaggcccatcaagtaaaccaagactataatagggaaaatagaagacctactgggggctgagcacaggtaggatgcagctctcaaggtgggcacagaacaggcacgtgtgcaaggtgcaagtccttagatcacttggtgtattcgtttcctactgctgtcttaacaaattaccacagatttagtggcataaagcgacacaaactgagtctcttacagttccataggtctgaagtccaaaatggatttcactgggctgaaatcaagatgttggcagggtcacattcactcttaaaatcctaggagagaattcatttctttgcctttttcctgattctagagtccacctacattccttggctcaaggctccttcctctgtcttcaaagcagcagtgaagcatcttcaagcctctctctctgctgtgtcatcacatcccctctttctcctcccaggcccagtgtggaactctgttggatggcactagacagaaatcacatccctcctacaggatttctacaaagcacgtgttcctggagcaactattatgaggaagatagagaaggcctagaaaatttggtccctgttgcctttgagacttgcaccatcaccctgcaactgagcactctgaccaaatatcaagatcaactgtgctttctgaaagatcaaattaagtctaattttaaatgggacaaaaggtagcactctttttatattcctacttaagaagatatccttcttggttctgttccattttgcacatggagtagttttaaagagccacatccaaggctggatttgaaagctgatgaacgtagctatgaagagctttatgatgaaaagggttattactggcctcccatctactggcttatctttttttattctttaagtcatgtgacaaatgagggttctgataggattgtctttggtgtggtttcatgagttgacataattaagagccatttccatttggcaatgctgcaagaaaaacatttccagtcagaagaacaaggaaataacttaattagcaactcaggtgagcgctggctctttagaaagatgttaagattggagggaagacaggagacccacagaggcagcgtgccacagttgggtgtttagccaaagacacgttcttctgtctctttcctcctgcatgagtcttttctgactgttcacctgaaattggatatggaagggctctgctgctgctgctgccagcctggtagacagaaaacgtcagtgtcaaagaaaaatgattgtgtgtttggttccctccagttttcacgaaataaacatcacttggcaattccttggagatgaattagccactatttcattcctgttagtccttcctgctgggttaattattgctgtgaacaatggcagcattaatcagcatgataacagtttctagtcattaacagtgtaaccagcttttatgcatatggaagtccctctatcaaaccatcatgaagatcagaaactcattctagggggtgctccttcctaggagacccacaagtgtccaggctgggaattgttcctttgggtgatttaattttgaataggttccaggtgtcatctgcgtaacaaggctgaagaagtctgttttggtggaactccaagacttttgctctgggtcagagtctttgacttccatatgtatcagctttgatgcttttaaaagctgcagaagcagtccaagtatcatggtttagtagacagattttggatccagacaggcatggattcaaacatgagcttctggactaagcggtcgtgggactttgggaaaaatttaacacttagggataaatataatctatgtagaacactttcacatagtgtctggcacacaataagtggtcataaatggtagtttataaaatgagaataccactaaaactgtaaaaaaaaaattaaaaattatgtgactgcagcctgttttctggggctttaccagcaaggggtatatcctcagggaaagaataccatcagtgccactccaggtgaaaaggtggctagagtgttccctactcttaaagcaagtcactatcagagtggcaggtttttacatgaacaggttcctgaaaatgccaaatggcagtaccactccttgtaacaactgctggtttcatctagtgatggccaaggtcctaaatcctccagacctatgtatcctacaaattcctgggtcatttcttctttacagaaccagaacagactgccttgcccgctttctcctgggttaacaatgggtcttgactcggtcctgcctaggacctcaagagcagcagaacaaaaccagtaactcaaaattttctttcgctttcttggtctcacctggcctttcaaaagtccaagaaccctcaaagactaaaaggagcatttgggccagaggcaccttcagccagtgtcactagggagaccagttcaagaagatgaccaaccaatgcatggtcttagctccacccccagcacacacatgtcctccatatatgactccacagaatgcaacatacaacatatctaataaaaatcctaatacaaattattgaggaaatacagattcttttatatgtaggcattgcaaatgtgcacatttcaaaaaatcatttaaacaaatttctttagagacaaggtcttactctgtcgcctaggctagagtgaattaatgtgatcatagctcagtgcagccttgaactcctgggctcaagtgatcctcccgccttggcctcccaaagcactgggattaataggtgtgaaccaccacccccagccacatttcaaaaatattcaagtgggaaggcaaaaggcacacatcatagaatgtgacaaccataacattgtcctagtgtgtgatgctgggcctgtatgagagcgtcttttcttagttatgctagttcgtgcttaggaagcgctgtggcctgttcttgggtgtcacgtaaagggccaaggagagaacctagagttttcaaatttcttcaatctacttctgacttcattggcaatatttggcactcaccttgtataggagaaacagagttctccttttgagaatagagacccctttgggtcgcagggaatagagtttgttagatatctccaaagaacgggaaccctggtacagcttgggtgagactttttaaacaaacagaattctggctaacaccttctcttagtccctagaaatcctccattcctcttccccacatcaaactttgaggtagagctgggattggcagcagcttggctctgccatcgtgtccaaattccactatttctgtcctgaatttgcatttcctggcagacttgagccaagtcccaatgaaacagccatagcttttcaaaattacaggcaaaatcaggctgggaagaggtgaggggggcagggaggggacgggggagaacatgcacagtaattgtcacgaagggcccagtgatgtggatctggactgaggaagtcatttcacatgatctttgctcactcacttccagtttggctcttccagctcctcaatccgggcatggagccgtgctttttatagattgtaagtccattgtggagttatgtatcctggcagtttgtaaagtggtgttttctctatttttatgggtgccctaggacagtgcaggcacacacacctttcttggtaccttctcattccacgctacttgtgattaatgaagaaggactgccacctccagtcgcttcacaggatagacttggggcagcctctgacttgctgtgtgtccctggtggagccaaccctttcaagccccctgctccctgccccctgctggatattgtgggagtgaatgagggatgaggatgacagtaaaccctccctgaagggttatgtaaatctgaaaggctctgtggactttgaggctggcctagggaaacctcaacaaatcagctactccttgcttccttgctttttattagattccctataaacaagtaggacatgattgtgggggaatcagaggacatggggctccttcatgcttgaggacttttccccagcactggtgccaagtagttagggcctcttctcctgatgcagccctgattagcctgtttctccctcagacctcaaccttttgttgaggggaagaaacacttgtggtagaaggaaacataattaatggaaggatcatgtgcatggactatcatcttatcagtgatgataataggcctggttgcctagatctttccagtcagccgccatgttctgtcagcatagctttcataatgtcctcttcctgtcattaacaatgtctttgggtttctgggttttctgtcctcaaattcatcctgaacaccataactaggtcgttcatcctggagagatatcttggtactttgcctcccaatgtttaaaggctccctattgccaatgatgaagtcctaacattgtatcctgacatctgcatccctacacagtatgatctccgctcatgtttatgatcttctgtcccactcttcttccgtgggaaccagaccattgagctcttgggccttcagacacctgtctgctcacctctctgctcagagttctttgcccggactgccctgcagtaatgatttttttgccctgcaataattattgcaataataaatacaataataaatgcaaaaataataaaaataatccaaacaataattattgccctgcaataattatctctccatatcctcatctctcacagagaagccctgacagcctcagccccagggagtctctctctttctctttctctgagctccatcagcattggctagctgggaacttgtcactggtttatgttattatctaattggtttaggtgctttatagagtatctaccctaagggcaaggactgttgtccacctctttgcagggcgcactgtgcctgatatgctgggtggcccttgtccaaagtgggggtggccttccatggctgtcaggagcaccggctcaagtgtgaggatcggatcccaccacaggatccaaccacaggcgagctccttcatctctctagtccagagtttcctcatttgcaatgtgaggagtgatgactctcattttatacaaatacttgtaaggattaaattagatattctggtttctacacttggcatagtgctcagtgtatgattatcattatcatcatcattaaatcaatgtgtgttgacgaccaggaattctggtaacaggatcctgggcctttctgaggggctggacattgccttggtctgcctgtggaatccctccctggcctggcttccatacatgtgcctgtgtctcagtttcctcgtgtgcatattgggacaacaggaatacctactgcccagggttatcataagaattaaatatgacaatggctggaaaatgcctacatttaggaaagaaaggcttggtaaatgagaaaaccatggaactctgctaattgctgtgagtaaatggtcaggaattatggcctgtgtcacagcttgagctttccttgatggacctgtttcccaatccctgtgttgagtctaggtgggatggggaagaaaagcttccaagcttccttctggctctgactttataaattctgctcatatgcctccctttacccacttagtctagaccagagatgagaaagttttgggattttggagaacgatttgtattccttgcttagaaggatgagacccttcaagtggctgagttggatgggatcacctgtttgcccccaggcagctcatgagacccctgcaaacttctccagggacacagagcacccctggaaatatgtacattctctaaaccataggatccaatgcaggcagattagcacacctccttccgccctccccctccatttcatcagctttatgctgaggtggataatgtttctctaactgcctaattgggagaatttagctggaaaattgccatcgtgttcttttaaagggtgccaacagcccacggctgccagctataatgtcagtgggtaatcccggctctgccgccacggagccagggaggacccgtctttctccagactccttcccaggtggtgagagcaggcctccagccctaagaggaaagaacaccaaggaggaggacagaggtggccaagaaagcagctgcaggcacaggtctgtttccctccctcctcatggccctcccagcctgcaccactgggaattgaaatgtactgaaattgcaatgtcacaccaggacaccctggccctatggtgtactgctcagcttcatggactcccactgcagcaatcttgagtttagactgagtctgggggttgttcaagaaaagggaaatctaattgctaaggcttgttcctaagtctgcgagagacagtgtagaatagtgttgaggcgtacagacctttgagccaggctgcttgcttatgttctaatccaggctctgctactcgctgggcaagttaccacatcttctagcttcatcatctgtaaaacagaggtgataatacgagcactttcctctgttcacatatcaggaggcccaggcagatggaggctctgctatctttaacacgtggcatccgggaccttcttgccaggtaggcatctagcccacagaaaaagagaaggcataaaggattaggtagggaggtttttgtcctactctggtcacactccactctctagactgcagtcacatggtcccagcccagctaggtgggggagggtagttgagctgctgctagggatgaagagtctctgccacactcagaaaacctccctaatcgtaacagtagctgacgcttattgagtgctttctgtgtgccatgcactcacacattcacttgattgattcagttattaaaaatggcatgatgagccatgcacagtggcttatgcttgtaatcccagcactttgggaggctgagacgggcagatgacgaggccaacagattgagaccatcctggccaacatggtgaaaccccgcctctactaaaaatacaaaaattagctgggcatgatggcacatgtcagtaatcccagctacttgggaagctgaggcaggagaatcggttgaaccagggagtcagatgttgcagtgagccgtgatcgagccactgcactccaacctggagacagagcaagactccatctcaaaaaaaaaaaaaaaagaaaaagaaaaaaaaggcatgatgatatgagatatacattatatatcagtgagggtcatggtaggaacccagatggaaccctcaaaaggacagttaaagaggatcgaatggtatttgtacacccatattcatcatttgtacagccatcattaattacgtagccaaaaggtagaagcaactcaagtgtccatcagtggatggatggataaaccgaatgtaatatagacaatgagatattattcagtcatagaaaggaagaattcggacacaggcaacaacatggatagaccttgaagacattatgctgagtgaaataagctagtcacaaaaatacaaatactatatgattccgtttatgtgaggtacctagagtagaaaattcataggagcagaaagtggaataatggttgctagaggggaaggtagggaagggcaaatgaggagctgctattgaatgggtccagagtctcagtttttcaggatgagaagggttctagggacggctgatagtgatggctgcacaacaaggcgaatgtacttaacgccacagagctgtacacttgaacgccattaagatgttaaatttgatgctatgtacacttcaccacaatgaaaaataattttaaaagagggtttcaggaaggaaatttttacaaatagatgggtgataggtgctgatgagtgatggttaaacatgaggaagtagcaactgtaggaagctgcatctacccctaggcctgaggggtgcatggaaggagagttactgggacaagtcgagagcagtagccatgggagaagggccgcccaacagaagctgtggcttttgggaactaagcacttccaaaccacagcccagcagagaggatccaggagatagatacctgacttctgtcctcttgccctctgatctcctgctcatgactcccattgggtgcccctctctggaagtcagcagccaagggaagctggtgatgtagtccatgagaatcagcctccccagggctcagagaagggtagagggtgaagagcagactttgaggtccgctagaaagtatgccttgcagctaccaccatggggcaaaaatgaggtaaagtcactcgcccaagctcacactattagtgacctgggttggctttgaacctggaatgctgaccccagagcctccagatggaagaaggagaaactaaaatgttatgagggtctaccttgtgcctggcactgtgctttctcctctctgatgagtgagaaaagaatcagagaacttaattaaggaacgtacccaagatcaagcagccaagaggtggcagatccaggattttactccaaagctgctgtctctccaccaactgcatgaccttcaggctgagagcccctcactgtcagcgctgttatcaccagcatcaggagcaggcactgagcaagggccgctttgtgctgtgtcagaacaaagggagctactgtgcatagccccggtgcctctcctgcccccattgagccttcaggctggggcatctactttgtaacaagccacactaaacatggacacaaaaatactgttcgttccccatcagcagtcaccagaatactagtcctgaaagggacatttgaaaccatctttcaaactccctcatttgctctggacccaaaggacccattcatccagtgtgagtttagatccagagttccacatggactgagcccctggctgaagtctactctaaactagacatagggaagacccaagatgcagaggacacccccagatatctagtacagtatcctctccttttcatttgcatcaccgtcccctagacccagagtccgaaactgcagtacacactggtcacatcaaccttctgcctgttctagtgaataaagtcttttatttatttattatttattttttgacagagtttttgctcttgttgtccaggctgaaatgcaatggtgcagtcttggcccactgccacctccacttcctgggttcaagcaattctcctgcctcagcctcccgagtagctgggattacaggcgtttgccaccatgccctgctaatttttgtattttttgtacagatggggtttcatcatgttggccaggcttgtcttgaactcctgacctcaggtgatctgcctgcctcagcttcccaaagtgctgggattacaggtgtgagccaccacgcctagccatgagtaaagtcttaatggtgcacagacacactcatgcttacctatcttctatggctactttcatgttataactgcatggttgagtatggccccaaagccaaaaatacttatcatctgacacagcttatcatttacagaaaaagcttgctgacctgacctaagccaactgtatgagttccctaaagctgctgtaacaaagtaggtgcaatttatagtctcacagttctggaggctggaggtccatatggccaatcacagtgcctgtgacctagtgagccagggcagggaaggctccctgagaaaggatgctcaggatagagtgtgaaaggtagagaggacatgaacaggtagagacgaggtgaaaaatggcctaggcatggggcagtttacagcaaggccctgcgaggaaggatgcacgggcagtttgaaaaactgaaagtcagtaaggccgttgcagagagggcaaaggcttgtggggtagtagtaggtggtcagggcagtcagaacagactgtgcggcaccacagcccatgttacagagctcggtcttcacccactggatgtgcactggaaggtttccattaagagggtgacacaatcccatctgaactatgaaataattattctgggaagtggacagttggctgtagaataagggtttgagggtggggtgagctacgctgcaaaaatgggagacccgttaggaagctattacaatagtccaggtgagaaataacgtagcccggtgttatgcattgaattgtgtcccctaaaaagacactgaagtcctaacctccaatatctgtgaatgttacctcatttggaaatagggtctttacagatgatcaagtttagatgaggtctttcggatgggccctaatccaatatgactgtgtcagagaaggggaaatttgggcacagagacagacatgcataaatgaaaaatgatgtagggtacagagagaatgccttctacaagacaacgaacacctaaagttaccagcgctaggagagaggcctgcaacagaccctccctcacagccctcagaaggagccaaccctgccaacaccttgattttggacctccagcctccagaactgtgagactataaattgcacctactttgttacagcagctttagggaactcatacagttggcttaggtcaggtcagcaagctttttctgtaaatgataagctgtgtcagatgataagtatttttggctttggggccatactcaaccatgcagttataacatgaaagtagccacagaagataggtaagcatgagtgtgtctgtgcaccattaagactttactcatggctaggcgtggtggctcacacctgtaatcccagcactttgggaggctgaggcaggcagatcacctgaggtcaggagttcaagacaagcctggccaacatgatctatctacaagtgtaatgctccaggggtgtagtgattctgggattactatgtctccttgttattagacgctccatgaggatgaaaagaggatcttgatattcctgctgttgtttgacttcatatctcagcaactggcacacggtaagccctccaaaaccatgtgacaaaggtaggagaagggaggaaagaaaacagaaggcagccagggccccttgaagagctcagagcctcatgagtgaagtcaatatggaaacagaaagggacaacatagcatcaaaagtattatagagaaaacatagggagctttgcaggaacacacaccagagactcctaagatgagagcagagtgaaatagggagatggtagtgcctaaacttagtctcatgagagtcccttagttttgttcttccagagagagggaaaagtgtgattaaaagcctagaggctgtattcattttcaattgccctataataagttgctaccagcttagaagcttaaaacaacacacatttactatctcacatttctatgtgtcaggagtctgggcacagtgtagttggatcttctgctcagggtctctcaggactgtaaacgaggtgttggttggactgcattttcatctggaggcttgactggggaagaatcttcttccaagctcattcagttgttggcagaattcatttctttctggctgtatgactaagggtcccactttttgctggctgttggtgagaaaccatcctcatgtcctagcagtagcctgctgttccttgccaagtgagcttcatgccttacttcatcacattaacaaagagaatctctccagtcctctgagacagagtctcatgcaacctaatctaatcacaggagtgacattctatccctgttgccatataacataatgtaatcctgggagtgacctcctactgcctttgctatataacttagcctcatcaaaagagtgacatcccatccccttttccatatgctgtcagtgagaagcaagtcttaggtcttacccacactcaagtggggggcatcacaaaaagacatggacacaagttggcagaaaatcatcaagagaccccccaagggcctgtccaccacagacagaggcctgaaagagcatgtggatgaggatactgacagtcttttcttcactcagccaggattcgtagagtacccactctgtgctaggcaatgttttagtgctgagaacacagtggagaacaaggcagacagagcatccaccctcttggagcttctccattgcagagtagtgagagtgtgcaatgagggggaggtggctcttacgaaggtggcctttggacatcttccttctgaagtatggcatgtggagggacttccttctcaaagctaccccatccaccaagagcattaaaaggagtccttcaccaagccatggcttcaaccattcctcaagacctcaagggttacagatacctccagtcatctctagctgccaaagctgccatggttcacccttacaacaattgagccaatctctcctttgtgcccttcatctgcctctacctttcctccaacccagcttcttccctagcctggaggaacatctctctgaaagattcctctggactttggatccatggtagaatacatgcctgtgatccattgtgctggtggtctttggagtatgctgtgccagctctgtctatatctgccagaaatccattctcaaatgtggtgactccagcatccaaatgtcagggccaggacttgaacccaggttgcttgaccctgaagactcttctcttccactgtctcccactgtctgaaaataattggtccttgccttccatctggagaacttttgactttttgtttactctgcatgttcattgagtagctactgggtgctacttttgagtagctacattaaacctgtatcagatgccttggggcaaaaacaagcagggctcctacttttgatgaggaactatggtctggtctgctgggggaaagaggtatggattgaagcattacatgtctaaggggaagtaacagtcaaaatgagtgtgaagaatgagcagaacatcctgcttggtgataggagagcctgggaggcatctcagcccgatcatcgaggtcaagaaggcttctctgaaggagttctcaagctgcaattaaaaggaagaagaaagttagccaagcctagggcatgaggggaggcagttagaacagtagtctaggcagaggacacagcacaggccaaggcctttatgtgggagagacattggaagaactgaaagaaggcaaattgggctggagcaagagagccaggtggctgttcttactgaagctgaagtcgggcagccagacccaaacaaggagaattgaaaggctccaagccttctgcacattcccaggctccctgtgatcccagcatggccggggcctcccatttgtcattctaaaaagccccgccatgcctcctccctggggctgtcaccccttgggagaggttatcaccacgcagaaatctaaccaattggctcaccatgttcaaagcacaaagcttagaataataatttttttcaagccttcaggaatgtcaaacccacatctacttgcaatgaaagaccagtgatatacagctcttagctccagggagctatgcagaccacagctcttacgaaattaaataaagctgagaaatgcatcagggtctataaaatcaagagggacgcttgattttccaccctgtccacctccccaacaccttcacacttgggaatacaagcttgagctaggagaagtgtgagccacagggatctatgaaaaagagagagggagacagacagcctcactcatcttttctgctagcagccaggagcagggtccagccatatgggcagccatgaggaggcaaggactgtggagcctgctcagtgttaattagaagcaaaggaaggcctggctgaagtggctgcaaggacgcccagcagcgaccatttcctgcacagggcaggcggccttggattaggggctgccaggtgctgcctcctctgacacgtttggcagcatctcacctgctcctgcagcttgtccctagatgcaggtgaccttggaatgctaagcaaagctgcatttggctaaagattctacagggtactactgtctccccagctctctctcttttgcaggtttgtctgcaaaaactgaaggacttttgcttttttgaagttcaacataaggatgggtgatatttggcccactgctttgacacagggtcattttgatgtgacctagaaatgaagttagtaaattatcagtatctgttgtgatgcctagcaagatgggatgcctttgcatgctacagggagacagggaggggatgcagtatgtacagtagcatcagggatggggaagctcagaactgagacaaagattgaggaggatgtcggagatggtgaagcatcagggatgatgagggttagactcaatactggtgatttttttaaagagtgttttgcatgttgatacaattttggcactggaatgattatagcaagatggccacatcaaaatgactcactttgcattggagatactaaggaagggttcacttgacagaaatgtccattgagttccctcatctctcctcccctttcatgcctttggtacagaccctcatcacaagccactcatactatttaacagtcccagcactagtcgctctgtggtctcccctccaaactgcagccagagggatttttctcaaacacacctgtttgaaagaggacccttggcttctgcattctgatctctgaatcctgtttttgtttttcttcaactttgaagttcccgggttcaggtgcaggatgtgcaggtttgttacacaggtaaacatgtgccatggtggttttctgcacacatcaacccatcacctaggtattaagccaggcattcattagctattcttcctgatgctctcattccccctgcccccccaacaggctccagcatgtgttgtttccccccatgtgtctatgtgcagaaataccatttgacccagccatcccattactggttatatacccaaagaaatataaatcattctattataaagatacatgcacatgtatgttcactgcagcactattcacaatagcaaagacatggaatcaacctaagtgcccatcaatggtagactggatacagaaattgtggcacatatacaccgtggaatactatgcagccataaaaaatgaataagatgatgtcctttgcaggaacatggatggaacaggaagccatatcctcagcaaactaatgcaggaacagaaaaccaaacactgcatgttctcacttacaagtgagagctgaacaatgagaacagatgaatcttgatctttctacttgctcctgctctggaacatgttggtttatccagggatggcctcgggatattgtctggtgggtgtgtctaatctgcacaggcctgatgcccttgaagctgcctgctaccccaaagacaactccaaccttggtaacgcttggcgtgactttggacgagtgtgttctcaccacagtcatcatggcgtgtctgcatttctttgcctgaaaactgctttttccatgaggataaagatggggcgagaagtcgtaccttgggtatttcgttggtttaaaaggaaaaagaaaagcctcctcgatctgtgcaagcatgtacatatatgtgcattagaatcattaatagttctttggagagaggttaaatttatgtgcggtttaaccaaatgatgtgtctccaggggaaggagagggaagccgtcccccacccacattaaacagtatttgtgacgcatggaaaaaataaaagaaaccctgaacccacgagccatgagaaaacaaaggggaaatcgaaattgtggatctgccagaaacctgccgttcacagagcccacaaatcacaggcaaacaaagggaaatggaaagatttggtattaaaaacccattcttccctgaacctgtgccagcatctataaaacaattacatgtgatcgtacttgaggcttttctgagacactaattcttttcttgacatgaaaatggcgcgcatgtttctttcaaaatgccataccctggaaagaaggggaaacaattggaagggcagacccagaatgtggggcaggttagcccagctcctaaaaactgataaatctctgtggttttctttcttttctccccctgagagttttcttttgagctgctgattcttgaatggggtatgacaaccttgtctggttcccagatggttccttggttgccaggagaccagacatgggggtgagtggatccacgaagcgcccctctccaaaatacgagaaaaaatcaccaaagctcatgaccaggagaagatgataaggctggaggcttggcccaaggtggaatgaacgcctgtgctcagtttccaaggagaaagctgacctgccaatccatttgttgacccaaagttcatcaatgcattcaatggttctttgacttaagattaaataggacccctgtgtgaaattggctgttagtttttaaagccttttcattttgacaggtgaaaacctcatcagaattaccctatgcaaagatgtcaggaaaaatatacaagaggaaattggaaaatgtgattgagctgagcgtacgcttcctctgccctggagttctgcgtgggcttatttatttcttgcccctttgctcttcaggcattttccatcactgaggcctagatgtaaacatgcacaaaaggcaggtgattccacggatgctggctgcttcccggcgcggcttcatgggtgcacctcttggcaagggacccaccttcagatcaaatatgggggtatttccaaattgagctttgaggggtggagcccagagaaggagaggtaagaagaaaaataggagaattaagtgagaagcatgttgtgggccaattaatcagggctaatgcatcaggcccagtattgtttttggaactggattcgggagtaacaggatccctgacaagttgtagccagccctgggaacgagtgtctctggagttcacagacgggtctggaggaaactccagcacagagcagcaagtggcagggccactcggccctgcatcctgcccctgccacccatcaagggctcgttctttccctggccttgctgcccttcccactggtgagagacgaggtcgggagctgaagcttctgagcagggtggcgagccccagcctgagcaggcctgccctggcccgaggagtgagcacacatggggatgggtgggagggggatgccaggccatgttttcagaaagttcctgtgttgcaggctgcaagcagttccaccctggacctaggaacgtggcagacccacccacctcccggtaacagcatgcccaccctggggaaggggactttgagacagggaacttaatccctgcattttgcaaagagaaataaaatatacccagaaggagaaaagcctcagcccaagggataactgggggacctgacagccacttgctttcaaaactcaccaggcagagttgacttttcattgcaaccaggagcacagcatatcctcgtcttagtttttctcagactctgaggatcacctgggccagggcttttcaaaccctttctcagaggctgtaactccagaggctataacattgcctggaagaaggagcctgaacctccacttcaaataaaacaggcttgacttgtctattttacacaatgtgatgggtaaataaaaatcccactgcttggatccaaaagcagttttcactatttccgagctattttgtgttgaatatattatctagccattctttttgtgtgctctggtttccacctctgtaaaatgggaagaataattaagagtgcctatctcataggattcctgtggagtttaaatgggttaatgcatgtacaataccatgagtagggcgtggatgaagtaatcactcaaaaaatgtcaccatgactatttattagtattataacttttattatcatagtcaagttttagcgaagattcagtttgaggaaaaaatggggtttctgaaggttaaaacaagtttaaaatccaatgatttagaagagaggtgacttgtgatttgtatgtcagctcaactcagctacagggtgctcaggtatttcgtcagatatcattcgagtgcttctgtgaggatgtttcgggatgagattaacatttaaacctgtagactgagtaaaacatcttgctctccctaatgtaggagatttggatattccagccttgaaaatcatgtgagccaattcctaatgataaatctccccctttctctctttttctagctacacacacaaacacacacacacttgtcctctgtatccatgggttccatatccatggtttcaaccaactgcagatcaaaagtatttgggaaaaataatacgataataaaaataatacaaattttaaaatacatctaataaatatttacatagcctttacattgcattaggtattataagtaatctagagatgatttaatatatgtgagaggatgtgcagtggttatatgcaaatactataccattttatatgaagggcttcatggattttggtgtcctagggataggttctgaaaccaatcccccacaggtactgagggacaactgtatatatattcatgaatatggatatatataatccaaaaatgtctatgttctttgaaaaatcaggagatttggctgcagtggcctcaaattggctgggagtgatttcaactctccccttcaggcaggggatgtccccagttctcatccccaccccaacacacatgtttccttttagccagctccacacaggcaatggcataactttctggggactgctgggcaaattgcctgccctccagaatacaggattcattcacggagtgaatattcattggttaggtgtcagggtcaaggtgaataggacaggggtcacttcactcaaggaactcacattctgttggaaaagacaaataagtctagaactgtggcgctgaatggtcagtgctgggaaaggccaggatctctgaggttatccagtctggagtagaggggatgtttaaaaagcccactgaaaagtagagaatccttgagctgagtcttgaaggttgtacagaaagttagaccggtggagaaaaagataaaagacactctaagcagagcagaataacatgtgcaaaggccctgtggtgagggtagccagagcatattgcaaatagtacccaggcatattgtggcactcagataatgagaccagagaggggtagcgagtggcaggatcattaaggatcatttttcttgaaactgattcaagattattgagagattcttttagcaatgaaatgctcagtatatttccatttgtggaagttctttccagctttgttgtggagaatgaattgaggaggcaaggtgtaggcaaggagaccaaggagtcctggaggcagatggctgagcattcatggatctcatggagttgaagatctccattctagtagttaaagcttagattcctatcacactgttagtgggataagaatttaatctcttaacacacttcaatgtgaatgagactggggacctctcccaagagcaagtttccatggtgggaggtctagagggcactaaggcattgaaaacaaacttcagctttacccacgtcctgtcctgtgaagaggaaccattcaagggaccagtaatgaccttgggtgggatgtttgtgggctgttcttctggactaaatattgtgcagcaaaaaccaaagtgttattgcctccagatgcccacattcatggctttcttcttagaagatgacagtcaagtttcttttactccctaagaccatcaaagtggaaacactaacttcagcctcccatggcactcaggacaaaatgaaatatgctcagtattaagtcactattcctttgtcaaagcaactagaactcaaaaccagctaggcaggatgagcccaaggaggactccaatggtcaactttcacgctgactcccatgctgggctacttatttaaaaaacacagaaggacactttgagaggcagcaactagcattctcttgccagcagggtttgttgacacatgggattttcctgcatcagcttgtcatctgccagtgaccgcagagaaccctaatgagtcagcctcttaaaccctgaggtatccctggttcctttggtgaagatggagaggatggaggtgcctggaattggtcacaggatcactggaggatggaatgacccagtgtctgcttggccttcccaccaccacggacttagtatggaggctctggggcagatggttacagtaaggttacagatcatgcttttagtgcgtttgtgtccctcttgtcccaacccccaggatctgaaggaatgacttagcattattttcattggttgaagcaccaatctctcctgagcctaagtgacagcatggacccatattcctgacgcctttattctgggaaactctttacctgctttcatttacaaagcattttcttccactcttgcctttgtgctacgacaatcctgggaagtgggtatcattttccccatttgactaataggtaaacgaagcctcatctagtttgaaggacttgaccccagttcacaaatctttcatgtgactttgccaggactgatcccaactgttaagtccagggctttttgctgtcctctccttcccgtctgactcatgctgtttaccactgttttcttgggcccaaggggattccatgttcaccattcttcctaggctcttctagctttggactggatccctcattctgctggctctgctgcaggcttgaacctacctgtttgtatagaccacacactctactctgttttttcacttacccccagcattagcagtgccagagagaggcttggcagggtgatgagataagtgtacgtgaagcagaacaaggcgttccaagctaaaggccagtcatctctctgacatctgctccccaggaaagaagctgctttctggctcatggtcagtctgctttcgttcagataagcccagcaagtgggcctggacctgcctcttccagctggcagatgccctccttgccttcggggcacaccttagatgttatcttttccttgcaacattgcctgccttcttgacctaatgcagggttagatgcccgtctggtagcacttgtcacactgtgttaccatcctccccttacctgaccacctcgccagctacaccatgagcatacattgaggtcatgaccggcattctgtgtcaggatatggcatggttgggactaagatgagctgggaaggcagactgcctggatttcaaccccagcccctaatagctgtgtgactacttacaggctgaattgtcatatctgtaagatagggctaataatcatttctaatcaaaaggttatgagaataaaatggcataaagtctagaaaacagtcagcactgtgaagagcacacagtagttgctaaacatgtgttagtgattctttttgcatccccagtgtctagcacatggaagggaaggaacaggagctaggaggaaggaagtgttcattgaattaaggaatgatgaacaattgaatggatgatgaacaagtcacacaagcatgaggataagaacagcccccagagataccctgagaccatcctgccaggtttgtatgtcaaggccactgtcttgggggcttctgtgcctgcaaatcgcctatttcatgccaacacaaaccgtaacctgagaggcatattccttgctgagcagagaatttcctcaggttgttttatccctccagaaacaaggaaggggctaggtcagaagaagatgagatgacagaacactggggagaggggctggggtagggaagatgcttgctttaaatcctcaagggaatttctggaaggtcaagcagaggcggtagatgtagccaccaggcaactgggagtagcctatgagcttttgtgctgctggaagggtgcaggcatctgagatctgacctgggatctcagtgttttggcctttttctgccggcccaggtgtgtgaccctcctacccgctggaatgtggctgtgctggagatgtaatcagtagaattcctccggcttctcaaggaatgctcctttgggagagaaaagtacaaagaggttggaaaaatgtgaatcctgcttcttgcaactgaacaattgtcccattgtaatgactgtgtccggtaaaggagacgtatgatcaaatgacgtcttcatcagaaaccatctacacttaaccctcctgtcatttgacacatttgtaggtgggcacatcaatgtcatccacttcgtccacttttgctcttgtgtgtgtttgctgagctatttcatgtctactaaactgtacgggacatctgtctgtctggaattgtcagagctgtgaacactagcgtcatgcaatgtgtggaataggtggagatcccactgataaaatggagtcctctgtgcatcccagcatttgttcagattctagcttaaggctataaaaatcatctctccttaggctgtgggcttgggagccaaaaccttctgcatctactaatagcggattcacatctaggccaaaaatgtgcttatgattgtgcatagttatcggttgcatgtatactgtgtgtatacacacacgtgtgtgatttgggtgtggggtgtcctcgttaaaagggatgacgttctttttatagaaagacacttggtcatttggctccatagaaagggaagttcttcctggagtaattcgtgactgaataattaactctaaggcatgaaaccccatgtgtgagaagaagcctgctttccaaaaaaaatcaagccggggcccagggatacccattgggaaggcccaggcagcttgcctggggtcagagtttctctttgctctgggcatcctttctgacaggttttccccaaatggggaaaaagcacttgtcaagtatattttaaaaattttttaaaagaacattttgaatagcccctgcttcaggctccctgggggttccctacttatatttttaaaagctcaggccttggcaggtctcagcttttcagttggcatgaaacggactggaaaatgcacttgatcctccaacttgtgcctggggagcagggtttggacctaacaaagggcagatgagaagcagcatctgggaccttttgcagggtggtggggggctacagagcaagctccaaggcaccagtgccaacctgacagccctcctgctactgctgctgcgcctgactgcctcctccaacagccccctctggccagaaatgtctgtggctgctaagctgacatcatcgtgtaactactcttcgtagaataaacatctccctggtagtctgcctttgatagttttaacagttctccaaactgtcccaaaaaggtgaaagcatattggataaatacaattttgaaaatgcgtctacatgtcacagtgggattcttttttctctcctttctccctccttccctttcttccttcttcccttttctcttccaccttctacctttcttcctccttttttccttccttcctctcccatttcctctccccttttcctcctccccatttatctatccatcttcctttcattcttttgtgggtaaaacacaagcaaactgtaataccacatctcacacttaatggactaagtggggaagaaaagtgaggatttctaggcagagagaggagttttaagttacaacttcttggccctataggcagggaacagtgcacatttcaggtagagacagcaaatggtaatgtttcaacactaaataggttcccagcctcatgggtcctaacaaggaatcttaacccgaggttcatgggtggcactcaggagctctgttacctgaaattgcagacaaactatctatgcatattcctggggaaatggtccaccagaaccatctaaaaaccattgttgttacaacccccaggaacttaaatgttggactagctgtcttttgacctgtctgcactctacctcttctccctttaacagtaggacgacattgtaatatagtggttaaaaatgcaggcttggagtcacgctacctgggaaggaatctcagctccactcattaccagctgtgtgaccttaaatatttaatatcactgagtttcaattgactcagtgggagtatggattctactactacataggaatgttgaatggactaaatgagatcatgcccatagcgatgggctacatctcactggctcaatatatatcagtagccattggtggtgtggtgtcatgccctagatccatccctaatccataaaacatagatgtacttgttggaaggtatactctaagccaaaggacagcaaactgtgactttgggccaaattctgtccaatggctattttgtaaataaagttttattaaattacagccacactcacttatttacatatctatggctgcttttcaggcacaagggcagagtccagtagttgtgaaaagaaccttaagacttgcagagcctaaaacatttctatctggccctttgcagaaaaacatttgctaacccctgctctaaacaattagaaaacaataaatcatatataatctaccttggagacacacacaggtacacaaggagtcatagacaaggatgtttataacatcattattttactctcaaatagctggaaacaatctaaatgtcaatcacaagaagaatgctatacttacactgtggcagtgaagaagaatgcattctatctacattgagtaatgtggaaaaatttccagtagggattgttgagtgaaaaaggcaaagatgttaccatttgtgtaaaatgtgcaaaacatattgtatattttctcacagtgcatatgtaattatgcaaatgcatagaagggacgctggaaaaatatgcaatggacagataatacttgtcttgccttgagggaggaatggagcttagaggtttttgtcaatagagacttgagccctatctgcagtacttttacagaatgcattatgatcaggagaatgcattcatgtacttatgtaattaaaattgttttaaaaagtattgtttgtaaaatgtaagatacttgggcagaaggttgaagaatgggtgtaattctgctagacttctgtggtggggcaggaacgagatgtcaaggaaccacaagtgccaatcaatggtgggctggaaaggcagtgaggccgcttgacagtgaggacacagattggtatggcccattgaaggcaggagaaggtgatgcatgggagggaagtcatttttcacaatagagggccccctagggacttaaaatgttacacctaatgccacagcgagccactccagagagagatggcaggtgggaagtccatggatacttacacaaaagctggacagagccccagcctcggtctggcctgcctgagtcaggggaggaggctttactcttctcaataccctcataccttagttttaatttcttcagagtatgtcctagggaccagagaacttgttatgcttctcagggcttcctaaaactgactgggcaattggatttggattttttcattaggggtgaaaatgcctgcttctaaaatggctgccataacatgtaaaagtgccagtcagatgtggttttcggtgcaagatgactctgcattcatatttttaacattaggcaatcagttcagatggaagagaatttacatgtgcttcccgggatgatcagtagttatacaatgaataagaagaaactaaatggctagatcaggggattttgattgagacaagggtttgccttggtaggaatacttggcagaaacgggaaatagggcagggagataaagtttcaaaactaccgagattattttcaaacttcatgtctttgactagctgttaggaaagcagtcatttcgtgtcctcctcctggtccctgtggtttaaggtggtgaccgtgagtcatgagccatcctgggtcctccccaggcaggggtgggccggcaagctgtctctatgaagtgccagatagtaaatattacaggttttgcaggacatgtggtctctgtcacagccactcagctcttctgttgtgatgcaaatgcaactgtggacagtaaataaatgaatggaaatggttgtgttctaataaagctttatttacaaagcagtggcaggttagggccacagttagcaaacttctatcctaaagcaatgattcttcacaccttggtgtgtcagcactctattctgcccacaggggatctgtagtacatttggagggggcatagtgagtggataagggctgtaatttttttttgagactgagtcttgctctgttgcccctgctggagtgcagtgatgcaatctgggctcactgcaacctccatctcctgggctcaagctattctcctgcctcagcctcccaactagttaggactacaggtgtgcaccaccatgcctggctaattttttgtatttttagtagagacggggtttcactctgttggccaggctggtctcaaactcctgacctcaggtgatccacccgccttggcctcccaaagtgctgggattacaggcgtgagccaacacacctggcctgggctatagcttcgaaaaacaatttgggttggaattctggctcaaagtcattattagcaccgtgaccttggacaagtcgtttaacttcatgagcctctgtttcctcatctgtaaaacaggaatagtaatgacctcattgggatcttacaaatattaagttaaattaacaaaaagaatacagggtgcagatttactggactcaaatcctggctccaacatttattagctgtgtgatcttggaccaatttctttatatttctattttcagttccatcatctataaatgggattaacattcattcctacttcatagtgttgttaggaccatgatgtgagttcacagataggaaatgcttagaacggtaccaggaacatagtatactcttaacaaacattaggtaaggagaaaggtattacttctatttagatattacttctattcttagtactttttaagaaataatttttacttgaaataaaaattcataaggcctcttcaaggccatgcttataagatcacacttgatcatttgtattgcaattgtgatcaactgatcacacttgatcaattgtgtattattttagagagtgaggaatgaatggagcatcagcttataatccatagcctgacttatatctggcacaactaatgggggatgcaaataaattctaacaataatatattacttcttataaaaacaaagactaaaacccatgagctactctattgtaaaactctgcttcccataagttggggcaggaagggttgtaaggatctgcagagaaatctgagaacattttcaggaatgatcaactcgaccctcagcacaagccagacctgggccaatcagcttctgtctcccacccccacccccaagcccctgccccaggacctcattgggttcttttgaatattaagttaaattgatagaaagaatacagggtgtagatttactggactcaaatcctggctccagtttgcccagttataatcagttccagaattttgctggaccttttgggagaagagggttttctttaacctacaataatcactaaactggtagggtacaatcctggagaagccggaaaccaggtgatgactagaacccacctaagaatgaaaccagtaaagaagaagcaagagaggtgaattcttgataatacttacctcaccagatctggctgtacctgggtcctgttaaccctcataatttacagttataaataaattcctattgttcttaaaccagtttctgtcacttgcccttaaagaggcctaacaaatatatccaacttattgttttgtgacagaaataaaaaatattgaaaaccgttttccagaactccgccctggataaaacacagcaagctctctgcacttcctccatccacttagaaataagccgctacacactctgtatcaggtcagcataatagttctatgcccacgctagctgatgtagatggcaaattgatgtacaaaaaatgaatcaggaaggtgtcagaattgccggagatctgaagaattgggctcaggacagggatgagaagaaaggaagtgggtacaccaagaccacaaagggacaggatggagagaagggcactgccaccactggtgctggccctggatgtggacacctcactctggtacttctgccccagaaatggactgtgctgcctgccatctctgcaagaattatgcgtgctgacagacactgctttttcatcaaaagctccagattcaaaagtctcaggctagtgtgtctcattggctgagcctaggtcacacgcctgactacggaggcaacagggaaactgaggacctgaccattttggcttctggagtggagggtagactacaactcccactgagacttcggtagcaagaaataaaaatggaatgggatggaatacaatggaatggaatagaacagaacagaatagaattggtacatctccgctatggtccatatgtcctttcccagaaacactgccactcctcatggccatttactcaccatccttggtccctagcaatggccacagctcctctccttcactctgtgggtcaatatgaatctgatttgaccaaccctgcctacctctgagtcttttttttgaaacagagtttcactcttgtcacccagactggagtgcaatggcacgatctcggctcactgcaacctccacctctcgggtttaaacgattctcctgcctcagcctccgaagtaggtgggattatagctgcctgccaccacgcctggctaatttgtgtattttttagtagagatggggtgtcaccatgttggccaggctggtctcgaacttccaacctcaggtgatccgcctgcctcggcctcccaaagtgctgggattacaggcacgagccaccgcacccactctgagtcattttttctgggcctctcagtgatttctggtacatgttaccatcccaggctgtcaaccttgggcaatgtgatttccagaaggaccttggcccagcccatgccatctgtgagcagactaaatatgttcagagcactgggtgataactgattatcaggccggtccagcttcgccacgaggctttgcacacgtctgcttgcactgtggggaggagagccaggcaaggagcagccagaggaaaccacgagccccatcaagcctgccctccttgtcatttccctatggtctcccttgaaactaatctcattcctcttgacgactgcacagtgaggctgcttgcttcagtgattgtcaaggtagcttatcctttcgttaattaactactcagaaaaatgctgtacaacagtgtgctgtttagcttccagcttgttaacatgggggactccagaggaactttgacctggcccatggccatgagttgcatgagtcaagagaaaagcaggatggaagaggtgtctttttctccatggctcccccttattgtcaggaattacaggttgaatgggtgggaagaatgggaccaaccatgccgttggaaacactgcattttctgccacctaaagcaagaatgcatcccttacagggtcttgggaggtaagggctggcttatagggtaggaagatatgccgtgtagagtctgcctagatgactagaaatattagaatgtgttaacttcttcatttgggcaatatgaagaaataagagatcaaagttaagatgtgacttaaaacctaaagtcaagttaatatttatttgtcatccattatatacccgtcacaatgttgagaactagggcgctctctctccaagatctaattctgccctcaaggaggtcagcctggtaggacagataagacaatgcaataagctgcttcagcatgaaaggacaatgggcacgggacagaagccagggatgctgttttgggaatacgatggaggagcacaatacacagacttgtagcttaagataacagtcacgtattctttcgcagttctggaggccagacttctgaaatcaagatgtgaacagggctgtctttcctctggaggctctagcagagaatttgttccccgtctcctccagcttctagcagctgccagcattccttggcttgtggtggcatcacctccatccggcctctgtcttgtcttcacattgccttttcttctgtgtgtctgtctatgaagcccatccagaaaacccagcttcagtctctcttttcaagatccttaacacgtcttagtcacatcttttgtcatataaggtaatattcagagggttgagggattaagaagtgaacatttttgggaggccatcattcagcctacgaaggcccctattccagcctgaggtggggtgggaaaggcttcctggaggacaaggcctgccgatcctggccctgtttgcctcaaacccattcttcttccttcacctgctctgctctgtgactccgtggggttgttgatctctgcaggctgcagttcccaggcttgcatgtcagctggcttccatctgggccctgacaaggagagtcattcatgagagactggtggtggaggcactgggagggagaagcagagtatcattattattactattatttctcctccttctctgctctcttttcctccctcctccccttcaccctcttctttggtttgacagcctctctggaaatggctgtgtcaccttggtattttcatctcctgccagacaggcccctgggctctgtaacatcacccgttccctttatccctctagcgtacaggtgggaacagctccctgctgttgcttatctatgggatgtctcagcattctgggttgggctctcagttctcttgtcacctgcatacacaattcacctgcattaaattctttctgtaggaaatacctgaagtggttttgattctcttggtaggactctgaatgataccaagtccaagctgagattcaaggatgtagcctagggtaggaaggatcatcgtgccatgagttatagtggtcagccacacacacagcccctacctctggaaccctaggccaagtggaaaatacactaagcaacttatcactcaagttaatctatggttacaaacactggcaagtgtgtgaaggggaaatgcaatagttgtagagaagtacagtgatgggacttccagtccaggatggagggtccttagggctccctgaggaggagaagtttgctgagatctgacaggtacagagctctccagggtctgaaaggtcagtgtgactggtgaacccacagccagagtgaaggattcaccactaggggcacagagtgtaggcagagagtgcacgggatttgggtttgggaaaaggagtcaaatggtattgtttgcttggagcagaagggaatgtattctaggctaatagctacctaagacaggccttagcttgtccacaggagaacagggacagacagcacccctgctaaccctgccttggagtttgagcagccggttttcttttcaagaaatgaagtagcacgtggtgaagtagaagccatgcaagagaacctcaggctttagacactctcaggaagaggtttctagaagtttccagcacaaagagacctgtcactctccacctcccaaagaggtccttacacacagtggtggatgacaagcatgaaggatgaagcaggttctgcctctggttgggaaggggtcctacatttctttattagcacttgtgtgcagatagcggtacagggctgctgcatcagaatcctaggcacatcggtatgaaacacagattccctggccctaccactggagaatcagagtcagcacttcttttttttttttttttttttttttttttttttttttgagatggagtcttgctctgtctcccaggctggagttcagtggcatgatcttggctcactgcaacctctgcctcccaggtacgagcgattctcctgcctcagcctcccaggcaaatgggactacaggcatgcgccaccatgcctggctcatttttgtatttctagtagagacagggttttgccatgttggccaggctggtcttgaactcctggcctcaggtgatctgcccacctcagccttccagagtgctgggattacaggcatgagccaccgtgcccagccacagtcagctcttctcaagaagggcctggaatcggtattcctcaaagctccttggagatttggatacccagccaggtgcagcagccagtgctcaatctgattctcggaaagacccttgccccagctcatggttttggtgtaattatcagtctctccatactgcattcctctgaccagtcttgctcactcctggactagttgtaaatccctggctcagaaatgccgttgctatggaaagggttttatgctgtgattctctttgggtttgctattcttatgccaattgtttttgttgtcattgttattgtcgctgttgttgtggcaaaaaaaaaaaaaaaaatcgaagaaaaagaactttgacaggggagtaggaggcagtacggatctcagcattttgcaaactcctggatgatggaccctttgtaatacgtgctgtgtcttctgaaacaccgtgaaccacctggctaagatgagaccaacttaggagggaggacaggcttatttatgaacacaagccatacggccagccgacacactgcaggagatagagttgctcagtcccttccttcttgaaagcaactgtcctttgtttcctactttagagaatctggagagtaattggccaagaaaacagcggtagggaatggctaccatgcagagaattgtaagatgttggcagctaggggcacctctgccctcctgcctatttctcgaagtaaggaaagtcctggcctataggtggcccagagaaaaagggtggtaggaggataaagagaacggaggaaagtagggggatgccaagttagaactcaatatgttggtctacagagcaatttgttttcctttcactaacacttatttttgattatcaaaggcatacattcctccctgtgaaaattataaaaaatacagaaagtataaagaaaggaaaaaatcacttaggatgtcatcagtcactactggcattttggcctatttccttttaatttttgatatgcaatgttttttctttattggttgtaactgtactacaaaaacctttgctggttttctgggttttcatttaacaaaaaacatactgagatcattgtgccatattattaaaagctttttgagaatatttagatgatcatataatattccactgggtggctgcagcatgccttagctaactattcccctcatgttaggcacataggttgttcctaattgtacactgaaataaaagctccccaaatgtgcagaggccaggggtgcattcttagtcctgacctcacttttctcttgaagcaacaggagaaagcactgcctcacatccctacaaagtgagcccagctccagaaatcaacagcagacaatagagatttgcctacaaatgccctgggcctacctgggagatggcagcattaccaacctcacagcaaaatatagttgaaaatctccactagacacttctgtcctctacccctctcaccaccttctggactctgttttctcctcccctgccacagccaccccctgcaggatgcctccctagcagttagtgctttgcagaatatccgggggaagaagctaagttgttttgttgttttgttttgctttgctttgttgtgaaacacaaaatagcatgccgggagggtgcaagatgtcaagctgctaaatatttactcagttgctgtattgctgactcttattgctggctagtaagtagttgcaagatagactctagtttttggacggcactttgcatagcactaatcttcagccctttccttttatgctcagcagtttctcacttcttagcttctccaaacttgcattctcacaccatcatcctgcccaacaaagacttctcctttggatgtccccctgttagaaggcagtcaaggccaagttaattataccagtagtgctgaaatgaacatttgggcctaaacctttgtccacatttctgcttaggatagatttcccggagatgaattaagggtcaaaggtcaagggcattcttaagactcttgacccacgttaccaaactgctttcagaaagtttgcacaaattttcataatcaccagcaggagttaagaggtccagcttgactgaatccatgctaatactgacatcagtttgattttcaaaatttcatctttgctgtagtgaagtcaaggaaaaaaatactatctctgaatggttctaatgtgcatttcttttatttttagtcaagccgtatatagttcatgtgtactttttacaaatgaattttcaggccgaactgttcaaccaccaattagaaacagataaaggaatctcattggtgttatatttccagaacacatgcattaactagttagatacctgtgggctgggagtctggccaacacttgtcaaaagctttaaagagaaatcattctgagatccaaacaatggattcaccaacacactttcagaacttacaatagtggttgccagttcctgggttctgatccttgctgcttgccatcttgcaagtcatttatattttgttcatatgtaaaatggggtggttagcctatgtaaccctctacgctcttaaaaaacaaaaagaggtatttgtgccccttggccttgactgttctcacaggggccacgagagcttctgaaggacacgttggggctgtgaggaaaggccgttggctttaggggagggttgccatttctgctgaggaggctagctgtagggaaaatgagggcctctgaaaagtgatttggggagccctcatggagtaaagggtgctgctgactcttgccgctgcaggctggtgctctgtggctgagtcagatggaggtcaaagacaccaacgttggaccagctttgaaaggtggcaagatggggctgcctagcaacacccatgtcatttctgcctgtggtttgcacgagatccacccagctgtgaatatcacagaaggaattttcacgaactcatggacctttcattactccagaaatgagagcgatgacagagcgtaggcattgcatgtctctggctggtccctttaagacgacgatttgtcttgctgagctggggcaggctgtgttgggtttgggtattgacaccaaacagttctgattcacagcggtaacctccttcttatttccatttcattaattttcatcaaggcttaaacagccatgcatgtggcctggatttggggaattggggtggatctggacaattaaaagtcccttaagttttgcagtttatctctgagtagagcaagaccaaagaaaaaacccctcccacgcccctttgctgctgtgttagttgaagcgatttcagtgggattaattgactgctggaatgatttgcattttattgcccaggtctgctcactgggtcagaagatgtcataaaagcagaaaccccaggttgctgacagcctcagagacaacaggctgctccacaaagaaattggaccagccgttctcattctttataactcagcagtgtaataagccacatgtgtttccagccgacctgctctggctctgagagtcagattttgtgtttttccaggagcccaggaagcaagtaaaccccagtagaagttggagggctgaatttaagaaagaaagaaacctggagtctatagagaattggatgtggttggtaacccagtaggaattttctccaaggtgtgggtagaaatctcctccacgtgttgctgctgttaaacttgtaaaacgtttatagctgtaggttgttgttgttgatagcagggattagacactcctgctgggagacacgggtaacatgaatgggtgaggttggtcaggtggtgagtggagggaactgggctcccctggcccatgggagcctttgtgtggattaggaaaaggggccccttcctcccagtggaagccaacttggcccagctttgatttgcgcccctctgggccccctcagcaggtacaacctatccaacagcatgcaatggccctggcccctgaaagaggggaactctgctctgctcaggaccaagtttgtcacccaggggtatggacccagtgttgctgcagcttctggtttttggttttgtttttcaaaagaaactgaacatttgatttcatgtgtgtaaaatatcccaattttgaggctgggcacggtggcacacgcctgtaatcccagcactttgggaggccgaggcagatggatcacctgaggtcaggagtttccaaccagcctaacatggtgaaaccccgtctctactaaataccagaaacaaaaaaaaaaaaaaaaaaaaaaaatctgggcatggtggcgcatgcctgtaatccaagctacttgggaggttgagacaggagaatcacttgtacctgggagtcagaggttgcagtgagctgagatcacgatcgcgccattgcatcccagactgggcaacaagagcgaaactgtctcaaaaaaaaaaaaaagaaaagaaaaagaaacatccctatttccctattttggaatgtaagccatggcttcaatcttttttttctcttaaatactgttggagtcaaccaacagaggtgtgtgtgagggagcctaggctagaaggctgcagactctggtactgtattgtctaggagtctctaatatcccgctctcggccaaactgaaacaagagttgaggattccagaaatcttttgattcttacactcaaacaagcacacttttggaaaagaacaaatgctaagcatgatcctggtcactggtaaggtggagactgccctccaagcgaagggagtaacaggcagagaaagtgaggtacagggcttgtgagagagcaggtttactaagaaaggcaagcagagctaaccacgagggacaatttgctccaggtgggtattctaagtaggccctagtgagcgcttcctctttaattgccagacaaacaggaagagttccaggtcaccccctggggtgctgagaattgggaagaggaaggagcaatcctagagggtgctggcatgccagctccttggtggacagctgtgagccgtgctgtgtgctgcccagaggcctgtgatggctgactgcagccctgaccgtgtttggtcttccccgctgagcccagattgagtgcatatagatggctaattaaactctgaactgacaaacacacatgctggagaggctcccctttgaagagcaggagatcacagggacaatttcctgtttgccaatgtgcaacctcaatctcatcagtttgggactgtaagtttaaggcgtgctgatagccctcaacaccattcacctgttgcaagaagtgctaagcctggattggtgttgatctcttctgcccccaccccctaacgccccatttcactttcaggtgtgtgtgctttgaagtgggaggagagatgttagaccagtaaagctttaaggtctcagttaacctagagtctttttgtatgactctcttgagggaataagtagatatccttctgcccatgtgtgtatattcgcacatgtatccagatttccaaatgtatttgacaggtaaatgcaaatacctgtcagtgcaaatacaaatagagtcaacaatgaaattagtttggtttgagacctttgtgtgatccattccgcttctgagtgaccagttagttccgaaactgtgttgagtaatgatgtttcttctcaccagcaactaagaccaaattcttattttgaataacatatgttacatatggtagagatttaataaagatcagtgtttcagattctgtgatcactttatttgctttggagctctaagaaagatgcataagttcaaattgtggatttgccctgtattgaactgctgagaagacatttgtcaatgtgtgagtggtgttattgaggcagagaaggagcagagataaatttagccgaaaggggtatgaagttgcatacagttgctgatgtaaggtaccaatcatgtaaggtcgaaagataaacaatggctcttacaaaagagaagtattaaacaacatcacatcttcatctactatttttctactcttcatggttgccaggatgtgctgaaccaattaaatggcaagttgtgataactcttaatcttttggttctgatgcggtcattcctacaattctaccacaggattcaggtaggtaggtagagaaagagagagacacacacacacatagagacaggtacttttcaaaatccaggcattggggtgggaagaataggaatcagagagtaaatagacaaacatccaacccttgaggagtttacaatttagttggtggaggtggctttgtgtgttattttttaaagaagctatctcattactcttctgaaagtaagtaaggcatattttaaaaaattactccaacataatcgtaactgggcctttggccagcaacttaaacaggaaactctgtaggttaaaaaacacaatcaaagcataatatatgagccgtgtgtcttcaatgtctgtgagttgcattggtgggaaaatagaaaaagttgaaggctttagacttggcatagaaagcaggggtttgtttggcgtggcttccacatggcttctactcgaggattgtattgctggcatgtctacggcctgtggagtccctgctaaggacacttactgcatgtccctacacctctccgagttgttttccttatctgcagaatgtgctaataataaggatctcagaattgtttgtgttaaatgggataacgaataggcacaatgtcgctaaatgttatgctgtgggggggtctggagtcaggctgacctggtttcaaatgctggctcagcaacaacccagctgtgtgggcccgggcaaatcacttagcccctctgtgctttggtcttctcaaatgaagaactgggctgctaataccgtctcagtgttgctgtgaagagtaagtgagacggtgtatgtaagagcaaagcacagggtctggcctgggataaattttttaaatacattcgggggttattccctgctttgaatataatttgctctgtccaacctcctactgccattgtgaattgctgccgggactcatgccttcctctagctgtctgcttaagaggaccatgtgctgctcaatggaagatcttctggaggcttctgggaccttctcagagcaagccctgcagcctagcatccccttctcctcgggggccctgagggaagaagactctaaaacatccggttgctccaaaacatgccataaaaaccccaggaggaaagggccccattagcacctgcacatttggggacccttgtcagcaaaatggccaggagtttcctgctgaaaccccagggcatggcaggtttacggagacccttcattaagatgaattatgaacctgtgggtctctctggttccatttggcccaggctgggaggcagaggcccagctgccccgctggctgcactgcatgaaacctccttcctctcctcttcccaggctccttcccaccctgctgtgtaccccctacccttgtttaatgaaagagaaaagcactgcacccctccagggggccccagagcgggaggcagagttcaacctgagaaaattgttttcttgtaagtggcaggcacctggtgggccaggcctgacccaggcctttcgtgattgtgcagagttggctcctgtccttccctgttcccccaggccataaacaagtcctggagctggagcggggagccctggggaaggggggcgggggcagccacagtgctctctgtgcatttgttcctatctcatgtgacagctcaggggttatcctgttggcttctccagggtacctggttttttacatttttttttcttttttctttaaaaccatgaaatatgatcaatggttgttcagagaagccaagcacaaatgctctccagagcagtggttcttagggtcaacatgcttttaaattgcctgggtatccaggcatagcaggaaaagcactacagtgcagaaaggcagccagctgaggacgtaactgcagcatgcaggatagaagttaaacagtcagtcaggtcagccccggccacagagttggctgtatggtagagtggctgatggtttggggaagaggccaggtttgcaaaaaaaacagcttcctcagaggtgttaaggaggagacccatatttactaggcatctaccacgtgctttatagctctcacctcggaggccctagaacacagctggtgccggcaggctctggaaccagactccctgggatcaaatcccctgctcacaggatgtgggcaagtcaaatcatgtctcccagccgcagactccttgccttggccgtggaggagatcatagtacccacctccccagattaccttactgtgggttaaatgagatctatgcaaaagtccctagcacagtgcttggcacataaaggctcaatacctgctaaatgctattatttttattatcaccgacaaacacgctctccttagccaaacttgagtcaggctcctctgaggcctctttttgactaggccctgactttgggccctgactttggcctagttagtccagttttagcaagaagcctgttgagtgggtctggctagtatccccctagccttgatgtttcctcctagtaattttccttccaccagactcctacctgctccttagctatacatgtccacttgtccttatattggagttgagcccatctctctcccctatgcaaacccccgttgcagtagccccccttaaataaagtctttcttaccaattttaacaagtgtcgtgcataatctcctcctcttcttccttctccctcttctctctcttccctttgccattcctcttcctcctcttcttcttcactcttccctttgctcttcctcctcctccacctttcctcctccctccctcctcctcctccctccctcctcctcctccctcctcctcttccccttccctcttcctccctcctcctcctcttccccttccctcttcttccctcttcctcctcttctctcctcctcttccctcctcctcctcctcttccctcctcctcctcttccctcctcctcctcttccctcctcctcctcttccctcctcctcctcttccctcctcctcctcttccctcctcctcttctctcctccttcctcctcctcctccctcctcctcctccccttctctcctcctccttcctcctcctccttcttcctccttcttcctcctcctccttcctcctccctctcctccttcctcctcctccctccccccctcctcccccaccctttctccatcttccacctcaaagtttgggatcccatccctgaccctggtctcttagcctggacagtgggagttttcgtttcagctgatgaacttgacattttctctgcctggagaccaaggatgagaaggagaacttctttgtttagctagaactataagatctgaaaacaaaagagagctgaaagcaggcaggtgtggaacaacagcctcatccctttgattctgtgggttacacaccacctggacaaaccctggcctgaaaacttggggctccttaaagcattttttctcccagatagaaaaggaaagaattcatcagtgattcattgccttgagatacggcaggatgagtagccaaggatctgcttttctgtctctgtcactgtctctgtctcgccttctcttctttcttgtttagggagctaaaggcagagactgaattttaggaagcaatttttttttccaatctcctccagaattctgtgccatgagaaagcttaaaatccagtgtgataaaggattttgagtttgaactatggcatttaaaaaactaattaattcctccaagtcttagtttatttctttttgaaaacaaataataggaatatttcctagactacagctccttgaggacaggaattgggtttgttttccttatttcacttggcgtgtctggtatgatatctgccacaccatcagtgttcaataaatattggaatgaatacatatcacctaccacactgagtagctgaaattatgtattgagatattgtgtgcaaaagctcctagcacagttattttcattagtgctcattttttctgattttagacatatttcttagaaggatgaagatgaagggtaaagaaaggaaggtgataggagggagaagctggagagtaacaaggaaaacaaggaaatgagtgaagttggtgaagtaggaagggtgctgggtttgcgggagactggccttttattccccaccgggtctgtgatttctgcttggtcatttgactactctgaacctcaggttcctcttcagtaagatgggaatacaaatcttcactttatcggtggtgggtatccaaggagaaatatatttgtgaaggcagcccccagagttcctgacatgccttaggtacaaaacgacatgaaacctgaaggtggagaggaaaccagaaacagagcgtagaaaggagaataggaagccagggaatcttttggctggtttgcgttggacttgggcctggggagacattgcatttggacataagccccttatcgatgaaccctgtatttgtaacctgatgtgttgaaattgaagcagtgggtggttgaggtcaggagtgggtaggcacagcatgtgatccctgtgggtgaagcaaaatgaacacaaggccccagatcatgcccctagaaagtaaagcaaggtttcctaggattctccaatgcacagactcaagctgaatcttgatcctgtatgggttggagattgtggttgtcaatgaacttggcaaggcaggcaacaaactggctgtgtgtagagacacagccttaaaaaaggaaacttaaaaagtgttgctattttttaaaataatatttttttacaatgacactttttttttttttttttagtaattgaagaagttgtggacatttattctggaaattttggaaaatgtagaaaacacatataagcccatcaagtgataacccatctctccgtgacattttgatatacattgacccttgaacaacacaggggtttggggtggtgaccccccacacagtcaaaaatctctgtttaacttttgactccccgaaaacttagctactaatagcctaatgttgatcagaagccttactgataacataaacagttaatgaacagatattttatatgtattactgttttttgttttttgttttttgtttttttgagacggggtctcactctgtcacccaggctggagtgcagtggtgtgatctcggctcactgcaacctccgccctctgagttcaagtgattctcctgcctcagcttcccaagtagctgggattacaggcaccagccactgcaccaggctaattttttgtattttttcagtagagacgggttttcaccatcttggccaggctggtcttgaactcctgaccttgtgatccgcccgcctcagcctcccaaagtgctgggattacaggtgtgagccaccgcgcccggcctacatactgtattcttacaataaactagagaaaagaaaattattaggaaaaacacaaggaagagaaaatatacttacaattcattaaatggaaatggatcaccataaaggtcttcatccttgtcctcctcacatggagtaggctagagaggaggaagaagaggagagtttgttcttgctgtctcagggggacagaagcagaagaaaatccacatacaagtgatcccaggtagttcaaacctgtgttgttcaagggtcaactgtttatccctctagggtgtgtgtgtgtgtatgtgtgtgtgtgcgtgtgtgtatgagagagagggatttttgtgtgtgtgagagttgtataaaattggggcatatttttattatatcctaagtacttagttgtcccaagtctcatcaactgagtagcacttgattgactgtcaagtcctgtactcgatgaattgaactagattctatttctgcttagctcaagtctttaaatttaaaaagaatattcttgggaaaggttatattcacccacatcctacaaccagttctagagttttcaaggactagaatttccaaaaactgagttataaaatgttccctgtctctctcaggctctcaagacaaatttcttccaccctctctctcctcttaaagtaagtatgagatcagaaaaaaaagaaatccattttgacaatttctttcctgttctataaaaagaagttttagcaagctagagagagagaggtagggagaagggggaaaggagagagaaatgagggtagagacaaggcaaagatagtggaagaaaggaggcagggagatggagagggaagctctagtgctgcttttcttgctgtgaaacttggggaagtcactcattttactaatatttactgaatgcccattacatagcagccctgggttataatcacagcctcctgaacaatctctagtgctaatatatggtctctctgatctcttttaagtctgaaaaggccctcaattccttggcttttgaatagcactctttatgaactactggggaaaagtcaatgcatcttccttcctgtgatcccccagcaactcactttggccagtgccagaccaaggacaggagtcaccaccaggcccatcttctccagaatgaaacccccctgagggtcctgcccttggtgggccaccttcactctcatacagagaacagaggggctcagcttgttaaggaaacttcccttaacacctctcaccacattgcagattctcaaagagactgggaattgagcttatcacccctccccaagatgtagattctgtcccccaactcttctggcaggtattggctttatttaagcctgcagagacaaactaggttggtaggtaagtagatagacagacagacaaactatgtagatagatagacagaaggtctgcctttactagcatggctggagaaagtactagatgaaatccgaaagagaagcacagaagagccagatcatgtaggattttgcatgaaaggcaatgggaattctctgaagagtgtgctgtggttcatcattttcttttctccattgttctatctgcatataagaagccaagtctctcttttgcttccacctagaatgttgctgggcttgaaccaggctcaggcaacccatcacaaatttccttgaagaaagctcttatacagcccactccagcatagctaaaatttaggtaaacactttcctcactctgagttttagaagcaagtgtttcttaacaaaatgccttcaacttcacgatattttcgaatacagcttttattccaggatttagagacacagacaccacagcaccaaaacacaccagcagagaaagctccaggtcctcactcagtcctgatgcagacactttatttccctacgtatgtactttattgttgttgcttcaggaaaaatacatgcaaaaatcctggcatcaacagatcccctctttcctccccttcttaccctagtcacgattacttagactttcttgtagaataagaaaagatgactaaaatgtcaaaccccaccatcatcccaaaatgtctggtccaaaattagaacaaggagaagacaatcaatcactcccaggttacgaatcatgacccagccataagcagagtctctcggtgatgtattatgtttatatctgactctccttcttgacagttggccttctgtgatcagtttcctgcattgtaaaactactccagatgtgagaacagctcaatagcagagctctcagcctaattaattcaatcacaggatggtgattaagaggtcagcggtgacatttccagagtgcaccttctgtcttcccagcagttagcttgtcctaaggctccaaagccctcaggtggctctggagccacaggagcccttgggggccttgtcccaccctcaggtcttgcttcagctgtttgcaacaaggctgaccaagaaacaaggccacggccacagtttggtcctgctgggaagtgtaaatgtttccccgtaaaaatgttcaccctagatccaaacacaaaggagccagagttatgagtccctggtatgctgactttaattttgaaatccatacttaagtctgcatcttaggaggcagcagaaggaaaaggtgaaacttgagaccttcagaaaggtactcacctctccgagcttttactccctcaactgtaaaattgggtttctgatggttacttcataggatgtgttttaggaatacatgagttattaattgaaaaacttttgggacagtgcatagaaggtagaaacactccataatgctagctatcatcatcattattattactactactgttattattaatgtcatttatacctgagttgtatcactcaggatacacactcaagccacagaatctgacttagctgatttaagcagaaaaggaatgcgttaaaaatgatattgggtgacctacagaatttctctgagagctggaaaatgagacctggagaccacccagctagcaacaatacccaaaatacagtggagacttgccctgtgagggtaacactgttgcccctacccagctccagagattatagggtacatgttagacatcatccacctggggctctgaaaactactgctccctccatccaccactgccccagaacttaatcttgttcaaccagctgctgtctctagaaaggatttttccaaatccccacttctttgaggaattcactccttattcccttgcggtactattctgtctgattgataaaatatcaatggtgtgtccctccccttactgcaagagagtctgggaaagcacacatctgtctgtattgtccagctgcattgcactaaaggaattcctgaggttaggaaataaaagaggtttatttttgtgcacagttctgcaggctgtacaggaagtgtggtgcaagcatctgcttttggtgagggcctcagggagtttacaatcattgcagaaggtgaagggggagccttcacatcacatggcaagagaagaagcaaggttgtggggaggtgccaggctcttttaaaccgccagctctcaggtaaactcagggcaagaactcacccattaccatgggaatagcaccaagacattcatgagggatcaacctccatgacccaaacgcctcccactaggccccacctccaacattggagatcacattcaacatgagatttggaggggacaaacatccaaatcacatcactgacattgtctgattctactgtagaagacgactttgcctcccaccaagacccagagaatggagaattccccaaatgttggaagaaggaggtgcagtaccaaagatgagaacgaatgacagaggaggctgttgatgaggatgagggcttgtgtaagattgaaccttgtgcagcatggtgtgattattgtatatccaaggcccaactgaccaactggaccaccaggtgttcatcctgcggggctaaggattgtcctcttactcttttaatgtgctaatgcctctggaagtacatgagaattaggatattaaggtctctcccctcccttgttacatggagaaaccaagtaacaggaaggcactgggaaaagagaggtggcggtgtatgaaaaggagccttcaaagaaaagcatcacaagggacctgaaggatctggcctgaaggattcacgatttgcactctccctgcgttgtgtgagcacttaccaataaatattaaatgaatgtgctgtaattattggatgagtctctggccacctgaagctacccacatatttgaggtaggctgggatctgctgtggaggctgctggtatttcagcaagtggcgggcaacctttacagcaacagttgggtctcctgcagagtcaaatgctgctttgcaagaaggaaggtgttggagactgagagtgactaaaggtggcaggaagagctcccagatgctcagaccaggatttggcataaggctgcccaaaggattactctggccagtgcctccagccgtgcagaagatctggtatggcttctgtcttccgtggctgggcccctactgttctatgctgaccctgcccagctgaagtctagaaacatccctaacctcctccatgggtggctatgtcaaaatgatgataaaatgtgttcaggcaggctagatccagtacttgcatggtggctctgtttgatccacctgagactcttcagccttgaataagtcacatcttcatttgtactaacccttcctcacagtccctttggagctggagagacctggaatgaataatgtgagagttgcctttgtgcagagtcatccatgcctgaagtcatttgctcctctccacccattggggaaggactagcagatatttatttgcctcatttgacagatgaggcatctagggttcagaaagcttatgtgacttctctaaggtcacaaagtagtacattgaagataaatctcaagtctcctgtctcccagtctgatgccagtgcattttcaagtttttcaagcttatcattattctctgctgctccctggaacactcttacatgcatggacactaccaccatcaccaccatacccccatacctccatcactgcaggaagacccctctatttgatgcaatacttgcatgtggggaccatcttcctctccccctaactggttttggaatctggatgtggtcattctcatacataaaggatgctttggctatttggggatcaaagctgagctattgttctagttccaactcaagccaacttacatccaagcaacatcaaagggagcttttgttaccttctactgtctctctgtgacgttccaagagtcttgaacctatcctttctccccttcttcctctaaccaaaatgacccaatccctctgccctgcccactcatcccaccctcctaaccactcgcacaaggaattgataaggcaagagtggctatttcctgaacaagaggccaagcagtcattgtggtaactcaagaacacaaggtctatgtggtggaaagggaccgccaggcagtttccattgcaaccacgacttggattctacacttgcacacagtaaagattccatgtcaaaggactgccacaaaaactcccctgaagtggaggctggcattgctgggaggaaatatggagcacagcttcattagaggggctgaaaccaggaaagaaacttccagagtgagaaaaagctctcataatacatttttccactatagtcatttatcgctctgggtgccctccaccacagtaatcagtgttttatgaactacctttccctcaaacgctctttctcctctttattttgcccaaaataagagtttaattaaactctagatttctcctgctgctacttcttagagaaatatagttgaaggcactaggctgtggagaaatgattttattggttgcttctgtttataaagaagaagaaaaacaagcatagtccctggttttgtgttcattacatgagccccattcagggactgaagccaacatggcactttctgggggattaagtgtaaaaaggtgttttgatcgtgataaccccacttatcaaaaactaaccacaaatcacagcctgtaacaagcacagtctcaagactcagggcatatagcctcttaattatgttacctgtgaagtaagttctcttacattttacagatgggaaaactgaggcaggtttgagtacctgcccaaggtcccacagctaggaggtggggaagccaggattcaaagtcagtattctgtctccaaggaccaagtagctaacctctatggatgcttccttttaaggttaaaggttgatgacggttaaagtggctcagcaacatgtgattctaaatgtttttttaaggttaatttggaagttagggcttcaggcttttgttttttgtttttgttttttgtttcttttttttttttttttttgaggaaaatgtagagagcaagtctaggcaaatgttggtagacagcactatggaattcaacacccatagatttgggaactcaagtggtgaatctggcctttgcatctttaaataccttggaaggtcagattagcacagaaaccctgatgctgaaccgaacacttggtcctcccagttggcaaacattagctggttgaaatacttcctgatggaaataccgataacacgctgacaaaagttcaaacttgtttctaaaggtcatctcgactggcagagtaattagttcaagtttgccttttgcttttccctggtgagagttttagctgaaacctcagattttagccctctttgcaacatacagtcagtgacaagagacagcctgagattctacccaatacagagtgtgtggtcatcaaaaagtttctcttcatctgggccagaactggagttagacatttacactggaacttaatgatagcagcagcctctccagaggaaatctccacccagtccattacttggattccccaggatgccccttcaatcccagaaacatccagttacttcaaggacacatcactcgaacatactgcaaaccccacaataccacctgttgaagtcccctgagtccccctttctctgtattgcctgtcacctttcagccagctccctaggattctgctcaaccttcccttttacccaaaatctaatcagaccaatcctaccttccaaatatcacttttcatttccttttctcttcccactgctgtcaccttgtgcatgggctattacagctgtcctatctgcatcccaccatcctctgcactgcacgtggagtaacctttctgaaacctccattggagcttgacttgactccacttaacatctgaagatctttccgagggttccccactacccagactctcatcattgcatgtgttcctctgtggtctggtctggtgcctgcctgcttctctgttctcatggtgtacacactcaccacactccatttgcttcatattcactctgtctgtctgtctgtctgtccacctccctacctcccctctctccctcccctacttcctctcctcataccaaacctcttggtgatccccagtgggtcatgatgtataaacatttgcacataatattgcctctacctgtcataaccttgtgataaccttaccgcacatagagtgtgctaagtgtccagtgctcccagagacccctgggcatgcctctaggggaccactcctataggtctgagttccctcggcacccagggtagggccctctctctctagtgaattgcagagggcctgcacatgggaagtgctcacagcctgcctgcctccctgcctgtggaacaaatgggattgaactctgaccctaaaaggactgtgacggtgatctcctgggacatgcattctagggccctccaaggcagttcctcttcctcatatttcacctgtcgtgtgcatgtcactcctctctcgactgtgaaatgggagcacctggaaggtggtacccagcagcaatggacggtctctggagtcagactggcactccagacccctctcaggcactgaggagttgtgtgcccccttaatatgtgccaaactcactttcctcaactgtaaattgggggtggtcattgttatcacctctaaggattgttgcaaggattaactgagataatttgcataaagcacatagtctacatctttgctcttcaataaagggcagccattgctttgttatttcctagctgtaccttctacttgattgtggtagggttcatgcctatccacttatttattctatgtgttgtaaagacctaaaagaaacacccaataaatatattaattgaaatttaattgccactaagtcaccactactttagaaggtaaacttttcctatgggatcataataaaaggattctgcattttttttttgaggcttttaaaatgtggatatttaagagggtttttcccgtaatgagtatgataaaggcactgtggcagagcttctccagctgggtgggttgtgttgtgtgtgcttagtgcatgcttgagcccagagatgtcacaagaagccatcctgaaacttgctgggggttggcctacatgcattgttgggaacattgtccttttcaggattcactgaagaattttctgtcaaccctgagttgccagaaaggattatatttctataaaatgagtgctatgtttggaaattttctctctttgctttggccactaggaagctgagtataatatgcagcccatcttaaacgaaaccctctggtgatcaacatggtgttctgacttggccccaggcttcgtcttagtgatctacattattctcctatacttagtctctttacctcagcacctagctcgatacctggctaacgggtgaaaaattcttaaccagtctatttcccaaagtctatttaccaacagactgctcttcatacatttttctatacttgtttcatatattttttggaaaatggcgagatataagtgaagaaatgttatattaacatttttttctttctcttcctctcttttttcttccctcatctgtcttcttaaaacatagtgagagttcccttacagcagatttattgtacttttacaactgagaggggaatagtgcttatcagcttgactggtggaaaatttccaagctgcacagttcactagtttatattacctaatagagagataaataagccatgattcttcttaaggactggcttttaattagatttttaatggatcctctttgactttcccaagcataagtactgctgtattagttcattattgtgattaaaagcagctaataattatcataactaaataattttcctcaagtgtgccagcccagtttgatgccctgagcgttagcagccgctggcctaagcctgtctctttttctttgctgtgcatagcagagcagctattttgagttggaggctgggaagcctgcagacataggaaggcacaagggacagaaagtgccagctgtcagagcctgtgtcttgatgctctgtgtggtgctgcttgaaacaccctccatttcactcctctgatgtctcaaattttaacccaactggaatatctccccaagtatctttaggtcactagtcacggcataagtcaggatgcccaagtagcaggaggtttatgagctgcaaaaggctcattcagaggctccgcaacatcagcattggactgagaatcaaacttgcagcatccacttctcagcctcccagccttttgccgtggaggcacagagatggatggattgtcccaggaaccacactgcctatgtggggtaattattcttcattcttttttgttgttgttttatttttttttgaggtggagtctcgctgagatggccaggctgaagtgcaatggtgtgatctctgctcactgcaacttctgcttcccaggttcaagcaattctcctgcctcagcctcctgagtagctgggactacagttgtgtgccaccatgcctaatttttgtatttttagtagagacagggttttaacatgttagccaggctggtcccaaactcctgacctcaggtgatccacccacctcagcctcccaaagtgctgggattacaaacatgagccactgtacccggccaattcgtccgtcattctttacctttttaagaatataagaataaacaaagatgtcatggtggaaatttttgaaaatgactaacaggaagcgaataataatcacaattagttttattaccaatattgtgtgtttgttcttcttgtctttaggcatgtatgtcttgtcttttttttttttttttttttcaggaaagggatcatggtgttgccttagcaatatatcatgaatgtttttccatgtcattaaattgtcttccacaaaatcatttcttaagttcagccaagtaggtcattatataaatgtaccataacttattaatctctgccttttgttggacaattcagatgattttaagacttgtattatattgtaagcaacatttcaattaatatcctttttaaaaaaatatttgagtataccatgatgatttccttgggcgaaaactttacatgccggtcaaagggagtggagaatgttaatgcttttgctatatagtaccaaattgccttctagaaaaatggagcaaagtaaacttccactagcagggtatgaggattgattacttcttcatatgttgtccaacactgggaattatcattgttatcattaattattttcctaggtttcaaggcacagggaatggtggttgatttaatttgcactttttttggtcttgtaagttgagcgttttttcatgcatatgttggccatttgaatttcttattttgcagattgcctcctcttgttctttgcccattttgggctgtgatgttaattttggtgtgattatcttttgaaggattcagatggtcctactttaccaaaaataattttccccacttactgtctgtattacctcatactaaaggggaagataggattgaccctgggcttgggactggagaaatgtaatggtagcactgcaatggtaccactgcagtcagaatataatttaacaaattccagactgctcaaaaatagtttttacattttagtgccagctatggttgtatttgcattattttagttagactgtgtttgagtcctggatttgccatttactagctttgtgagcttgggccaggttaccgcacctctctgaggctcagtttcttcatctgtcaactggaatgacacctgccttgcacactttttgctagtaacaaatgtgatgaagttcatgaaacatagtacctggcacaaggatggcagccattaagagatatttaagagactatatgtatgatacctaattttctactcaaacgtgttactttaaagtagccttgatggaatcataaaggtctccctcaccctctgttcctccctctttgctgaagggacagagaagcaggggtgcatgctatgttgggaagaagccttccagctcctatggaatgggctatccgggaggatttgcagagatcttgccctcgttgccccacagtggcatgggaatagcagtgctcccaggacccaaggatgcctttgggagggtgacagggccttcacattccttagcaatgagcaggatgtctgatgtgacgaagacaaaggtcaagtttaaaagaggactgtcttgatggccaggctcctcccattcattccccagagagacaagtatagaacttctggggacaccaggacgtgggctcaactctacaaacacttcagaggggccgcccaagtggaggggaatggatttacaaggactttgacatggaccttgggctctgctctgtgtgatggcttccatattaaccatttggcatcaaatggggaatatttcttctatcattcttttttttattctagcaggctgtgtgatacactagacggtagctgccaccaaggtgaatactgaatgttcatcagacagttggagggcagcagtgactgcgtttgaagcaggtttgaaaagggcactggtcttactttatatgcacatctaagattctctaaggaatcctctgagcattttaggtggtatctgcaggtttcgctttgcacctttccactaatatgacatatgactgtttaaccatatgaacttgtctcctctgtgcttctggttcttcaaggaccatactaataatttccataccttcctcaaaggcaaagttttgaggataaaattaaatagtgggaatgaaaggtcagaactctttgtgtcaaggcaagcaattaggctgggttctagtttcgaaactgccagggaaaagtcctctgaagctcttatttccgtttcattaaaatgaggaggtcgggctggaaaatctctttggtccctcataggtgtaacgttctgggagtctatatgaaatattcaaaaggattcatcaacagcaaatccctagaacatagtgctcctagaattgaatcaatattgaaggaaatccagtgtctcgggacagaagatgcacagagaagagccggactgacctttcttgtagctgcagtcacaagagacttatggcacgggaagccgtaacactcatcatacagccagttattgcatgtgaagtgtgtgaaatttggcagcagaagaacctgggttcaaattttggctctgttagtttccagctatgtaacctaaaacaagtcattttacatccctggcctcagtttccatctctgtgaggaaaaaagaaaaaggacaatactcatgctgggtcttgtgagtggcaaataagatcatatctaaaaatactggcatattatagggcctcacacatagtgggcattcaccaatgtgaccgccattgcttttattggactaaatcagagaagacaagtttccatttcaaccacccaaagaattaagaggcagtggctcggagccaagaatacttcaagcaggcaaagaatgtttgttctgtcccttgcctcccctcccgacttcagttagagtcctttcaggaagtcagaggtgggtcacagggttttaataattccagaaagagcatctgtttatctgtttaaaggagagcaacagaatccaattttctggcaccaagcagaatggaaaggtgttcatttgtaatgggctggtttcaggccttaagcccttcccttttgaaaataatttaccctgctaattacatcatattaaccaactactcccggtatagattaaaggactgctttttcaaatcattctataaattaaaagcagtcctcccagatacatgatttcatgcataaatacggcatttgtgttgtcagaatttatgttgagaggaaatggaggaaatgtatccttaaggaaatattttgcagtagttgttaacaccttccactccttctgctcagtgcttctcgtaccataatataaatgtgcaagctgttagcgcgagatgaacattccggagcttcaggggccacctgcctgtgtggctgacttgttatttaaattccctttgcatttcacagatttaaatactgccagggtcctgatttatggtgtccgcatcacacacataaaactttcactaggatctccctgtttctcactcacgcacacgggaggaagtcaattgtggccacaggtggaatagattgtggagcaagtaatccccagcagggtgtaaagaccagaggggtgtgcccccgaggcgggtcagaaagcagcagggcttgggagcctcagttccaggaaatctgtccctacccttcctgtcagccacaagagaatcgagggaatgtgggaaggattgaaggggtagagacatttaagagaaggaatgctgaatgggatcatctggtcctggtaggaaggaaacttccagcccctccttccagcgctgggtctcatggctatcaaggggcaagcctgtaagaagcaatcaaagcaaataactgacgaattcaggactgaccctgaaagtctgccctgaatcatgcactgaccctcatgcagccggcattaaggccagtcatggtcctctgtgcagggctggcacgggggctcaattggcacttatgattacaaacttcgtccctctaggtatttacagctgacaatgtgctaatttatccaagcttcgtggttaagcttggcagaccagcaaatgcacccaaatgcaccaacaggtacatttcgaaaacagttcaaacaagaacagtttatattacaaaatgtgagaaacatcttagaaaaggcttgattttgaacaggtttatacacacttgcacacacagcctcttgctggtgctgttcaccttcctggacattcctgtcattcttggttaaaggtctttttcttccccagctactttgagaatttctccatatgggaaaggcagggaaggaacatgaagggggaaatgatggtcacaacaacttactggacccaactctgagccagggggactcatgggtaaagaaacctaacaggcagaatctgtgctcttatggaatttacactgttttgaggagagagaccatacaaaccaaacacatgagtaaatgaaatagtttccacaaagtgtaaaataggaagacaatgcaataggatgatacactagtatctaacggcaggagcaagaagataggacaggcgtggaaagtggaagggacagaaagtcacctggagcacagtgagtgagggcagaggaagtggacagataaaatcagagaagaaggcagaggccaggccttctagggccaaggcaggaactcaaagatgatgagtccttgcctacactatgaaggtaaggagaaggattaagtcgttaccaggtctattcctgggtgtctatgtagcattcatgtggcacccaaagccttaataagcactaaacaaatggggtagatttatcttatgtcactagagattctgcttagaagggtgagtggtgaatgcctgtcaaattaactgtctagagttctttctgggatggtataaattctttattttttatttatgtatttatttttttgctgagacagagtctcgctctgtcgcccaggctggagtgcagtggcgtgatctcggctcactgccagctctgcctcctgggttcacaccattctcctgtctcagcctcccgagtagctgggactgcaggcacccaccaccacgcccgtctaattttttgtgtttttagtagagacggggtttcaccatgttagccaggatggtctcgatctcctgacctcacgattggggtggcgtaaattctaactgtccccaaggcagtgggatagactcagtctctctggttccctttctggccccagagggtagggagtggggtggggaatgattctatcatcatgatcttcacctccagctggaggggaggggattgtttctgagggtatccgtcatgatctgagatgaatgatgatccagcattttcccaggaagggctggaagcatcccagcgatgctggcttcatcgttgtcctagtccaggccctcatgcatccttgcgctgcatcgtgcatggcttatacaacagaaacaaagctagcctggaccttccctgcatctaactgggcatggctcagttagagcccttgtagtaaggtcaggtagagatgggccaggcattaggtgccacgcagatgtgtctctccaccagtcctcgccttgggtgataacaagatgctttgcgatcagaaccatgggtggattgtagggagccgaggggcagctattgggcctctgcctaagaatagcgttcatagttatggctgattgaggggagaattatgaagagtgaatacagacctgaggggcaagcaaacctgggttctggtccagggaaggcctctagtcaacatccagccacctgcacagcatcttccagcacagagagacatcggtcagagcttcactctccctggtcccttggaccaaactgctgaagagagcccagtgacaccatagtaaagggtcattttccaccctggctaagttgaaaatccctctaagtcagccaggaagaaaacattcatgggaaaatgtaagtattgcttctgtttattaaatatttattctagaaccgtgctagtggattatttaattgaacacccacagcatcccaacaaggtagattctatttatattcatgctttgcaataaggaaaccggggtgcagggaggtgacaaagttgctcaaaaacacccagcttaggaagcaactgcacaggacttgagtcctgttgactctgaccccacagcccctgtggataccactaaaggtcccatttagattggaaaagagattcagcatgagcagacagctagaggggccatgattttcccagaggcacttggacagccattcatttttctaaacccagcttcaagtggactcagacccggtatggacactgctccactcagcccaatgagcattctctcatcctgttgttcatagaacttctctgcctgagctctgctcctggtcagccttaggctgaaattcccccaggagcaggggctaaccctgtgtcacttggtgcaatagagaagaggagacatagagcctgatgcagactcccagctaatgacgctcacaccccagttgcagctcatctccagggaagtggtgacataaagcaatacacaagattagaaaactcacatgcccacagtgctgtgcaggttacctgagtgactgaagcagctgtcttagtccatttgggctgatatagactgggtagttcataagcaacaaaatttatttctcagtgttttttgtttgtttgtttgtttgtttgtttgagatggagtcttgctctgtcacccaggctggagtacaatggtgcgatcttggctcactgcaacctctacctcctgggttcaagtgattctcctgcctcagcctcccaagtagctgggactacaggtgtgtgtgccaccacacccagctaatctttgtatttttagtagagacagggtttcaccgtgttgaccaagctggtcttgagctcctgacttcagatgattcaccggccttggcctcccaaagggctgggattacagccatgagccgctgcgcgtggcctatttcaaacagttctagacactggaagttccagatcaggatgccagtgtggtcaggttctggggagggccattattctgggctgcagatggctggcttctttctgtgtcctcacatggccaaaaaaggatgaaagagctctctagggtctctttttataagggcactaatctcattcaaaaaggctctgcctcatgacctaatcatctcccaaaggccctgcctcttaacatatcactttgggcattagaatttcaatatatgaatttgaggggaactcaaacattcagaccatagccccagccaaatggagtctgttccccttcaaagggcagctcctcctcagccttcaacctgctgggcctcgtggcaacgtgggactggtagactcaggccttttcattttattttaagccaagtcagacatttagtttttaaaggtgaaatctcacatctttaaaatgttggcaaccattttaaaaatttgtttttaatgttgtgctgggcatgctaattacatgtgtgggctggaagaggcccgtttgaggcttctacagtgtagacatggataaggggctttgggaccgagagcattgggttcaaatcactgcccttctactttctggcagtgcaactcaggtaaacgacttgatgtctggataaagtggggatcctactcccacctggcaggctgtgctgtaggattgaatgggtaaggcttacaaagagcctgggacagtgcctggtgcttaaagaatgcggcttttgttgttatcctcattctggagtatgtgtgaacggtgagctccctgtctctgccccactttgctcctagaggggggacagtgccttttttcacttggtgtcttccatagaatctctgtggtcttctcttttggtcttcacagccaaagaaattgcaggcttctgtttgtcaggaggattctgacagtgactctaccaagaagtcaaaggatgcctagagctggcgattagctcccttggcaccagctgaaggatgaaagcaagtgttcttggagctcatgcttgaaaataaaccctccaattcagggcttctcagctcccttggcaaactctccagcatttgggtccctggctttggacactgcaacgtccttactatgtttggtttgtgcaaaggtgcccaacatggtggcttcctggcctggaatattctgttgctcttccttgatactctctagagcaacaggaagtccttctcctgagagatgcattttccaaacctgaggcatcttattctttcttctgatctcagccttccatttagatttcatcaaaggagaaagaagtagaggacttacttaccaaggtgtggtatatccagagtaggaaacagattagaaatgaatgcaatccatagaaagccaaactgcttcacatcctgtcccctcacaggaaagcattcagacagaaccacagaccagcagccacaaggaatgcttttgacactgtgacatgatctcaatatttaaaacagcttctcaaaacttaaagtgcaggatttcattcataaaacacaacaagctttctctgaattttttctatatctcatatatcaggcagcaggcccctgttccccagcttctcccaaatatccctccaaatgtgtcctgagccgctcttgcctccttgacctgcgttcttacctttcagatctagtttctttctaactaagcctttccaatggaaaccatactcaccttcctggcttcccttgtttggtggccctcccggaaccctaagcagcacagtaagcaagcaggtggacaaagaatcggtgttggaatactagtggggagaaaggctgtgatggtatttgcatctgcactttgccgcatggcattaacacagtggatgtcacaaggctcggggagaagcggtctgatggtagcttttaataggcagaacatctgagaagtcacgtgagaagaccttccgtgcaagaacacagcagtccctgcatctgcaatagcgctcgtctcatttgacactgtaggaaattccatgctttataccttacagggtggggtcgatggtttaataactcactacatgctggggcaagcaaccagggtccctgggtattttctatagctgatttcatcttgatcttaagcctctatcagccaaaagagaagggagaaaactctacaccttccccataaaagaaagctgtgtctttttgcttaagtggcctttttggggtgaatgctcagcatttcaggggcactcctcattttcttaaccaagaagtcacagaggtcgccccacatagcagggtggagtgtggagtgtgagccttatcatgtgctggtgcatcctttctcaccccagtctatggctgagggtgctgtggtcccttcttctggcaccgtggggagtcatgataaccctactccaccttctgcccttccacattcggccagtgccgtgtccagaccccagcatatccctttctctgcttctactgagaggtcctcgcacgcctgcttcctagtagagcctctgactccctattcttagccaccctctacatccccctctgggagcttatgggcactttcagacgctgcttttgcactctatttctggattctctctgcttaacctcaccataccagcatttctgggctcacctggctgccccatgctggtgccaggccactaagcaaagcgggcttccagaaaagggaagggactttgtacagcctcttcccagtttctttgacccatctttccagacctcagctcagggttgtgggggaactggacatcttcccctctcccctaagtctcatccactctgaatttctcccctgtggttcagaagagcatgcttttcccttcttgtttaagataacttatcactatgttagaccctccttctcaacttccctaggtcacatgtgggagctacctacccattcctttcttggaatatcaaacctcaatgtggccttaatggcagataggacatagatggaagatcttgcttaccacaaaaagtgaaatatatcagaaaatatattgacaccatttatttcacttacaacatgcctgctcttgtcattatggagacaggtaaggcagatagcattttcttactttacagctgagaaaatgaggctcagagaggttaagagacccagcaaggtcacacagcttgtggggggcatagtcaagaagaacatgtgagcgtttggactctgtaagagtattctttctgtggccctgggccacctcccctgctagggctctcttttcctccatgggactgtgaagtcagccacagggcaccgtcagctccgccaatctgctcccttgtctcttaaagtgattataaagtagaaacgatgaaatccacagctgcaggaacagtaggaattctgcctcaaataggcatgaatcctggaagccagcatttaatgctgaagtcactacgaacttcatttaatctttttttttttttaagagatcgccagctatgaatgtctggaaggtggccaacgatccattataagcactaaataatttgtaagtcaaacctatcgatggcaatgtggtgtcaaaatcactcaacagtgttcattgaaaagacaaatcagttatgcctgggcctctgcaaaggtggtttgggaaggcagcagatggtcatgtaagtatgcgtaaacatatatatttaatggactgcagaaggaacaaaaactggcataataattgaggaatcttttggactctacaatttttcttgctgggaaacctgcccagccaagaatccacaaggcctgtgaatcaagtcggcaccctgtcctcatccactgagcttatgaaaaaatgagggtttgactgctgatagcaaaggttccaaacctactgagacctcccttctgcataatgcttttacctgagaggagaagattttatacccccactccactgcctcctccgagccccttcatcttgttcctggacttctacaaaacctgcctaaccagactcccagactccactctgcccctctataatctatattcaaggacaagccagggtggtcttttgagaaccaaagtcagatcatgttatgcctcttgctcaagcctgtcttctctggtttaccattgtatgtagaataaaattcttaatttcgtatgatggccaacacagccctccctgttttgaacactgtctacttctccaacttccttctttttcttttttcttttttttttttcctccgagacagagtttcactctgtcgccaggctggagtgcagtggtgcaatcttggctcactgcaaccaccgcctcccgggttcaaaccattctctgcctcagcctcccgagtagctggcactacagctaccacacccagctaatttttgtatttttagtagagatggggtttcaccatgttggccaggatggtctcgatctcttgacctatgatccacccgccttggcctcccaaagtgctgggattacaggcgtgagccactgcgcccgaccttctccaacttctttcatacctttgcccaactctctccctaagccttgacctcttcctggcctttttgctgttacttgaataggtcaagatgtccctgcctccggccctttgctcaagcttggcctgagtgtcccgctttcaactttgcacatcattcaactctaatctcaaatgtcacctcccagagaggcctttcctaaccagtcattctctgttgtattactgtgttttgtttctattaccgcgtaactcctaaaatatttacatgattactatccatctttctaatctacaatagaaagttccagaaagcagggacttggtcttattcacagctatatcaatggtacctagagggtcacttgtctcatggctggcatcctcatgaaacttgtttattgactgggctactcctttcttccccaaaactgatggtctcctttaccagttgagcaacaaccatattgaagtttaccagtgatccaatcatttgtttttgtaaagtcatctgtttaacaagaatttactaatttcctaccattttccagcccatatgctaggcatgagggccacagagcagcctctgaccaccaagaattcaagatctggaaaagtccatgatacctgttcaatgtgggaagaaccagaacaaatgtgtgcattgtgtactcagataatgggaccccctaggccaggggtttccagggaggccttcagaaggagatagaccttgagctgtaccttggaggatgtgtaggagttaggcaaacaggggcttgaagtattctaagcgtaggaaaagcaaatattcagagcccaagagaggctggcagacgtcgttccgcatgcctggggtaaaggattccctgtaggagaggcagacgggttggagtgggactggcctttgtaatattaaggagcttggactttactttgaaataattataaactcgtaagaaggggagggacttagggttgcgttttgggaagatcactttggccatgagggagaggatgtatcggaggagaaaacaaaggagacagagacctgaattgcctggacaagaggggtgtaatagtttcctagggctgcagaaacaaatcaccacaaagtgggtggttaaaagcaatggaaatgtattctctcacagttctgcaggatagaagtccaaaatccaggtgtggacagggccaggctctctccaaagcctctagggaaggatctttccttgcctctcccagcttctggtagcccgcccccagtattctttggtttgtggccgcatcatcccaatctccgcttctatcttcacattgccaccttttttttttttttttttttagtgtctctctcttcatatggcattttcctcctcttattggaacaccagtcatgttggattaaggcccacactaatagcctcaatttgacttcatctgcatagaccctatttttttttcttttcttgagagagagtctcactctgtcaaccaggctggagtgcagtggcatgatgttggctcactgcaacctctgcctcccgggttcaagagattctcctgcctcagcttcccgagtagctgggattacaggcgtgcgccaccaggcctggctaacttttgtattttttttagtagagatggggtttcaccatgttggccaggctggtctaaaactcctgacctgaggtgatctgcccacctcagcctcccaaagtgcagagattataggcatgagccactgcacctgttccctattttgaaataaggtcacattcacaggaaccagggctttgggccacaacataatcttttggggggacataattcacctgtaacagggagtgaatgaaaagaagggggcggggaattccagagttgaatagagttggattcagtgagtggtggaaactaaacagatgtaaatgcttaaaggagagagggtaatctagaaagattcccagattttcggtttgtgcaatccggtggagggtgaaactattcattgaaatatagactatatcatataagacagaacccaaggtccctgtttcttttctacaaatacttagcacattattcaaagcaatcttagtagcccaaagaactcccctagagaggaagaaatggaagaaatggcaaaacaaaaaaaggcaactgcatgagcaaagcaagagggaacgttagcttcctccaagtttagaccagaagcagaaatgaaaattgagttactgaactcaattcatgtcttaaaagttagagccacagacacaatcagagttttccttgtggaagaaaggaaaggaaacctgttttcccagcctcatctattgacccttcattcattctggagccaggttggaatcaatagtgtcttgtttggtttgaaatccttagaaaagggaatccaactcccaactgtagctacagagcttatttcagaagagcattagcatgcgcaggaagcagcagaccctacaggtataacaccttcttctttggccctcataatccaggtcttgttctgatgtggttcatccggtgccgatagctcaacctctttgatgtccagaccaaatgtggcccactttcctttgggcatcggtgcctttcagcctgtttacctggaggcggtggttctctgcaacatctgcctatcctttgaaacagagtggggtgagggagggtgggtgctccccaggaaaaggccgattgaatttgcaggcaccagacagaggtgatgatgcagtatttcagcagtggtctgagaggtagcttgggtagcgtggagtgaaatccaccttcctaccacttaaaacccagttcaacctcagaggaccgcaatagaatgatagcttattgggactgagacattgtcagggacaaggccaaagaggatgtgacctaccacatgttacacattgttgacagacaggcttactggtgctcacactccatattctttttgacattctccttccctcctgttcttctgacagttgggaagtcttacgtggcctcgctgcctttaacaagctttctgttgcctgagggggaaaaccacctctgctcttaacctgacccagctaattggccctggggaagtaaattatgtagaaagaagagccctccctgactcttgccacaaatatctcctaactataggagacactgagagtgaccacagccttcttataaatctgttgtggcctcatgacctctgagcaataataaatagtactttcacaggccgtcctgtagatatgaagatgttttgtgagaacatctggcattcattgactcaggaaaagaaagaaaaaaatcacaagccttgggacagaatttcattttcttttcatgtttccatgtgggtgaaggagccctctctgtctttaaccaaatgtgggatgggggtatatgagctccctttcaagttttaaaggggaaataaaaatgcacacgcatttctgtgaagaagttctctggctggaggggggcatctttctgaagggggctggggatgtccggttattgtaactagccttcagtacatcgcctttccttctggtcctgtgaagttttctctgtgctgccctctgggaagacctgggttgcagatgatggattctgtaggttggtttggggacaccaaggcgtgcaagcttgaaatggatgagagccgacagtgctagtgttctctctgcctctccctctttcactctcttcctttctttctgtctctccccctctctccagtgctgtagaacgacctggctcataagccctaacaaccacagatttaggctctccttggaatgcagtggaaactcaaagctcatttctgcagggtggattttccactttcccacaggatgagcataactctttgcccatacaaaagctggctgctctgtgatcagtgagtttaaatcagaataggtcttaggtagccaaagtggcttaaaatgttagcaaacagtgggatcccttttaatttttaaagggaactctaattctaccctttatgacttggttaattatcctgggcccctgaacagctgtctattgattccaattaacatgattgacatctcctctggaaggtaaaagctaatcaactacagcatctcccactgagaattcatttccttcttggagtcactcctgggcaggaggaaacttaaatatgagaatcaagattcagcacccacagctctgatttactcttttatatacagcctcacagtatcttgtagaggggaaaaaaaaaaaggctagaaatgtttaaaaatggcagtgtatttttgaaccaaactagagttaattcagttggctttcactttccttcctatttttcgtgaatctaaattgatcccttgaatgtttgatttccttttcctttccggttctgaaggacccacaaagtctacttttattgcttctgacaacaagtttagaagttgacatgaacttcctggtgcagccaaccttcaatttttcatctccgttttgcagtgatttagatgcagatcttgatggtttgctagtgacgttttcagataaaacaaaagccagtaagagagaagttatgtcagataaccaaccagggtccataagacagcagagcgctggaaggctgctgaatctaaatgcgaaacataaatagtgccaacaaattcattcaacacatatttctgcctattgtgtgccaggtacatggaaatttctggaagggtggaatgtgatctcgccgtgatacctatggcgtctttccatgtgtattcttcctcttcagaaaggaaatctacacgttacagttggcagcaagctcaacgtgaagtgttatatggtcgccaaaaaaaaaaaagtgctattataggctgcgtagtatccagttcaaagggggcagtggttaaacaaatcctaacattaattggcattttatttgactataaatttcataagggcagacacaacgttggtcttgctgctcaccacattccaataacctagctcagggcttggcacaccatggacactgaatagatatttgatgaatgaaccaattatctgggcacagacccaatcgtggcaaagaaacagaggccaactttgtgctgggtaagctggtcagataggataattatgggatggatgggtggatagactgggtaaagtgacatcagaggaagtgagatgagattttgttttggacaaataagatggggataactgataatgggcaaataaaactcaaggttcactctcaagaaagagctcacaggctttggggatttgtgcatgaggagatacagtgctgcattcctaactgtcgagtgactctgctttaattaggtttgggcagtaagtaggaagaacagtaagagactccttaacatcagacagtgtggcccagcaaacggcctgctggatgtgtctattctgttctgttgctgactgtagaaaacgcacccctcttcctacacacctcttcttttatctctctttctggagccatcacatttacttagaggagaaatggggaggaggggaagcagccaggaaaaaaaatagatggctcaactatacccagaaaccagtgtccaagtctcatgttgcaaggccagcacctccctagtaaagatcaaatgcttatagtggcatttcttggccaagatagagccaacaacagcaaataaaaacaataccacaaacccaccctgggaactacagaactcttgtattttgtttctcttctgcccactttagagtttaggtttctgtctagcagatttaagtgtgttgcctatcattcgtcaaccccaaatgccagtttatgtatcttaatgtcacttgtccttaccgctacaatagatcttcagacaattagaagccgcccggcatcctgcagggagtctagggccctaggctggacttcgtggaaagaaactagagaatttctgatgttctgttcctgactatttgaaaaattacagcgctctctacatttcagataattctttccagttctccactgctgtcactggttggtctttcttgtttatgtagctttgctgtgttgggggaaggtgggcaggagagacgttaacggcataacctaagagaacaaaagttaagcaaagcaacatcgaattccagtaaatatgtaggttgattcctgctgacttcctctggttaccttagcacctgtcaaagccccgagacctcttattttggaggaaccccctcccccaccacgtcgaacatagtgaattacacttagatcacacattagatgtagcatacagaaaaatagaaacaattattattttgtttcttgtaattttaactttatactttttgtatactggggccagtgtaattttttccaactctacacgtttgtatttgcccccaaaaagctcatgtgacataggtcttgactaacatgggtaatggccctgcctgccgtagccctggcgccctcacaggctattgacttttctcgaagaaactgcccgactattctctccattcagtcaaccaggattttcagtcatccactgaatgtccaatactatgctggttgtggcgtcactctcaacttctaagggcctctcccaaagctctggcctggtcattgcttagcctactctgaaactccatatttcaagaagagtatcttaattaagtggggaatttttccaagcagctgaaccaatggggcaaggggtctgggtttgctttcccagactgtgattcgttccagaagaatcctataccacctccagagatgagatagaggcaatgtctgtaacaacttaatacggctgttattatccgaggcaaaaatgctgtgtggcatttaatgtgtattactgtactgggacttgggtatgatgttgctttttatactcaaaaaggacaagctattttgagtacttggtagcaacactggaagaagtctgtaaggcaaactaggtaactactgtgtgaatggctacgccgccggtgatgcctgacttctgttgtggctggtttaaggaaatccatgttctttattgtcatacctgatctgtcaccctaaccaaattaccagcttcaccagggcagagattatcttagagcttgaggactctattcagtaaaaggtcataaaaatggtaataagaaacaataacaaaagttagcatttctggaatgcttccgttatgcctggtttgttatgagaatgttttacacctcatcccactggtcagatattatagctctatgtagatgagcttatgattctccgtttaaggatgaggaaatctgaggcttggaggggttcaagaagccatccaagaccacccatcgtcagagagtgtgttttcaaaccttgcttgtctgctgctaagcctgtgctttcagcctcatcagtttctcctttctagcttgaattttagtcaaggggcatcagaagaaagaaattgaggtttgggggcaattagtggatcttgagagcagtgacagagcagagtttgacatagtttcttccatttggttttctctttttttccccctccttcctcctgctttcttccttccacaagcatctaatcgatgcttgtggcaccatgctaagttgctgtgagacagagatgactgtcacctagttcctgctctggagctgctcaggacctagaagaggatatgacgatgcatcttttcaggaaaacgggctaaggaccctcatagacctacagctacatcctggtctgccagagcacagcgggaagagcagctggggaagtgaggggaacaagtatcccagccaaaaaaagaaaaaagacagcattgtatatgaaggcccccagaatgaaagcacataacctattcagggagtgacagtgtagtcgggggagtttggtcagcccagctggactgaaggagtgatcatgggagatgatggacataaggctagatggaagggtaggctccatctaggtctccagatggaagggtaggttccatctaggtctccagatggaagggtaggttccatctaggtctccagatggaacctccagtctgccgtgaagacctctggagactactgaaggcagagaccccaataaagatgggaataagggcctgtgttaggacagcgggtagcagagatgggatgaatggttagattcaaaaggcatttcagctgtaaaatcagcagagcttggagacagatttgaaagcgggagaagaggtcaaggggaaaatgaatatgagggttttagctgaagcggtagggtagatgagggacattgttcaccaggataaggaggatggttgcaggaggatccagaggaggctcgagaaggtggttaaccagggaggagtcagtgagtgcacttttgggcccgttgagttgggggcgtctgcaggacatccaggtggggaagtatgttttttcagctatgcattgttgtggggtttttttaggttttggttttgcttctccagtctacgaatagaacttgaatcctccttaaattcatgaacttgacagtaacaataatgtcagaattagtatgtctttactgcggccagagtagacaccctgtagcaagcgcctagaatatagaaagcaaatggtgtttttggcagtctgatacaggcacccagctgctgagtaggggcacaggcctggagagagggctctggagcagaggggtgctggggaagggtgcagaaaagggaggagaagaattatctctaagaagaaatcacttttgattttaattttacacacatggggctcataatactctcaagaacatgctcagcaatgaaggaagatagagagataagagcaagcctccctttatggtaggctgggggacactgttgctttctgcggagcagtctccagcgcccaaaaggaatgtgtttttggtgcaaggcaaggagaaagtgattctcaacccttgcatggctttcttcgtgccttcctaaatgtgcagtttacctctcagttctgatctgctccaagtgtagggataggattatggatccggagacattttaaatatccaaagagaatgttgctctctctcttgcattttattcttatttacttagctactgacttgcttttaaagcaatgtcaaagggaatctatatgttctgcagtgtatctgattctggagtctcacctcctttcttgtgttaatttaggaatgtttcatttctgcaaaactagtgctgcgatctttgcttttctatgcatgcctttcatctggtgctcacaatgtgctgtacagatgtttcactgccagaccctactgccccctaatttgctttgtgattcctggctagttacagtccctctaggcaataccacctctttacctataccaaagcacaaaaataaggcaccttttggggggtagggaaggggtctccctccatacactgtctcctacttctttgtccatcatcaaatccttctcatactctggcttccctgttcagtctgtgtgactcccattcatcaagtgataaattcaatcattaattcaatatgtccgtagtgagtgatatattatactaagaactgtgcctgttgtatccctagagatatagcaatgcacaaaacacagtcagttactgcgtctaagtgctcactaaatgtagtgggtgaaatgaatgaaaagtgagcacaaacttaacaatctgactcggtgtatggtaaaatcggaggactcaccaggtgctatgggaacatgaagtgtaggccacaaactcttcttaattaggcagagaatgcttcctgtaggatggaagagcttgctgtggtttggctcctgggtctgcagtttacaagctgtttgactttgggcaagtcactgtacacctctgtgcatttaaaatgtgataatgatgtaaaaacttagtacagcacctatcacatagtaaatactcatatacacatattcattcactccttctttcagtaaaaatcatctattgaatacctaccgtgtgtcaggcaatgccctggaaagtgtggatggtgcacccaggtcttgaaatactaatatttccaggaaataaactacatcatctcagttctttttttttttttttttcctgcatggactacacttggaagaagtctttgaagtaacaatagtagaagttcttttttgctgtctgttgaagcagcaactcagaggattttcctaggtgtgagggaaagcccgggcagtgaggaagtagcaagtgaagctgtgcccaagttgcacgtttagggttttcatctcaccagcagctccagcctacaggagtcacccctcccaacccccatccctgtctcaaattaaggtctgcttcacatagcagggcacaacaggaatgcattgtcgtcttctgttgctgtcacaagtggtctgaaaacctttaagctgtgcaatcccccactgctgctgaatacttgaagttcttctatgaaaccttagcatgaccccgcatctctggtgctgcttcatctcgcagaaacctgtgaaccatggaggagttcttctcatcccgtgatggacagaaggctgcttcttcagagagagaagtatgagcagtgggaagctaaggaagcttacactgttgttgatgatcaaaaaatgcagcaataagcactatccttctccaggcccagaaacagagctggggtctacaggccagttgaattaaaaaggggaagccccactgtttagagacattctctttctagcaaccctggccctttcttttttccttctttttttcttgagatatagtttaacataagattcaccatcttaaattatatcattcagtgctttttagtctatgcactatgttgtgtgaccatcaccactgtctaattccagagcatcccatcaccccaaagagaaatctggtacccattaacaatttctccccatccccccccccaccttcctccagcccccagcaaatactaatctactttttgtctctatggatttgcctattctgggtatttcataaaaatggaatcctgcagtatgtggccttttatgtctgacttctatcatttagcatgttttcaagattcatctgtaatgcagcatgtatcgatacttcatttctttttatggctgaataatattccattgcatgttccaccttttggctatcatgaataatgctgctgtgaacaatgatatgcaagtttctgtgtgcatgtatgttttcagttgtattaggtatatacataggagcaggattactgggtcacatggtaattctatatttaactttctgaggaactgccaaactgttttccacaatggccacgccatttatattcataccagcaatgtatgcatgtttcagttggtccacatccttgccaacacttgttattgtccttttcatttttagcatagacatcctggtgggtgtgaggtggtgcccttgcttctgtgcattgatttggccactttagcctttatctactacttctctctactcagggtagtctcctatcagaataagtttctctgatctgggatccagagtatttcctaaatggaaaggaagatatgaacagtttttaacatgttctgtcgtagttatgtcattcttactgttgacttgaccagagtctgcatcatcccaatcttgagctcccagttcggatgactctcactgctgtttgctaattataaggcctacctttggtaaggcagagatagctgttccctcttaaatcagccactcttcttgcccagacaactggagtggggaatggagaaactcattgctttctctcacagtctcttgcttctctttattgctaagccaaggggttaatgaaatatacaaagagctcttgtttgaaagaaattaaaatcagagcataatcacatcaaggcctgctactcaaaaattcgtgatcccttgaacatagctcatataaagtgttttcaaaagagagtttgataggcaagttatcaagttatacttaaccaacttaagggaacaaagtattttcatgcattttagttgggtgtttctattgcctttatacagtggggttaagacttataattattcttatcattgaaggaagtcctgaaggatctgcatcaaacagtgaaactaccaactcattatgtgtacttgtgggtaatctgtggatatgttgtaattcaaacttttctagcaaatttaaactataatgtgtctcaaccagcccaaattaatgaggctttggagtatgaccattgaatctaattactaacaagacctaaatgaagtgcaaagcaaaactgactttggctttgaattccaggtctgcgctggctgtatgacctcgggcaagtcattttttttctctagtataaaatgagattctgatatgtaggttacagggctgttttgagaagtaaatgagattacttatataaagtgtcagtacagagacagtcacataaataggaggcattcaataaaggaagccattagtagtagtacaaaagatgtctcattctataaataatggatgtatttcaaaaatgttgccagtaaacacccttttgttttatggataatgaaacattaactagattagggagctgatttttaaggaagccgatagtaagccctcttttgtaaatggacagatcgtttccagtttttcttgtttttatagctcatttttgaataacaggatttcttaaaatggaacacacctgttcagaatcccaagcccagcaccctcatctcttacctctacttaaaaaacagtttgattctcgggttggcaatgttggtgtaacaaacaaacaacaaaatgcccctttgatgtgactgtaatatataagggagctccaaggtctctgagtcaaaggagctagtggctcctgggagaacagggctgatttcactaatctcattcttcatcaggctttgaagggaaatctcacaaaaacatttaggttaaaatgaaagcaaaagtgctctcgctgtaataaggatctcaattataaccctaggagagcagaggggcaccggatttgatagaaagaacccttttagcacatccgtctttgataacatctaatgcaaagagtgaagcctttgaaattagttggtcagtccaaagcagtttttaaataatgcaactgaggactttttgttatatagaacagtccttactggtgctgactttgagggttgaattaatttttcatgagatcttggaactccaggctacctttccagcctcttctggtttctcaggacttttttctaatgtgtagggtgattaaagtgtttctgtatgaaggtattgaggggctctgtttgtcactgtctggaagtgtgattctggagagtctgagaattctccagtaggcccttatgaactggaccgttctacgatatccattcttcatcttccattttccttgcctatgccctgtgtacagcactatacatgcaatcatcaaaccaagaagacaggtgggagaagtatacttcactcttgcagagaagtgccttttttagaactgcaagatttaaatgagggaagagatcaatagcttattttttcctattcatttccaggaagggatcttggcaccctatacctatccacttgggttcctaagaggaactatctttcatgcgtctgattgctggaaatagggtcttgtctaacagaagtggaaagtactgacttcattgttagccttagagagtaaactcagctgctttattttctgaagcatctcccaaatattctaatctacccagattgcttctgttcttcaaactcctataatatatatttgtagcagaaaaaaagtagaaaatagctttaagcctgcctttctttcccaacatttcattataagaattgaagaatatctgacatttacttatataactgcattggggaaagaaggaaggacaggcactgtaggactaattattctatggaagctttagtgtaagtgctgagagcgctgtaaatgtaatggacaagaggaaaaactctgaatgccttctgaacagccctccctgctgtctccctctcaaatcaaatccatgatagatgccactctgctgtactcccatggtatccagtactcggctccatccggcactcatcatactctgttgtgattacctgtgtgcatgtttgtcacctccactagactgagatccacgagaacaaggactgtgtctcattcacatctttatccccagtgctcagcatacagcctatgtgctcggtatatgtttgtcgaataaatgattgagcaaatgagtgagagagccatgtgaagtagttggggccacgtctcaaaagaagtgttactgaagaaatattaggtgaatattccagatatcagaattgatttgaatgatattgtacttctgaaacctaccagagtttgggcatatgatactaggaatcatggaaacagtgacaaatgtggaatattcatccagtaaacaaattgtgggtagctgaacatttttgcaactctcttcatattgtattgacagtacacctatgaatcactcccttcttcagagtttatcagtctcacattaatgcatcaatcatcatttgcagaggtggggagtaggagaaatgagccagctctaagaaagattgccgctgtttatgggtagccaatcggcaatgggccgatgcctattggtaggattcttcaggtcataatgtacatgcacaagacctttttttcctttcgaaaagggataattgattgaggtgagaagattggagagtcctaggagatttttaatccagtgccatcacgcaaagcttactacatcggtaagacagttccataggggaatggaggagtaattgagatgccacaccagctggaatccagatgaagatacatttggaagcttaatcacaatcatgttctacactaaatattcatccgtctgtctcccaaagaggagaggaaattaagttgtcaagggcaggatggggatgagggtttagctgaaagaagaaacccacaccatatccttaatctctaaatatgcaagactgtcttaaatggttgaagcaagggctcttctttccagttttatttcctgagaaatatttgagctgtttatacacaattttgtcagctttacagttaccaaaatggactgttaagataacttagcctcctctctgtgggataaatacagatgagcaatgccatctcaaaggaaaaaatgctttattgagccaatatagaaaagtattaaagttgtgtaaacatgcaggaagaagcaagggaattcctaacagagctgacgggctgtgattgcacatgccttgatatactctgtcccaaaagttgaatgaaaccctggatgtggtcgataggaattagattacgtgttgtgagggctttttttatttccaagttaaactgtttatatctcatctaaatggtctcatggcatctaaattttatttcaaatcatgatttcaaaaatatttgttgctgctatatggttgctgctatacactaaatgatagggtcctttgaaattctgactcaacaatgtgaatcaaacattggcttttgttaaaagggatagtgaagttcagtattgtattgtgccctgaggcgcttgcattaggtagggtgcctttggctgcaagtaacagaacaatccctgtttgaattcgttttaataaggcattgtactgtatcacgtgataaggagtcgtttgataggggttgctccagctgtaagatgtcctgattacacgggacatcatgtcatatgtcaagtcagtgttgggactccatcctgatactttgattagtggtggtggaaggaaagggtatattgtttttctatttcaagacaaagaacttaactcctggccgggtgaagtggctcaagcctgtaatcccagcactttgggaggctgaggaaggtggatcacgaggtcaggagattgagaccatcccggctaacatggtgaaaccccgtctctactaaaaaatacaaaaaattagccagacgtggtggcaggcgcctatagtcctagctactcaggaggctgaggcaggagaatggcatgaacccgggaagtggagcttgcagtgagctgagatggcgccactgcactccagcctgggcgacagaacaagactgcatctcaaaaaaaaaaaaaaaaacacaaaaaaaaacttaactcttacggagcactgtttggttatgccgaagcctgaaagtagccttctctctctttaaatgcaaagcctgtaccccctcagggtaatgtacttcctctgtttctttgtggttatcttggtgtgctgcctttcccagtgtgcaacaccatcctcaaactgggtctacaatatggcacatgtatacatatgtaactaacctgcacgttgtgcacacataccctaaaacttaaagtataatcaaaaaaaaagatgactgagggatgtcctggccatcctatcccgatgtttcaatccccagcagaagaagggggtcatcttttctccatgcttttttcttaggagggagtaaacttttcctagaagttcatcagttggacttcttctcactcaaaacctacccaggccagccccttgtgattattttatggtggtctttgcttggaggtggaggtaggaacacagccattctctttgtactgtgtgtcatatgaacaaagcatagctccctgtgacaccactgaacaatgtggtgccatagaacgcaggctgtggagccggacagtcctgtacctgaatcccatctccatcactaaatagcagcgtgaccttggcaaatcgcgtagcctcagtgagcttcactgcctcttgggtaaatatgggtgtgaacaccagtcccacacagagcttggagaattacagcatggagcacaggagaagcactgctcagtcattcttcctcatccacctatacctttccatagagagcgtcatggtgccaactcgttacctaatgcacttttttaaaaacctaagtataggtcttccttttgtaaaccccatcttcttatttacacatatgttatggtataaagtataatttgattgaacgtatgtgcatataccagtatttggtgtgaatgtattccatatgtgtacattgtaatatgtgtatatatgttataattcatacacatattcaatcagcagttccatattgagaagatattctttgctccctattgtaccaggcattctagttgttctggtttaatgataatcaaatgaggtccacagacccgtgccagttagcaaactgtgtgttactggtctatgacaagaaatttacattaagcatttagacacatttatagtcatttgacactactaaggcatcctagtccatgttcatttttctaatcattttgattatacaaaagtattggcacatgagaggttggaaatttttaaaaaaaacgaaaaattctgtatcatttgagaagcttactaggatagacacatactgaagatactcttggccttccaggcactaaggtttatttggagtgaaaagagattgttatacaaagttgttaaacaatagtgtaaacacagtcgtgaaaaagaatatcatgaggcagctgtaaatggcccagtgcgccacatcagtggctgcggtaacacttgccacagatgtccggaggacgaggtcacagtgcggcagtctccttaagcaggtggacttgttttgatttcccctgcgtcccaggcctcccgtcagggcctactctgtcccctctcactcagcagcctggcgggttaatctcccggtgagcgagagcctgtgaatgaagctggatggagttatatgtcagactgcaacaggcatgcactaaacatctcgctccatcatccttgacgaggctttgatgttagcgtgaaacacgtccaattacacgagacatcatgtcatgtgtcaagtcagtgtcggggctccatcctgacactttaattagtggaggtggagggaaagggtgtattatttttctatttcaaggcaaagaacctgactcccactgagcactgtttggttatgcccaagcctgaaagtagctttctctccctttaaaaacagagcctgtgctgcttagggtaatggccattgtctccactaacgaataaagctatgggccagtaaacctagtctaccaggagctgctttgtgagctacccaagctgccaagtgttctcatcttcagcaacataaatgcttagtaattatggactttgtttcttgacattaaaaagtgactactaatgctcttgtgtatctcacaggagtattagttgttgaagttgaagtagtgcccctggcaatgccttagaggcacgaatgagactacatgaataggcacgatggaggtgggggctgagtggagagagagggtgcagttagggacctctgctcagaagagcccttggtcaattagcagtggtttgtcccacacctgaaaacatcttgttttgcttgtcccactatgagcaggtgttaagtgttgtggttcagggatatattccacctagaaaagtgtctaggcatgaacacagctctttgccatttgtgaagatggccctgggtaatgagaaaccagcgctttgctctctggtcccggaagaaggtcgtccaacttaataccgagtgaaatctctgaacgtcaataagctgcattcattttgacatctagactcctgtgtaattaagatctcaggtctggcgtttggtttatcgagcatgtgtcaattctcatttacataagactttggtttttcccacatctctgcacagacgccgccaaaaaaaaattactattaacaaggagagggctgaggatagagttacacagcccatcgtgtctctaatccctgcttaacatttcccttaaaaagaacattgccctattcggaaattaaatgctgtgcgtttagatgttctttatggagggagaggggaggtaggttttccactgctttatattgagcttgaaaaacatccgatttcatgccccttattcaactgtgaagcagaatttgatgcataattggagggtggtttctttatctcgctcttagaaaacaactggctgaagcttctctcacctccctgtagctggatgttaaaagctgaggctggcctcacagattccctaggtgtattcatctagttctgtttattcaaactgaagtctgctgggtgtaactggatcccacgaaggaggaaaggcacttcagggactgctggaaaccatccttccctctatttggagcttcctccaaggcaagggcgatgcggacccaacactttggatgcctcttcttctttccatgttaatggctacaaagcagatgggtttatttttgcaactcaaatgagaaaaaacatatttgaaagaagttagggcactttcacaggaccacacatggagttggttatatgacctgggaaataggacagtctttataagtcttcattttcacatcaataaaatgtgctcgtctgtaaaattagggatggggaaagaagtctaataaaaaggctcagagaaaggagatgctggagttgatgtaacaggattcaagactctacgatattaactgtttcaagtagaaaaccatcaagaaaggatagaaatttaggattgctttcaaggagcctctcattccagatttactacttagtactgtgtgaccttgggcaagtgactgtacctctctgggcctcagatgcctcatcttggaaatagattatcgtggtactcactttgtagtcttgttgtgaagagtaaatgaggtaattcttttttttttttttttttttccagatgcagtctcactgtcacccaggctggagtgcagtggtgcgatcttggctcactgcaagctccacctcctgggttcatgccattctcctgcctcagcctcccgagcagctgggactacaggtgcccgccaccacgcctggctaattttttgtgtttttagtagagacgtggtttcaccgtgtgagccaggatggtctcgatctcctgacctcatgatccacctgcctcggcctcccaaagttttgggattacaggcgtgagccactgtgcctggcctaaatgaagtaattcttataaagcacttggaagaatactgacataaagttggccttcaatgttgccatcagtagtagcagtattactcttactactactgttaatattattgatcaagatgaccctctcctctggataacataacagtgattgtctccactatggccaggttcttctcttacagtctatccacaatatttgtctaatcctagaagttctagaaggcatccaagaatctaagttagtggttctaagtctcagttcacataaaaattatcttaaggatgctgggcactagtggctcacacctgtaatcccagcactttgggaggccaaggtgggcagatcgcttgagctcaggagttcaagaccagcctgggcaacatgacaaaaccccgtctctaccaaaacacacacacacacacacacacacacacacacacacacacacacactagctgggcgtggtggcttgtacctgcagtcccagctacttaaggggctgaggtgggaggatctcctgagcatggagaggtcaaggctgcagtaagcagtgattgcaagccactgcactccagtctgggtgacagagcaagactctgtctcaaaaaaaaaaaaaaatcataggaaatgtttaaaaatcctgaggcttgggtcccatgaactgagatttttatttatttgatctagcgtctagctgggccttatgacttttagaaacactccaggtgattccaaggcaccacttggccagtggaaggccatgttaattttatattgaaaaagacctagaatataaatggtttactagtcaactaattttccacaagggcaccaagaggacacaatgggaaaaggatagtctgttcaataaatggtgctgagaaaactgaatttccacatgtaaaagaacgaaattggacccttaacttataccactcacaaaaaatagactcaaaatggataaaagacctacatgtaagatctgaaaccataaaactcctagaagagaacacggggaaaaagctcctggacaattgattggccttgacaggttttttttggatattgcaccaaaggctcaggacacaaaagcaaaagcaaataaatgagagcacatcaaactaaaaagtgtctgcatagcaaaggaaataatcaacaaaatgaaacagcttatgggttgggaaaaaaatatttacaagccatatatatggtaaagggttaatatcccaaattcataaagaactcatacaaaaggctgggtgtggtggctcacgcctgtaatcccagcactttgggaggctgaggcaggtggatcacaaggtcaagagatcaagaccatcctggccaacatggtgaaaacccgtctctactaaaaatacaaaaaattagccgggcgtggtggtggacacctgtagtcccagctactcgggaggctgaggcaggagaatcacttgaacccgggaggtggaggttgcagtgagccgagattgtgccactgcactccagcctggtgacagagtgagactccatctcaaaaaaaaaaaaaaaaaaaaatcatacaatagtggaaaaaccacataacccaatttaaaaatgggcaaaagacctgaataggcatttctacagagaatatgcaaaaatggcccacaggtatatgaaaaggtgctcaacatcattcatcattaattaattattaatcaaaaccagatgagataccaccttacacccatttggatggcaactatcaagtcacaagataacaaatgttggtgagggtatgaagaaaagagaacccttgtacattgttgctgggaatgtagattggtccagctgttatgtaaaatagtatggatattcctaaggaaattaaaaataaaattaccagatgacctaacaatctctcttctgggcacatacccaaaggaaatgaaatcaccgcctcataaagagacctgcatgcctgtgttcactgcagcgttgtgacagtgaacataggcaacaacctaagtgtccggtgacagacaaatgaatacactgtggtatatgtctagattggaatattattcagccctaaaaaagatcttgcctttgccacaacatagacgagcctggagtgcactgtgttaagtgaaataaaccagacaaagaaagaaaaagattgcattgtttcaagtatatgtggaatctaaaaacaaacaaacaaacaaaaacccaactgtacagaaatagagaacaaaacagtgattaccaggcaggggatagctagggaggagatgggagatggaggtctgtattaagtagggagggtggccaggtctggagacctaatgtacaaccggaagactatgggtaagaaaactgtgctatatttgggattcatgctacaggagtagatttcagctgctcttgccaccaaaaaaaaaaaaaaaaaaaaaaaaaaaatcaaggaaaaatggatacttatgagatgatggctatgttaatttgcttcactgtggtatcttttttactatgtgtttgtatcccatatcatgttgttccttcaatatacacaataaaattcattttacaaaatgagtagaataagcttttgtttcccaagcatagtattcatgagtgttatatgaggtcctgttagatagtttagattatatgttaacagtcctccaactattttcatgtgaattaggacaaaaaaaaaaataactagcagatcgactccatgacttcacatgtagtattctttacactgaaaaaaaaaaaaacgaaactaaaacatggaggggaatctatataagttcaacttaagtaaaacatcaagttactatttacacatatatggtaaaaaaaaaaaatgactggcacataagtgagtaaggcttagaagacatggtatgaactaaatatgactatttttataattctgagcaaatgtgattgttctaaagattaaagtgatttttattcatcaattgtaaagtttctagcataaaaaaggtagatttatgaaatacaaatccaaacttctaacctaaggacacaaaagtcttggtttccagtaacttattttcaggacacagagataaaaaaaatgttctttcatatttactcagagctgtaattataattactttgtatatatggacatggttaatgataatgacatcctgtattttcatagtaccttcccatttacagtcgactttcactgacatgaattaggcatcctaataacccgctgagtttggattattagccccttgtcacaaatggggaaaatgagggccagaggggttggttatgtggcctgtcctacgttacacatccaggacatggaggtgcaggattggaaccacatcacctaatccaaagtagtgctttttattttctaccatgcttactcttctaagtcttgtccatgctgtctgctctctcttccacattcaattaaaaaatccctcaagggcacctctaactgtgtaacaaaggaaaaccacctaatcatctcctcccagctcttttgtttatgcttttgaccaactccaatttgttctccagacaatagccgaagtcatcatgatagtcaatcaatcatgatacctcttacttaagtccctgcaatgactacccaacttgctgtgtatgaattcgatgccctgctcctcctgaccccgtctcccatctcctactactctgttcttgctcactgggccccagccagctgtgtctcctctggatttctcaaccaggacaaacacttgctgcatcatgccagacggtgctgttccatgcagcaggtgtgccctcccaagaaaatctagcttcggtgtaacctccatgaactgtaattccctgacctcctgtttgggtgagaccccactccttgctctttcatgcaacaaacagatctttcctgcatagcttttattacgatttggaattatttattggtaagattatctgtttcagatctatcagaaggcatcttctatgagggtagaggtgaaatcacctccatattttttttctacccctctagtcccagacgcaaacacagtacttagcacatagtaactcaacaaatatttgttgaattaatgaacagaatatgaaatggctgaggggtaactttcctactctgaggacaaagtgcagttttcactgcctacactgatcacaagccagggagtctgaaatgcttgcaaaaacttcaaggcttcccagggccatctgcaaggatattatcctgaagccactgcttacacctgactagtacgactactatgctggatactcaagacaggaaatgaggacctgtcaggggcttctaagttgctattcaggagaggaaagcttttagttaaaccagtggtagaataccctgagccctgtctgcctcgcctttccaagaagaagcatgcaagagcccgagggtcacaattttaaaaccacatatctaatagataaatacagaaccagaaattagaaagccgtattctattcccaaccataccacgttctacttccgagccaataagttgcttttattggccaaacttcagttttcttaccattaaatagatgtaatattgtttatcctccttaactcatatgattgttttgtggataaaataagacaaagatgaaaatattttgaataggtagaagtactttacagtattatttgagcctgagttacacagatagggtttcttctccttagaggcttcaaaattaaggaagatgcactgatttccatagatacaaaaacattccaaagacataaacacagtgaaaggacaaatgcattattcattggcattatggatttaggtgggtggtcagaaagaaacagtgttctataatagatctccgcctgcggatcaggagtcctgggtttgaacctaccttgtcatccatttactagctgtgccagtttggtaggtcacaaaatctctgaaagcctcagtggcccccatctgtaaattgaagagggagggtgagagtgggtgggaagtggagaaatagtaatgatattatgatagtttggaggatcaaatgaaaagtggactaggaaaggcctttggaaacagtgaagtgacttagcaatgcaaggcattagtattatccaagcatttgtgtgtttagccaaggggcagtcagaaagtcgtcagggaaggctgcccagaatagcaaagaagtatcaagaatgacttaaataatagcagggagagggcaggtctagtcaaagaacaagtttcaggggagggtgcagcctaggagagggcaggtttccaaggggctggcaggacccagccaaggtggtgggtagctcccctctttccaaaagctgaagtggttcctaaaagccctggattacaaggcagaggacagcattcaggtggggagaatgtgttaaaaggatctcaagtacactcaaggatgtttgtttttgattagaagatgaggattaactggattaatggagcctcatgaatggagaatgtgcagatgctaattgcccctaaattacagtggattccattggaattgtgtattcctctccacaaacccaaccactgcctgcctgctctctccttccctccctccccacacaatgctaaaatgaatgtgtcattgtaactgagatgaaaggccttgaaattgattttctacttccttccaagatctcttgtttgcaaaacacaggaagatgtaagttactaatcgagttccagtttatttcaaacaaacaaacaaaaaatgtattctagggattcagttgctggaaggctttttcaagccctcatttcttgcttagtttctctgccacaccaattaacttagtggttctcaaagttgagtgcacaccagaattacctggaaaccctgttaaaacagattgctgggccccaccccacagtctctgatgcagtaggtccgaggagaggacccaaaatttgcatttctaacaagttcccccaatgacagctatagtgctggcccagggccaccctttgagaacaaatgaactaggaaaatatcagagtattttaaggaatctggctaacaaaaagagtgcaaacctcaaagtcctgtggctatgtcttctcggagaaagtggtgcaatcactcagaattcaacaaatacctactgtttcctaagtcagctatgcatagattctcttggatttggtgaagcttacggatagcttatgggatcaacttgctttgctattgcatgggaaatgcagaagaatttgcaactggggtgttttcttcctggagtccccacccattcctcctcctatctggtttgcacaccccctcttctgttgattatacatgtcaagtggtgttttcacagctccacagccatcacacacctccagacccctgaacactccctttgccttgaagccaccaatatatgtccaggcctattctacatttatttataggtcacttttgtgcaaggcctgggctgcttttgctagtgttgccaaaattttggaaagcagtggaatcaacacattttgggttctagctctcaccttgcctctaggttaccatgtgattgtcgaaaaaatacttaaacctctgggtaggattttactcatcaattaaagaagttattagtctagctagcttagtggttcttctccttttgggggaaatgaaaatgaaatgtatggacctcttcctaggaaagtggacatgtgcaaataaatgcaaaatattgctcacaattgttagactgcctgaataataatatagtaataacaagcaatgatgattatagcatttattaagtgccaactatgtgccaggcactgtacaaggcactttacatgtgttatatttaatccttgcaagaatcctaggaggtcacaatgcccagtttctagatgagaaaaccgtggcaaagacaagagaattcatctcagttcacccagctggtaagcgcacaatgggatttgtgggagcctacacagccctgaagctgaccaatggtcctctgggacatgtatgaccctgagttaagagtagacgcagttctaggtgatagttcaagtccccctgagctctgaagtacataattcacagattttttttttttcccatcactaataaccaaacatttggagaaataacccctggcattcttaaggcttctgtgcatcagaggtggtcacaaggtttacaatttaaagaatatttggggattaaactcagaaaaccaagccaccacagtgccacacttctgtcttttgtgggtgtcttaaaaatgaatgctttcttatcgtagtttctgaccagaggcagcttcctttaaaggctaaaggaagcagcccgtctcagctccagcaggtcagtaatgtgacgagataaagggcagttccttaatgaaaaccactctccctcctgccagtaaaggagttttcttagtgcatttcaagtcctctaacacctcttcccagatcaatggcttttcataaatgcaccaggagatctttgaaccactaatgcttcaggggctgtttaggtttggagtcaaactgtttaatataactctcctccaagtctggctctattgaaaggtctcaggaaacaaggcaggaggaatgtataaaaagcagaaccgctgcggccaagtgacgtccctcgcctgcctcggccttctgtttatacaagcaaattggaccaggcttattacattcaggagggggaaggaggaataaagtggcatatgggtcacggcggagagttgagtgaaaaggaatcagattaaaggtgccttttgattggagtggagcaagtcatttgcttaggaagcggggaaagccattgattgacttcatcaacagattaagcactacaataaaaactgcattgtgctggagaagtgtgggccagacttctgcatgttcctgggaaaatgagtgccatttaatttaaatacttgtttaaacacttacgctagaggaagtgtcttttcaaaagggacatgactatgagcatcaagaaatattataacaaaggctagtcttttctatctaaagctgttcccacacttgctttctccaagcccttggtaggaatgataaaataatcagaaaggtgggcatttcctaaatgtagcctgtgcagcactgtgctatgtgctttacctcatctactgttactaactctactttcagatgggaaaactgaaccccagggcacatgagcaacttgagcaatattataccaatctgggatgggcacctcaattttcttttactcaaccaccatcctaagtctgtctacccatggaaacatgatccactgtcatctaatgtttcattcttttactcctaaagatctatgacttactggtaaatttcatgttgttccacacaatatcccctcattcagacttcaagcctcctgagggcagggaccatgtagttttaaaattttgccttccaccacagtgcctggtacagtagagacctggtccctatcctttattcttgaaaagtcaatctaaaagtagctctagagttttggggtgggttttttttttctgatgatagtattcatagaagctcactgcataaaatattgttttaggcgctaaaattatataaaaattaaaaaagccagcagaggtaacagtcattaacatttcagtatatagccttctactcttttccttatatacatacacatgtaaagatatattttaaataggattatgctatgcatgttgttttgtaggctgattttttttgctaacaatacatcatgggcatctttccatatcaataactctagatcttcagcagtctgtatatcataatcctgcacggtgttccattgtgtggttgtgtcatgattcacttagttcacaatgaatggacttgggtggtccctgatatttgcttgtctctgcaaagatggagcagacattcctgaacttacaaattgatgctcctctttcagtccttgttcttgacccaacttcttgaaagcttcacacccaccacatttgcttggattgcagttctcctagaaatggcaaaacaacatactttgtctatttcaggaagccttcttacaatttcatttttaatattaaaattaggctgtggcatttcccttcgaacagaaggaagtcacaggtgcccatttctgatgcagttctcagaatatcctaatctcctctcctgctgaacagtctctgccagggagtcaccacacccaggagcttaagagtcattttcataaattccccatctatgaaattgctgtggacagttaataaacccagagtcaaaggctaatggatgccagcaagagcatggggagaggagacaggctggtgattgggggatttgggaaattagccactcaccttttaagcatcctgggaaatcgcaggtggctatagctatgctagggccaagccaggtataaaggcggaactaggggagagttcaggctggtagtaacagataatacaaagtgcaggccctgggagccttatttattattttccatcagccaagtgaaggcaatttttagatttagacttttttttgatgaactatcaccatggtgatggaattggaaattcttttcctgacaacattgctgttaaaccatttgtttaattatttgcataccatgactctaggaggcccctagagctgtatgcttctctctgtacaaaagagagttaatctcaggcatctcttagtttccttacagcacagagatccaagttttctatatgcctcgtctttaccaggtatggattgaggctcctgggggttccacagaattcatcttgcaaaagatgttcatgaaagaacaagattgaagaaaagaaagaagagcaaggaatgtaccatctgttctgggaaaaatggttttgagcctctctacttcttctctggacccaacagatttggtttctggcacatcacatctacagaatcacctataggccagagatgttggaaggagactttcagtaagtaccttctggtacgagctgggaactctggagtctaagttaccttttctattatggggctggagccatttctgaattcatccctttccttccttgaataatagtgtctttaaaattccagatggattcaagatatatttatgtattttaatcccctctcttaactctgcagctgactccagaaccatatccagaaaggtctcttctaaacatccctccctgatttgggtcgtgcttattagcgaaagagaatgagcttgcttcctgagtcttcctatactttgccctgacccacacttccattcagacctggtctctgaaaaattactagccccaattataatgaacagtttccccatgagaagtaatttaattttgcaaattgttgtccaagtcataagggttggaggtgtctggagactttgggagcggcagttgttctctaatcctgtggccctgtggggatactgtgtacatcagggtaggaatttcttcaagctgaaccaatgtctcctctttctgcctttttccttattttgtctctttcttgcatcactgctattcttccttaaagacaggcaaggggttggtggattccaggctgttaccaccccgcttctggaggatgtggtgcgtgtgacagcttgggcaaggcacagagcccaggctgtgtgtgtcacactccgttcccaccgacaaacactgctgctcgcctccctgtccaaatctgataccacgtatgttctcccgatcctgtgctgttgctctggaaaccaaggaagcagcaggatctggagtaggttcatggccgagtcaaccttaaaagtctcccagacgtttcagcaacttccggcaggaaaaatgtacctgcaccccctgcccagtgagaagtttttgactgatagctctctcccccgtggaaaagtttgcctcctgaagttagagaatgtctgtcttcccacggctcatgttgtgggcagggtagtatattggatgaagattcaaacttcaggatctcaggcaaattccagccctgctgcctaccaggtcatgcacataacaaataaataagaacgtcatcttatccccttcaaatgccactctgcttcctcccggggtggactggccatcttgcagtctccacattgctgagttccggtactgtgttcacgctcaataatctgctcttgggattaagttcctggctcagaggcttagcagctgggtgactggcatgttcttcacctttctggtccatctactggttattcaccaaaagggagtaattatgcctacctcgaagctatgttttgagaaagagaattgcatacatgaggtccataggtcaggacacagccccaatatgaccagctggcagaatcacattctccaattgtagcatgcgaatgtttccactgggaagaaaaaaatttctttcccttttcccagcctcagtctttcattcctttcgaaagatgcatctgacttcataataccagctcacctctgtctttagagataggtaaaacagagttataaaactcaacccctgaccctgtgccccactcccacccacacacagccatcccagcattattacctttgctggcaccagacaggtaagcccttcaatatggtggaatgtaggtgggggagcctaggagtttagggcaaagaagatgggttgaagataacagaagagtgagagcaggtagctgtggtgggaaaaaaaaaagaacagagggtagaaatacaagaggaatgaggaagagagcaagcaaggagaatgaccctatgaagtcagcagcctcctaggtccacagaagtctggggagagtttactgtaggcctcttctcaatgcacatatcctacaacccagaggcctagagctgtttcgaaaacagatgacagagctttagtcttacaattatccttttaatgaaaattccacccctcttttttctttgaatacagtcctaaaaaaatttctacacacagacaaaatagctatttttcaagtaacagaggaaaacaaaccccaaacccacccatacaaccatgctcactcctctgcatagcagcactaggtcctcacagaggagctcataccaaagcctgagtgttcaggatcttcagtgtgttggcattgtacctagttatatgcatgtacacactcatgcaattcctaaaaaagacatccaaaatgatgaaaatatggctggtgtaataataacctgattaagaaagatagcatgcttggataagggaagttagagcttccgtttcctcaggcaacatcatatacacagaacacatcatgttagagtgggtggcactagaagtacaaacaatactggactcttagtgaaatggtgatatattttttttcttattacctgttcaccttttgcccattttcttgtggaacaaagcagggctgtaagctggggtgggtgtgtcctttttgggtgtacttaacatgtttgagcttagagcgctcactctcttgtttcttggcttggcttttgctcccctcgggaggatgtcagggcacacactggacaatgccaccacttgttctcacgcagagtttcatctaaaaccatgaggggcctgaaacttcttcctgcctttgcttgttaccccccgcaaaaaccatcacatttagtaagatgcttttaggtgtgagaaacacacatctctggctcaacctttcttgagttttcagtctcattgtttttagctacaggatcatttttgtacaaggcaaacataggaaatacatagtgggtgaaaactcagtctacaagtgtctgtatccaagaaaggtgacttttattgtttgtaacagtttctcactgatgttcacttttccctgttcacaaaaactaaatagcaggcacttgcaaataatccctctgcctcctttccaggactgtgtccaagtttcagagagtatagcggtgcccagcctaagggaggaggtagtgggcatctagttcatggaacctaagtctgtccaccttggtgtccaatgaaataaccctttctcactcaatatgcttcttccctacaattctcgagggcacaaaaaatcatccttttacttactgccttgctcctcagcggctctgggagactctcgaaggctgtctttcaggcgatgccgctcattgccatcatgaagccattcctccttgaatgctcctgcagtggcatggaggcaagggaattctcagaggcttgccccctgatgttttccccagctggaggaatctttggtggagggagactcctaattctgactgatcaagtatactctgagcacacttagggtttagatctacaatatccaatagaactttctgtgatgatgggtgtgttctatatgtgtacttccattacagtagccacagtcacacgtgtctagtatgaccaatgaactgaatgtttcattttaattgacctcaaatagctccatgtggatagaggctgccatggtgagcaacgcaggtctagaattttgaaactgagagacgaagaattaatgtctttattctctatgctatcctgggacaattggtccttaaggcaaaggtgaattatatctggtctgcctagatacaagggagtatgagtgtcttggaaggggcagcaacacataggttactattttaaaatactatcttggctgggcacggtagctcatgcctgtaatcccagcacactgggaggccgaggcaggtcgatcaccagaggtcaggagttcgagaccagcctggccaacatggtgaaaccccgtctctactaaaaatacaaaaattagccaggcatggtggctggtgcctgtaatcccagcaactctggaggctgaggcaggagaatcacttgaactggggaggaggaggttgcagtgagccgagatcatatcactgcactccagcctgggtgacagagcaagagactccatctcaaaaaaaaagaaaaaagaatactatctcaccataaatacataaaaattcatgttgctcaagttgaatttgtgggcagcccagaacctgccccttgcccatcccttaagatactgaggcacctctgacagatcacaggcattcttggaagctgctttggaaacctctgagctagttatagctaaaatccagtctggtgctgacattccagggtgtagacatctatatatctatagacagaagaactacatcttctagatgaggaagtcctggcttccaaggtgtagtgacttgccttaagcacatagctcatttctagaaggttctgaaagccaggtctgtcacactctattcagaacactttcctccctacttcatagtcttctataggactctaaccctgacacttcactgttccgtctcccctggaaataatgatttcctggaggaagggttatcttgctctagcactgtgtgtggcagggcatctactggtcagtgatggggaagacaaattcattatgtgggtattttagaaagtgagcagagacttcaggcaaaagtagtttccgcgaccactgtcctctctggttctgcgtgtttctctttcccctttacataggtagcaatccctttacccaccatccatgcttttgcagatggtaaatgtgttctgaatgagaagatttcattccttaactctaagttctaacctaaggaaggaggctctgtgtttaagttaaattaattcagctgctgtaacaaatgaatttaatacaatgtataatgactcaaattgattgaggtttatttctctctcagataaagaccaaaatggcttttcttaatgagtaggtggcttccttccaagtaatgattaagagacccagattcccaaactcctttactcaattcatgattaagagtaatcattaagaactctgccactttcagcagtaggttcaatgctaggtttgtcaacatcgtgggggatcaaactcagggaagtttcacggaccaagccaggccaatttcctctccttgaatggaactcagtcacatgatcaggaccaactgcaaaggagactgggagatgtagtcctagttatgtagccaggaagacaaggaaatatgtttgttcaactgccagccagtctcactacccttctaaaccaacatttggcaaactttctgtaaaaggccagatagtaaaatattttaggctttgtaggtcatactgtttctctcttaaccactcacctctgccatgatactatgaaagtaaccacagacgatatgtaaaaaaactaaatggcaggacttccgataaaactttattacaaaaacaggcagcggccaaatttgtcctgagaaatggcctttatttgtcagtctctgttgtagcccagggaaaacacttattcccaagcaaaacacagaacaaagagcattttaaactatctgcaaagaactgaaaaagttatgtctgttttcactgctggaggcagtgaaagaaaatggattaagaggacataaaaagactcaaacatatttaatcctttataaaagagaaatgttttctgctgtgctttgaaggaaaagagtgatagctataggaagaggacatttatttaaaatgtaaatttcaggattccacccttagtattttggagttggggcccaggagtctgcattttccatatgctcccctgctcattttaagcaagtggtagaggtagcaggtgatcataatttgctaattgctgccaagccatcagtttttctgacatttgtggatgtaactacttatgagcctatggaatatgtgagaaataagataccgtgcatatgcaaagccgctgacctaggtaagcctaactcttcttttaccttcaaggaagctatcaaaatacaagggaatgtgagtgatcatacaagtctccctaatttattcttttaatgaattaacttgggactctaacttataactagcaacttgtgctgtggtgcaacccacaatttaacgcaaagcaaagggcagagagtcaagacttcaaactaggctgtgacccggaaggcagtttggcttctttcaggcattccatcacttgcttcccgcctctgcaaaggtcgacccccaggtctgagaagggacagtgtttgcactggcaagagagatctgcagtcttgtggaatgagttgacccagctggaagatcccaattctgagtgccatgtcacttcctttctccttcccaggatgcagctaaaagttctccctttgctgtctatgaaagatgtagccctgtacaaggcttccttcctgttgcccagcaacccagagtgggggaggcaaattggcctggagactcggggcgtgactagttgtcaatgcagggtgctaatgggcacctcagcagagagaggcaaaactgcattccgagtgaccttgagacagccactgcaggagttcctagggaaaggagtcccagacagccgtcagcgtgttcccgttccaaagatgtagtcaaaacagaaggaaaaggaaaactgccatcagaccccctgcatttccctagaaatagccagtcatctaccagagttgtcggagatattttaaattcccttcgcaagaagactgcaaagcattgaagagtgaagagcaaatcaatacagtgtttccacagttcaccacccaactcggagataagacagagaaaaaaattacccaaagatttctttttctggtagacgataggactcttgcgctcacgcctgatttctcggcatggaaatgtgcccttagctgtgaacagatcttcatgtttcttgagtccccatgtctctgggaccatgtccagcatcctcctctcacctgtctgtctatgaaaatgggctgctaaaccctctttgactcagcagtctggcagtgtcctgggctcaggttgatactctggcaactgagcagctcacctccctgcaaaaaagaaggctttatttttattttactgcccttttcagatgggtttggtaaaatgtatgaattcagaaaattcaagctggaaggggcttgcgccggctttggttcactcccctaatgcagacaagggactgcttctcgatgacttcagtgtagataggaatcaccccaggagcttgcaaaaaatgtgggtttgggggcatccccgtcccagggatctgcctcagttttctggggtggggcctgagaacttgtatttaacataaactcttcaggtgattctgacgcagacagtatgaatgttgcaggtaactctggaactagtataaataggatacatgcaggcttctggggggtgggtggaagatttgttttgtgtcagaattccttcttggagatgtatgggtagaaccataacctcgtcagcaagagaatctagcaatcttaccagcctgtgtttctttgtcctgctggaattttcctcctgcttaagcccatttttcctgtctttgactcttagtggctccagattacttctctgactcctccttatgaaagctaataaaccaaagaagacttaggagatgcttggacacactaagctgttccttaagcttttttttctcatagacaatatttattgacaagcttcttccttggactgcttatttacaccccttttgacacctctttagaattactgctgcagcatgcaccttcaaggtcatccattgctgcaggagatttagcccattgccatgcagaggcttgtgggaagcatcagttgactcaaaggagctggctgcaatttgtcctgctcctttcagccctgctgccagcgaggccttgcctaagtgttatgaatgttcctcaggctgccaaggtggctgctttcctttccttaagagcttcctttggtgagagcagctagcatttccaagtcttgtatctttctagccccatttcatgccatgctctttttagctctttcgttaacatttccgtattagggaccttcagtgcctgatgtgagctgggcattgggaaggagtcgaaggggatgtcccaggagagtccagagtggggataggtggggaagtcaactatctggaatcacagatgataacatgcgaagcagcctgatctccctatctcaaagtaaaggccatagatgtctaacttaaaggtctgtctatgccacgaatttgcctgacctctttccagggcaaagtgattttaactgaagatccataatgacttttaaaggcggactacaggacaagtcacacaaagtgctgagttacttgaggatttaaagcagttgctttcaagaatactagagttctgcagtaataattcacttcacaaggaacagcacagtatggagcttagagacggagctggattcaagagtgggattcaaaccccactcttgctctgtgacctgggatcagtctgttgctcagtctaatgctctctgttcctccctcaagtagcaatatgtgtaaaaatgatacaaactccaaaaaataacatttatagagcatttactatgttcctaatgttgtattaagtgctttacataattttttaattgaaaaatcacaccaagcctttgaggtctatactattatttgtcccatttcatagatgaaaaagctgaggtgccaagggcagaatctctgagagtattaacatgcctttaacactgtgctgtcgttgatctgtatgttattgtgaggattaaatgagatacatatatgaggagctcagcacagctcatagcatacagtgctcagtaaataagaattacatgtattatatgtttttaatggatggatatgtcccaaatggagtgacttctcaataggaatagatacacttaataatgataatatcatttattagtttttataaacttgcatattatatccccattcctaggaaggctttctggttcataaaaatcactccgccagtaatcagcatgataccttagttgctggtcatttcacccgttagctgtgtcttgatttctacagcagaagtgttgcatttctgtgagcacatgtgcttctgtattagaccaagtgtcttggtgcaggggctgtatttattgctctgtagccccgggacttaaccaggagacctttgcttgcagactgcctggcttttcttactcagcactcaacaggagacttggggatttatctcacagcctgagaagcacgtgggaaaaatagctactcaaaactttgtgaagaaaattcctaatttgctggcttccctggtctgcggctggggctcactggcctttgtgaggcagacgaaggagatttgacaaagagaggaaagaagaaaggcagagatgggacaggaagagcaagggggcagacagaaagttgtgtgtgtgtgtgtgtgtgtgtgtgtgtgtgtgtgtgtgtgtgtgtgtgtgtgtttatatttttctgagtcagaatctcattctatcagccaggctggagtgcagtggcatgatcatagctcactacagcctcaaacaatcctcccacctcagcctcccaagtagctgggactataggcaagtaccaccacacctggctaatttttggtttttgtttttgctgtgttttgtttttgtacagacagggtctcactatgttgcccaggctggtcttgtattctcttgcctcagcctcccaaagcactgagattataagcatgaatcaccacacctggccagagtaatgttttccataagattataaaagtttgaaaccggggagatccttagagagtatctattccaaagtcttaattttatcaataaggttagaaagttccagagaagttaattgtgcaaagttacacagctatggattatgtatcacttttggacagttgcagcggacactgctccagcctgtccatgcttgcacaaatgcatgcatattggtcaactctggcttttggaacatcattgctgagtggctcctggaactgtccctaaacagagttccccacagtcattaacacacacctgcaggagcttccctgccagatccagggtcagcagaaagcaggccctcaacctgctcttgcaggaggaccctttacctcctgagcataaaatcagccctgtaggggaggggtgtgagggagggatgattatgatgacaaggggatgtcccagagccactcttgttttgtcctttcctaatacacagaaaaaccaggctgagccaaatatatcaactcatagatggtgttgctttgttttttttttgtccagttagttggtttgtaattcattttatatggatggatagcccttatcaatgacaaggttttgctttttgccctcctgcaagtttggttctgtaatctacaaggtcattattgccaccttctgaggttgcatttttatttttatttttttgagatggagtctcgctctgtcacccaggctggaatgcagtggcatgatatcagctcactgcaacctctgcctcccgagttcaagtaattctcctgtctcagcctcctgagtagctgagactacaggcatgtgccaccacgcctaactaatttttgtatttttagtagagacagggtttcaccatattggtcaggctggtctcaaactcctgacctcagatgatccacctgccttggcctcccaaagtgctgggattaaaagaatgaaccactgcaccagcatgaggttgcttcttaatgctcctacactcagggctagctcaccttctctgccctattttccttccttctcttcattcctgtgtgcaaaaggcactgttttccagctcagaggagcgaaggaaagtgtgtgtgtctgtgtggaggaagccggcttgacgttggtcttgacctgtctaagtctatcctaggcttcagccaaagaaaagccctggctgtggctattctttctcttctccacctcaccatcctctcccccaccagtacttcaggtttcctggctctcatcaaatttgtactgactttccactccatggacttaggtattcaggacctggccaattttggttcagaaaattttctggatatatatagctggagagagagaataagaatacatgtataatgtataaaggcaggtgatactaccagataaaattatcttcttgagtgattcagtccctttgtatcatgccacaaagattatgttcactccatgagtgtgtcataaagctttgagatatcaagagtgaaaacataaccaacctgcctgcctgcctgcctgcctgcctgccttccttcccacaaaacattctgtattgtgcaagcttctctgtaataccaggcaggcagacctcaaagtttttgcgaggcattttatgacttttatccttctccctcatccactcagtgcaataactatcacacacaggaactatagcatgaacaagacaggcagtctctcttctcagggaaccaacagcctagaggcctgcaagccagagcaagtatgcagatctataaaccaggcactttagagtaagtggcatgagaaaatacgacaatgtgaggaagaaggaagaggtaagtaactgtaggtttggagggcaggtgaatgaatatttgagcagagacctgaaggagtaggagccaggcctgctcaaaatacatttgtctttcgaggagctgcatggggccccggctgccctgggccacctatttagcccgggtttaattccacatgagccttcatctcagaacgggcgtaagaggcagaggtcaagcagctgctgaaagtggagtaacccaatcttgggcacaagttggcctttaataagcatccaggtagccctttgaaaaacgaaacctgtggtcaggtctctgagagcagaaggatcgggtttcagttttaattacaaaaccaaagagctgtcccattttgctccatttcggcttcccccagaagaggttttcctgtctcccatcctgggggccctgacgtgcttacctgacacagagatgggctgctctaggtgcagcacacggagcttgagttggccaggcttgcgaaatggtaggatggaagcagaggccccagatgggatgtgagagcgggtgatgaaaagcatgtgggaggtgaggactgggtttgggggttgttggagttcacatttgtgggctatggctcagattatgacatcacagaaggatgggacaactttgaagcccaggagaatgtgcgtgtcttttcttctcccttgtcccctgcacctggcagaacctctgctcaatggaagataaagcgataagatggggatgtggccagtgctagtaaaagaccccttttaatcgctcacatttttggcacttgctatgtgctagacactggattaagcagctaacctgcattattttgcttaactcggtcagtgtttcatacagcagatagtagcgctattctcatttgatagacgcagaaagtgagcctcagagaggttagataagtggcccaggctcctccgtgagtaggtaatggccggggttcatcccaggtctgactgaagagtccatattctttacatctttgcctcactgcctcttcatgtaagctctggacctgccatcataagacaaatgggaagaggtgtcctaccttcctaaaggcattttccaaagtgatttctgaagatatctgatatgggcaactttccagaattagttcagttgttaaaggtttcacggatgaataaatggtgtgggggatgggggttgagaagaggtcagaaggagagacagcgtggagaatgatttccaaggctggatcttttctttatttgattctagtaaattttaacgaggcccttaataaaatcccagtgcttagcagagcctccacatttacaagttgccagacctggggcggaagaagggaagttggaatcctggcgctcagcttagtcctgctgacctttcacagttcaggcgagccaggcttgtaagattgagcactgcactctgagcagagcactcctgcccagatcaagtggccagaatcctcaccccaacacaaggctggtcccatctccttcgaggtggcatccttcaacgggcacacctgaagtggatggctgccagttggtgagacactggaaggaaatacacacagttatcacaggtcagcagagcttcatgccattttgcttcaggattattacaaaataaagtcttctaggcaatcatcaaaatcctcatctcccaatctataagatgccctttcctgtacccccgaaaaatggctttcatcaacaatgaagagttatcatttgtatttgctatttagtagataataaataatgtttataacatatcaagttataaagaataaaaaatgacaataaaagtggttcctaccttctaacacctagttaaaccaaaaaaaaaaaaaagcaagaaagaatattactctgtttttgaagtcccctatgttgaatgaataaatgatatttttatcaaagtgggcagtgctatacagggggcttccccagaatcatactctttatttcctacaagattcatacttaacaacaacaaaagtaccagcttttgtaatagcaaaaacagctgcagcacatttgctgacaataacatcgggttacttttcaagtgtggttgagtgttttcccttccctttgacctgatgtccataagtaaagattttaggatgtgtaaaaccctgagctctgacagagcaggcccctcctctcccccagcaaatgactgtcttgagtgtgctgggcagtgcattcctcagccttcctcctcgggggtctacaagggacctctgatagtctggcctcattctttgcacggctctcttctccataaatcacctccataaatccacactgtcctcattgagccgcggaggaatgaagccatcttcctatttgtagatgggtgtcacctggcctggaagatgataaaccaaagctttagtagctagacctattacaattttgcctagaagccacaagcagtggagacttactatggtcacctctccaaattaaatcttttcatagttctggcttttttacacactggagagtggtaatgtggagtcggacacgccaaaaactccagggttcacaaaggcttctaagagccattttggaacagaactcggtgatgtcatttctgggatgctggagcctgggccaggctgggactcagaagcaattcagggtccaggagcagagctggactggaggctgaagcaggtgttggttatagcttcggcccttatagacttagagtcttcagtgggcttagcttccctgagccctgctcttctttctggaaataattagacccacatttctcatctcagtaggttatgggaagaatcagatgacatagtccatgtgaaggggcttcatactgtaaagcactctaaaaataaaaggcttttttttttttttttggaaacagagtctcactctgtcgcccaggctggagtgcagtggcgcgatctcggctcactgcaccctctgcctccgcctcctgggttcaagcaattctcctgcctcagcctcccaagtagctgggactgcaggcatatgccgccacgcctggctaattgttttgtattttggtagtgacggggtttcgccatgttgcccaggctggtctcgaactcctgagctcaggcagtctgcccacctcagcctcccaaagtgctaggattacaggcatgagccaccacacctgaccaaaaggcattattttctgatagggatgaatctcattccacagactgagttttacaaactcaggtatgagttttagtccacatcattttgtcaacttaatttctgtttcatgatctatctagggctgccagatttagcaaataaaaatacaggacacccagtacagggcatcctgtaattcactggcaactttagccttacccttccaggccaccatccaggaaaccatggtcaaaatcgcttcagttccaccctcagtctgggccatagttctagggacttgggcaacattaaaataaaggagcaaccaagcaagttaactctggattgccccttccccttatcgctgttcatctggcattgttagggctagcaactctctgtggtcacactgggtacctgagaagttgctgccaaatcacctctggtcctgtgtttgcctaaacattccacaccgccacttttttagggtcttgttcagacaaaattcatgacactaggtcccctttgcaaagcacccagctatgctttttcccacaaaccctcgtttgcctccttcctcctgtaaaactcgattggttcacctctggacaacagcttttggcatttcaaagccagggagtcttgcatgctacttttcctttctgttttacaagttatcatccctgaggcagtgaaggcaaggctgattggctacttgcttgaggaacaagaacagaaaatagatgaaaaataaatataaattaatagttcaaaatatgttccagccatcattaaaattatgttcatctagcatgtatttaattataccctatattacagtgttcctttctcagtcctttcccgccctacatttataattctgggagggataagcatatactttatcatgtctgatgtcttacctgaagtaagtgctcagtgaatgctcaatgaacttgttttggtggcacgcagctacttaacatgacgttaggatgtagcattaatcagctatgaggctgtcactatctgtaacctaagccccttttaggaaaggtagcttctctcagtgataacgacagaccaaatatgacaaccctggtttactacaggtttgttcttcatgggtgtctgggtggggccagggggcctggtgcagacagttgacctggaaagagctggtgactacacagcgtgcttgcttttcggcgaggagggaagagcctgtttgcaaacagactcctacatgtgacatttggcatcatttctcactaatgacatctttctgagagccttgcagagattgtctgctgactcacccaagttacggtcacccagagacacagctatgtgggatctgagaagcgaattagcaggttgttggtctctaaaggtgcaggggaggacatggatgtagaaggggagtttcaagaggaggaaaaccatcttctagtttaatagctttcaaggaccatgtgcacttgctttgtgctctaagataattgcttcctcctaattaacctttcctggtttctcttttaaaaaaaaattgtaattttggctcatattgaaatgttaccttgggtgcagagaggtcaagctgccttggttcaaatcccagcccgaccagctgtgtgacctcacacaaattacttaatctctgaactccagtttcttcatcagttcaatgcaaataatgacagcacataaatacattcatcatgaggtagttggaggggttatgtgagaaaatgtgctcaagtgtttgctgcagtacctggaaaatagtaagggcttagtgaatgtttgctattattgctttcagaatagtttatctgtgaggcaaaggaagggcaggaatactttccatttgaaaaagaggatgcaaggcaggaggatcactggagtccagaagtttgagatcagcctgggcaacatacggagaccctgtctctatttttattaaaaagttaaaaaaaaacaacaacagcagcagcaacaacaaaacagatggtgagacacagagagaccgtgtggctcatccagactcacaagggaagtcagtagctgagccgggagcccctctttctcaatagaaaggtggagctagccgggactgcaggtcttatctcgtctgggcccacctgcccaagaggtctgtggatttctctggctccttcctgatgccagctctagctattgctatggcctcttctccaaacccctgtgcttctcttcatggctagggaagtcaggcccgtcatggctagggaagtcaggcccttgtcttggagcctcctcccagccttgcagcttcatggccacagattatgtggtgacccaaagatgactgcccacaggaatcatttgctttttttcatgagtctagagatcccttttctatgagacccaatgttttctctaactcacatcctcccagagatgatttcttttcattgcaaagaattgatcttatttttgcctttaatcttcatctttccttgtgtgaactttacccaagagaagaataaaattatcattagttcaccaagagccacatagagctgggagtctatcttacatcatggcagaacaatggccctctgcctggtaataccaaaagaaagtgtccggttctccagggatggggctccacaaagctcaggaccagacctccaggcaggctggctgctttgcaaggagatctctgtttggtgtcctataaggcaacagggaaaaggaaaattcacagggaagattaatgtctaaattaatatctagcgataacttttttggccctgagtgcttcagcaagagaagtcatggggagcccaatttcaaaaggcaaaaggtgtgtatgtgtgtacctgcattataactgcattagttaaaggccatctttagttctgattactctcgggaagaaacgctattaagaggggctttctacttggagaaagtgaagatagttaaaactctagcagagcaagtcagtgtatattcagtgaagcagacaggctgcagtgtatgtaggcaaacacatgcagactatacacccaaaatacacacttaacacacacataggtatgtgtcatgcaaactacttacctatccagagattcctagacactttcaacctaatcttattttaacatctattcgttttggatcaaaaagcacgtagaataaggttgggtccaaagggactgcctgatgttccaccccttcatccttggtgatcagggcagagcccctggaattgtcaatgagtcatgatgacagactaggaaaacatccaagatactgagacttggcagtatacaggttgtattagtctgttttcacactgctttaaagacatacctgagactgggtcatttataaaggaaaaaaatttatttgagtcacagtttcacatggctgaggaggcctcaggaaacttacaatcatagcagaaggggaagcagggaccttcttcacaaggtggcaggagagagaagagcaggggaaactgccctataaaaccatcagcttttgtgagaactcactcactatcacgagaacagcatggggtaaaccgcccccatgatccagtcacctcccaccaggtccctcccttgacccctggggattacaatttgaaatgagacttgggtggggacacggatcctaaccacattacaggttgcagttggggggtggggtgggcagggctgcgtgatgagagtagcctggcttaccaagtgcccagggcatgcctcaggcaccatgtatgtgtatccagacactctgcaaaaaggccaaggggctcgactctcatgtccagcaacaggaacggttgggtgggaggcactcaggcttcctggtaaagcagtctctcatttagggaactttggggaggaaaagacaaatggaggtgaagaattaacttttctttctttgaattttcaaatcctgtttctaatagtaaacactaggttgttgtcagctctttgtgcttggagagttgtgtgtgtgtgtgtgtgtgtgtgtgagagagagagagagagagagagagagaagagggggaaagagagagaaaatctttaaattttaattggtctgcaatggaagatttaactgtttaaaaaacaaaaccctcttggtcccagaccacaacttgtgtgtaatgtgggaggctggggaatagtgaagaaagagggaagggaggggtagattcctcatggctccacagggagtcgtgttgttaagggatgaaggaaccagccatatggacagtagaatacaatccagatctgccaactctctcattgtcgcatctcttaggtgaagaagctaattttttgctttttgtattatcctataaataaaatagatgattagagaagagaatgctttaaggtttaccatatacccaaattcagaggatggccaggctggttggtagttacgctgcaaggccctgaattacagtaagacagcagtggccttggggaccaggcattaccacttggtaggatgatttttttcttgtctgtgtcccctttcacttagattatgaggccttgcaaggctggaactgggcctgccttgtccaccacaaggacaagggcctagcacagtgcctggcactgaggaattgcctgttgaagattcgacagcaaatacctgttgaattttctatgggcattttggggaaagtataaacttgaagttcctatggccctgctgacttctatgcactgctgtttgtttgcaacaccaaccttgagcaataacataggttgcctttgaagccttttgcgctgcgtttcccccagagctccaaaggcgcagagtgccaaaggcacaagtactcaccagcaaggcaagtatgatgtctgccctgcttgctgctgtacctgaaactctagtataaagtgtctggaacatagtaaatatttgtcgaatgaatgaatattacagctgtgtcctttgctatatcctgattatgtagctgaaagatgaaagtagggatatacatactggtaatatcatgagtgtcatttgcaaatcctttccaaatggtgttaaactgagttgaatgtattgtctccattctcattcaaccttggcccaggtcatcagggaagatgctggtggtgttgctgatgatcatagcaaccacactggttataatgtttaccgttcaccttgccatgggccaggaactctcctatacatgttacatgcatcatctctcaagtgtttgtagccactccataatgcggacgttagattctctgttttacaaaaactgaagctcagaggctgttgtagtcagctcaggctactgtcacagaatataggcctacctgggggatattatgggttccatttcagaccactgcaaacaaagtgagtatcgcaataaagtgaattacacaaattttttagtttcccagttcatataaaagttatgcttacactgttccatagtctattttgtaacagcattatgttttaaaaacaatctgcataacttaataaaaaatactttattgcttaaaaatacggacacagaaacacgaagtattcctgctgttggaaaacatgacaccaatagacttgcttgatgcaggttgccacaaaccctcaatttgtaaaaaagaagaaagctcaataaaacaacgtgcgcctgtaccataaactgggtggcctagacagcagacacttatttttcacagttctggagactaggaggttcaaggtcagggtgccagcatgatcagattctggggagggccttcttcctggcatgcagctgccttctagctgtatcgtcacatggcctagagaaaacaagctctctggacccttcctataagggaattcatccatcatgaagattccatcttcatgacctcatctatacctaattccttcccaaaggctccacctccaaataccatcgtcttggtggttaggctttcaaacatgaattttagttggacacagacatgcagttcatagcagaggggttacctgtagtcccaaagctacgtagctagggagacgcagaggcagaattttcactcaggtctgttgagctgagtccaaagccccttctctcctctctgcatcacgctgagcagtatcatactcagcgcttggaggaaggcccagagggctcagtaaaagcagctgaagaaaaacaaattggagggagtttattatggttgatcttaaaagccttgtaatgaccttattttctccagaggacattctgaaagccagtgatttaccctggcagcccagctgggggaagatgtccaggcagccagttccccctacctgtgcctctgggcatggcagaaccgaacccagcagggactcccgaaggagccattcccatccacttttatttctctgagatgcacagaatatcagcccttcgggtttcgtgttgttctgttttttggtgtgtgtgttttttttttcccaaaacagtcgtgggcttctagccaaaagtcctttcaattaatggactaggaacagcacccatgaagaaaattaaaaacagataagaaaagaagggccttcatgcgcagagtagaggaagggaataattcttggattatgctgatgatttaccaatgttttcctaacgtgagaatcagtcagcaggggcctgggttttttatggaagaggaacctcttccagacagctcactccacaacaggcctgataaatccccacatccccacttccagcgagaacgctgccccctccagagccaccatgtcaaagcctgtttagctgttccttacttatcagccacaaccccaacattagttcatgcttggaatatgaagccatttcatatttattcttgttatatctggcaagaagccttaaggaaaaaaagagagtcccctgttggtgctgttcagctcttatatctttatagtctcccaaattgatttgacagggcaattgcaggccatgggtgagacgaaactcttctctcagaaaagtctgggagactaggcacaaatacacagcccactccttcagcttctgccctgagcctgtgttcacgtctgtgttcacatctgtgttcacggccactctggcccctgcagaccaatgccatagagtttcctcgtgtcaattttctggtaggagcctctgaaaagaactagggtatcggaggagacgttagcaatggaattcaccacaggacattctagaagctgagcagggtcagactcccacagagggtactgcagacactcagtaggacttcaaggccacatgagctttgggaagatgtactgagtgccctggtctgcccagaagctagggcccatattctgcaagcctcagatgggtcaaaagagttttaatccaaggaatagtgacaacttgaaatgatatgcaaagtttgtttgtgcgtgctcagacacactgagtattctaggaaaaaaggactagattttactgcatacatatgtagatacatactggtaatatcatgagtgccatttgcaaatcctttctaatggatttagtaggtaaacaaaggaatctatgaccccagtaagcttaagaacctgtgagcgaaggcagccttcccccaaagaataagtgccccactggtagtttgagatgattttaagtaagattcagacaaacttcttcttttactaggcatatacttgttttcatacagttaaaacctatatgtaactaatataccaagtttgtaatttcacagacattgcagatcaaggtgaggataaaacagatgtttaaataagagtcattaatggataaggtaaaacaagtaaacagtagtacaagttttgtgcctctatggcaaaattagctaatagtgagaagagactgctaaagttagggaaatactttgatcaaggaagaaaaacacggaaaaatgtagtcctcatcccctcttgtcccaaatactgagatgtttctacattagagcccctgtttctagtctcttccactggttgcctgcacaccattgccattcccatactcactcactccacgtgactttcctgctctagactacacaatggctccctgtggccatcacattctgtccacactctctaactgggtttgcaagtccatcctcccacctgatgtcatctccactatttcctagttctgaaactcttcacttcccagaccattcttttcattgtctgctccaaatctccccatctgccccatctgtactcattgatgccccattgctttttctttttttctttttttttttttttttttttttttttttttttgagacagagtctcgttctgttgctcaggctggagtgcagtggagtgcatcctggctcactgcaacctccacctcccagttcaagtgattcttctgccttagcctccctagtagccggaagtacaagcacacaccaccatgcctgattaatttttaatttatttttatttttagtagaaatggggtttcaccatgttcaccaggctgttcccgaactcctgacctcaggtgatctgcctgcctcggcctctcaaagtgctgtgattacaggagtgaaccaccacaccagccacattgctttttcctataattaccttcatacccccatgctccctattcctcttttgagtcccctcctctccctactctaaaaacctaccgtttgcagttcccaccaatgtctcccttctctggagtactgctgccctgcaattctgtatgtcaaggggaaaaaaaaaggagggagactttggttaattaccacttcacttggcaccaggaagggtaggctaagagaggagctatagccaggagtctaaaacttttcttttggcttgtttaaattgttgacaaaaatgggattagtttgagattaatcactgaaaaacaagggagataaactcctgggttccagagatattaattccttggttctcatcccagcttaggttatcaaaaccaagaattgttcatttttcacagtttatgaggtttatctttggcctgtcatgagatgctgacagaaaaatgaaattggtctgtttctagtctatttcactttctcattcccactctcataacaagtcaaaatgttccattgtaacacttaaggagggaaaaaaaagacgtgacccgcctatgtgcctgtacttcttgtcattatttggtgtttttttattctaaatatttttattgttcaagccgaactcaaaagataggtgcctctcccttcatttcaagcagaaagtgaattttaagtacttagtaggaaaagttgatggcaaattaatatgtgggggtggtttgagaacttttcatttttctcaggataaggcagacaagacaggttcaaaatacggacagtggcgatgagctggaagtgagaagtttcctcagaaagggctgaaagggttggctgagaattttttttcatttcatcctcatcagatgctcatttataaaaatagcaaagcacttggataaatgtgaaagtggtttgaaatgtgaaaagtactatggatttgcagaaagcatctttttcccattgaatgggattatttatgtccctctgtcatatcacaactttcctaacaaataagatgacaaagtaataaacttcttccaggggagccattcagtgcagaattcactaagaaagctttccgacgcaactcaaataaccgcttggcaggaaaagttatttgagagagattttagaactgaaaaccccaaaaaagaacatctagtataaattaaataatgcttcaagaataggttgtcgggtcagttgtaattgaatagccagcccatcagtatttatcagatgcttactgtatgctcagagctctaataactgtcagccgtgtatctttctttctgttgctgtttgtgtgaaggtaatttctgaccattcttcagtgagtttgatactgaccagatctatcacgttcaactctgtatcatattattaacgtcatgctctgacttctaacacccttaagtttttgttatgagttcttatgtaaaatttttgttttacataagattattgtttttaggttattgaacactttctgtgagttttttattgttcttctctttgagtaattcttcattgtaggcttaagcgttgatgcaactgaactttccatttcagaaaagattacgttaatatcctttacaaatctttttttttttttttttttttttttgagatggagttttgcttttgtcacccaggctggagtgcagtggtgtgatctcagctcactgcaacctctgcctcccaggttcaagcgattctcctgcctcagcctttcgagtagctgggactgcaggcacacaccaccatgcccagctaatttttgtatttttagtagaaacgaggtttcaccatgttggccagaatggtttagatctcttgatctcatgatgcgcctgcctcagcctcccaaagtgctgggattacagccaccgcacccggccataacttcttaataatgatcgcagcatttgttgagcactgattttttgtcgtcaataatgatcgcagtatttgttgagcactgattttagcaagtgataggcattactttacttctgctatttcctaagaaggatggggatacccagaccccaagtggaaaaaatcatgaagggtctttgggtcatctccctactccaagccatgagccacaaggccatcgagctcaagaggaatgactgagcagtccagcaggtccacttttgcatgggtcttcccgtgcaaaagctcccaggtgggcgtccactctgtacctgcagccccagggccggccctccatggtgaagccagggctgcctttgtgagtcccgtggctgcatatcctctgtccacattcctcggctttgacagtgtgaggcagggacttgggctgtgtgcctcctctgcagaccttcaccctctcaccctatagggacactgtccaaagtttgtgggaggcagcactaggaagccaatgtgagtggggaccagatccctgagtccttcagaggagttcatcagcaatggagcccatgttctggtctccatctgcctgcttcacatgggtctggaattggaaggggatggggatatgattagttatcactcagcaccccaaaatacccacacaaggctctatgtagctgtgctgttttatttgatccaacaaccttatgggatgggggtaattattactgtttatccaatcagaaaaccaaattaagagaggtaaagccagcagcacaagatgaactgctgcagatccatgcctgcagatctgggattgaaacctgactgtatcccactccagagccagaggtcttgaacccattaccagaggctctcatacttggaagttcattcattacctcctaaagggtgactcacctgtaatcccagcgctttgggtggtagaggcaggaagataccttgagcccaggaattcgacaccagcctgggcaatgtagtgagactctgtctctaaaaaaacaaatttaaaaatagctgggcatgctggtgcacacctgtaatcccagctacttgggaggctgaggtgggataatcacttgagtctgggaggttgaggctgcagtgaaccatgatcactccactgcactccagcctgggcaaaagagcgagatcctgtctcaaaacacacacacacacacacacacacacacacacacagatttctgggtcccctcccagaatttctgattcagtgggactggggtagggcccaagaattcatatttctaacacattcctaggtgacagtgatgctgctggtctggggaccacactttgaggacacatcttttcaccctgttcaatggccttttgttttgttttgttttgttttgttttgttttgttttgaaatggagtcttgctctgtcgcccaggctggagtgcaatggtgcgatctcggctcactgcaacctctgcctctcgggttcaagcgattctcctgcctcggcctcctgagtagctgggattacaggtatgcgccaccactcccagctaatttttgtatttttagtagagacggggtttcaccatattggccaggctggtctcgaactcctgaccttctgatctgcccgcctcagcctcccaaaatgctgggattataggcctgagccaccgcgcctggcccatttcttagttctaaccttcaaagtttactagtacatggggtggcatcaaaacattataactagaagagtaaccttaattggatgtttaactaaaatacctacaaccttgcatacaaggcagaccctttggaggcattttggaggtggtgctggttgtcctttctatagctgaaaagaaacaaggaagggatgaaacggatgtgtttcatgtgttttaagccatgacaaagtatttcattcttcaaatacattttctggtggcattttattctagagccaatctggatgactttctttcttgtaactctgtgagatcagcagccatccctgtgtcccaagtgactcccacagtttattattgagagcttccacctggctttgaatatgaacagaggagagagagggagggaaggggagagatggagggagagagagggcatggggcgggtagagagagagagcttggcctcaaattctgggaaaggttatcacatgaagaatggagccctgatctctttatagacactacagataaagccatgcaagggttgcggtggatgtgaagtgccaaggacaaactcaggtgtgccagaaataccactcctttgaacctgatgttgacacttgaatccccatgtcataggctggttggaaatgccgtgccagttgctacctaggtcttctctcctgtttcccttccaggacccctcccagcagagttaggagtttgcatggtgaccggaaacaaaggatggtcatcagcagtcccagatcacccaggcccactgaggtctcctgcatgcagcagctctgcatttctgggcttggatgagaaagggaatttggggcaaggcttctagaaagccacgcggccatgactctgtggggtcttttgcctctcccaaatccttgggccccacgcatacctccctctacccccatccctttctagttttggagaagaccctccctctttcagttaattctattctttcacaataggacttgattccacaaacccagaaccccaaatcctctttccagggggtacagaaaagtaattgcagtctctccctctaaagtggggggatggggtaggaaaaacaacagagctcaaatttgacacaaattctcagtcgaagtgtttgccccttcccaaccctccaaatccccagggagcctctgagcccagcttttcccaggtcccagtgtgacctctcaggagaccagcttccagaccctgtgtctgggaaggtacaggtgtcgctcttagagaaggggcacgcgatgcgtcacagtcccctagtgcaccaggcataaaactgagggccacaggagacaggattattgatcaatgaggcggttgatccctccctttcatcatgatttcttgagagtgcactaacccggcctgacagctgtgaggatgacccactcacagagacctgcagcagtcaagatggtcctgcagaagctgaaaggatcctgaatgtaaatagaccatgagccacattctcccacacatcactcctccactccacccggctcaggccacccacctcctgagacaggcctgagactcacttgcttttgcatcccagcggaagccgtaaaaatattggtagctggggcccctcaccgtcaggagcaccacttcctatcacctcacatggggattggatggatgacctgatgccaagtcactggccagcccagagggacatgaccatgtatgaagggccactaaaaaatccgctgctgtaacattcatcagtgaaatgtctacaagccaagagttgttggggatcgaaatcaatagcttcttacgtgtttctgaatttactgtggcatcacgaagcgcttgacgttatatccaaagccccagatatatgcaaacaagcccaaagtcactggaagaagtagactatttcttttgcataggtttggggcagggggacagtgtacctagggaagaatattttattgatgttcattaaaaatgaaactttagctccattttcccctcttcccttcccccatccactgaaaatggaaccatttaatgtcaccctggtgtgaaatgggaaaggatagttggagctcagatgtccctctgttgacttcagcctaggtaaatcatgtgtctctcgggaggaggcctgcaggtcaggctttgcgagggctgtgcttgcagacttaatgcctctctgtttgttctccctctgaaagggcaaaggcctcccttcaagaaaagagcttctcccagcaacagaagtctccccacacccttccctgtcccagctgccaccagccacactgagctttgtggagctcctgccctgtgcctggccccgtgctaagtgctatggtggatatcattgatctcagtgtcagatgtctctatagatggtcaccaactgaatgtcctggggtgggagggtgatggggttactcacggttggtcaagaggaaccagaaagaataccagtgctttgggaattggccacaattgccaaccttctcagggaaatcaaacatggtgctgaagctttgtatgagaacagaggcccagatgtccaaggctgctggccttgccactgaggagttgggctgtgtgcagggttggggtcccagcttggtgctggtttgccaggtgagcaattacgccagaaaggagacagggaagcagagggagcaggggaagctgccatcggagaccacaagttcccaatccttggaaactgttttcgtctgaccaatgaaaaccgtttattttgcaaatgtgtcaaggggctcctttcaggagaagaaccttcttgatactgatgattctcagttttctgacagtagattacccaaggttttgggtttttcccctcataccaacgaacacaattaaaagcactttctttcatcacttaatcattgagtacctggggaagacaaactagatttagaattagcttgtgcaagcatgactaaggtattacaatgaggaatagatactaaatgtaatcgtttattaaaatcatgttcttaatttggtggcagaatcaaagtgacttttggcatgtccatcctgttggatgatctaagtggctaattcttccctgttctactccacactaccccctttgtagaccagccttaaacagctcctttgtgaacattcttctgctgtgagtataggaaggctttgtttgctctcacactgggtcaatttgctggttgcacagtggagatctgaaggtgcaatatgcgtgctgtggttgagtgacgtacagaagatgggactcttaagtaagatcacctggtatgagccctgcctatatcccctactgattgtgtgatcttaggcaagacaccagatttcactgtgcctcagtttccttatggaaaaataggcataataatagctcctaacttcataggcttgttgtaagcattataggagacaagacatgcaaaatagaatgccagggctgggcgcagtggctcatgtctgtaatcccagcactttgggaggccaaggtgggtggatcacttaaagtcaggagttcaagaccagcctggccaacatgctgaaaccccgtttctagaaaaatacaaacattaactgggcatgattggtgggtgcatgtaatcccagataggaggctgaggcgggagaatcacttgaacctgggaggtggaggttgcagtgagctgagatcacatcattgcactccagcctgggtgacagagcaagactcagtctcaaaaaaaaaaaaaaaaaaaaaaaaaaaaaaaaaaaaaaaagtagaatgccagacactggtacatgttagtagcattagatattattattctgtttgtaaccactttgaccagcgaatggcaaagctgttagccttggaggtaagatgggatttatgtgggtgtgaaaacagataatttggttgggagtaagaggggattgagatggacagataactaaattctgggatggtacctttcgcctttatggggtatgagcaagttccaggtaggaaaagtgtggaaaataaatgtataggacaatgtcaaccttagggctggttttctgtaggattccagaggatgcctttgattctcagtaaaccccagaaagccctgagagaggctcttcaccagctccagcagcagaggctcctcccctatcccagcactgaggattccattcaccttgtttttctttagggtcatgactcttaccaaggggttgtggagtcttccgaggagccacccagctgtcccactccagggcctctaggacaagggtgtctgcagacagcctggtaaagtctttttcttctccaccgtctcctcctacagccacacaatgagccaatcaggggcaaggttgcagctggaaccctggctcccgatgtcttgtctgcatccctcatacccatcctgggcatcctgcaattcccactgactctagaagccctcagtcagctgctgtgagaaactgacattctgtaaattctgtgttttgcctttgttttgtttgtattatgttataacatcaagagaaacccaagggctttccccagaatggggaaaaagcgggatgattttgatcacgtggctctaccatttactcagtggggaagagaaggtggcccctgaccaggaacaaggtgatagatttctgtgcccgtcttcactttgtgtcttgtttcttttctgcctatcatcatttagtcaggagtttttttttttttcctgtgtacttagaaagtatatgagaaaacagaaactctttccataaatcttgttaggagagagaagaatcctgtagttacttaggatggaaaatccttctaagacaaaagggccttcagagcaggctgtgggagcacattgagcccacagagagaggttgacccccatgggggattttgtctggcctttcacttcctaataccttgttgtccacatctgtgtagtgggtctccatctgtcctgcctgcttctgagagatgacagagggagtctctgaaaaagccaggcgtcagatcctgtaggcggggtgccatgggcatggcctggacaagtgaagcctgacatgtgggtgctctcctccggacccggagcccccctgagagtgcagagccctgaccctcacagcagcctgtcagcagcgcctcgagcacctggctattctgcgcttggctgacatctcgggattcctcagtctcttaggagaaggagaggaaatgtgtgttttcagtttgggaaggaagacacacctctaaatgtcagacctgaggcttccgataagcccataggatattttcatttcggaactgaaaagagccgacccaaacacctacctactgaggcccatgaagctcacactcccagagaggttcaggggtaaatcttgcgccgcgtcaccctttccagtgaagagacggctttgaagcttgcgcctcgctctgggctcattgttctgcgtgtaaagggcctttgctaacacccactggcattttctagtacaagggaacactgtgtcaacctacatgaaaacggaaatgctaatgcacctgggatttgagaccacagcgccccctccatgttcagtaatcctggaggcagcgactggaaaatacattccatgcagcacagattcatttagagcaatgtctttcagactctgtcccttggaaccctgaggttccacagaacacatcagggactggggcagggggacagatggccgctggaaatgggtgccctccaggcctgagcaggaccccaggccttcctttccaacctgaccagagaacttttgcttccatttttatgctgtggttctgcacacagctccattcaacagaaggttcccctgctttaaaaaagagtttgaagacccttggccgaggtagaggctctattcaatctataattctatttacaagacaaaaataaataacctatttataaatccagcttaattagccctcgcataaagtaaaagtaaacctcagcagaattctacaggattcggtcatcataattctttctcctccttcagatgtagttgagggtccttgcgtctgtcattaagctcctcactccccattcataaggctgccttgtactttttgaaggatttccacagactccttggctgggagcgtgagcaacctcaaaaaaccttcaccagcccgtatgaagtgtctgactaaaacgcaggaggtcattctcttttctgccaggggcagcttctcaaacacagaagggtggctcaggagagggggtggggcaggggccaagtccaatggcaaaggcaatggctttgggccaaagggtaaaaatgcttgttttcaggaaaattagaaaaatttgcctgaggcaggtcccacttacacactgagttcttatatgggcccttttatattgctgtttactttgctttttaaattaaaaaatcagtgcctgccagtcagggggcctctccggccctgaaagggtctgccgttgcccccaccccagctccccaccccaggctcctgggtcagagactgatgggaattgggcgtcaagagggaaatgtgtgggttagaggcgaatgtggagtctgggctgtttttctgtatggtaatggacaagccagggtggccattctgagacaggcactttctcctctccagtctctggggtaggcctttgaaaacaattgccagccagaatgactgaaagaattttcctggggatcctgagcaaaacctctgagagaagggggaggctttccctcgtcctccctgatagatccccagggcactgcattccccaggctggcatttccccactcctgcctacaggtttgctgctgggggtggtgggggcagtggggaggccaacatgggaagccactgtttgtgatgcctgtgactcagcccagcttctagagggctgtggcccacacagcacctggggctcccgtgtcccctcccaagcctggggctgtaggctctccacctgcttcccagccaggcaggtgactgccccatgctggtgagagctgaggccttggagcaattcagactctattcctaccacttcctcctttggaggcctctgagcctcagtgttcttagctcaaaaatgggattacaactacaatttgcttgataaggtttttggaaggacaaaaaaagagacaatctttatgaaaccccccagttcagagtccttggcacatcataaccactccccaaaacattagctattatgagttactatagttagatattcttgatgggaagcaagtgcttctagtatagtatctaataagagcacctcccagcggtgccagttgctagctgtgtgatgtcagataaattcctttacctttctgaccttcactttcccccttcacagaatgaagatgaccattcccatcccacaaggtgacagtggcccaatgaaagcagcaaatgcaaacaagtacttagtgcagggtctggcacttggcaaacaggcaataaatgatagctgctgttactcgtggcagctgtcgtgtggcattctccaaggacaacataatgttattgggttttgtttttctctaagacctccctggagcgtgttcttgcagactgacccagcagtcagctgagggacattactaacccacccaagagggacaggacctgcctgaggtccctgtacctgcacacaactccattcgacagaaggttcccctgcttttaaaaagagtttgaagacccctggctgatgtagaggctctattcaacctataattctatttacaggacaaaaataaataacctctctgggtccccttcactctccctttagaatgatgctgttttgacactgggctggggcagggagataattgttttaaatttttttattctcatcaagtttgagagaatgcttttaaggctgtgaggtggtcatgaaaggtagagtgagaggtgaagcccgccatgtgaaagtgaaatagaattgagaagatctcacgggatctgaatcacttcaaacaaacaaacgtttagcattcaaacaaaggctttctgtaaaggttttagagctggggctggagtttcttaccctgtcccaccctcacccttctctgtgactctctcctttgttgactggggatgcagggaagagaggagagattgtgggaagagaaggtggctcgtggctatgctttgcaaggctgcaattgccaagggtgcaagatggacatcctgatggaccctgatgtagaaatcttgcctcagttggactgtagtgagttcattagacaatcccatcctctctcacatcttcaggggaatggaactaggaatctgccagcttggcctgagaagagggccctgtcctgaacccacatgaatagcaggataggcggccgtggaactttgatggctgaacctggactttcttgtttactcagcttaacctcttgactataatgtgccaactacatatttattcacagaactgttagagataaaagggacctcaggggacattcaacctggccccttcactttgcagaaaacggaaatgaaacttcagatgggtgaataacttgttcaggtcccatcctggtttctggcatcattggggtgaaaatccagatctctgagctgattttctacgtttcttgttcattctctctgatcttctcgttttagggtggctatgggaacagtgactaccaattactttcctgggtctttgccctgctttgcactagtttgtgcctgcattttccattctggtggatgttggttaccactcagatttgcctcactcttttaggatacaactagttcgcgctttagaactttcagaattacattagatgcagagatgttagctggaacttgtcacctcacattctccctctgctcgggctctcctccttaccccaaagagcgagacaagtgtggcaaatcccacctgaaagtttgctgcaagtctcctgctgtgttttcagcaaattcatttcaggtggctgtgcctaagtttgcagctcatcttctattttgtagaagaatcacttgggtggttccttcctctcataggtgctttccttccctgtcaagtttgttttggaaaccaactttttaaactttttgttactaataagaattttgttttgtgggaattcctaaccgaaaacaaaacaaaagatcatttcctaaggatgtatgcttaccatattccgtcttgtatggatttgcctgcttttcatgtctttgcaaaagaggcattctttctgttctgttctgcaaggctcctgtatttggtgtagctttctaataaaatacttgaattcagtggtgtgtctctgaggcaaattaatttagtgccatggttgagactgaagatgtaaatgtccaataacattgagagcaggagtttgctttagcaggatttgttaatgaaagtacatccagaaactttcactttctgcagtgaacagtgaggacaaatgctggcctggctgagatggggagagtggtgtgccaaggagatcccaggagagagatgctgattcttttctctggaggcaaaacccaggaaggctttcgaggctcaattctagtgctgcctgcccctgggggggggtctcctagttgattctcctccagtgtgccaaagtgagatccgtgaagattttccatccaggtgaaatttaaatcccacccattcacccttttatataacgtatgcatgttaattgcatccctaagtatttggttggaagtttgctttaagttagatctcgcagtcttcctgagttctgccctgttttgctatttcccagaagctcttttgagggaacgtccaggaagccacacaccctccttctataccctgcagctccaagtggtcgggagcccttggaaagagctgagagttagactcaaggatctgggtccttccctgccagcccagccatgtgacctgggcaagaccattctactctccccatcatgcaggatctgagtgttgtctgtgttcccttccaaatataaaattatggaattgtaggactttgggaaattgcatgtccacaatttctttttccatgggaaaaaaagggaaaccatatctatggagttacagtggagatgtagcagagatgccctagagcgagcaaccatctgtgtttgcctagcacggaaggattttccaggacacagggcttcccgttttaaaacccagaaagtctcagacaaaatggtcaccataggtgcacatatggtccattcaccagactccctgacaccttaatacaggtgcaggatggcgaagcccagcctagggaggtttctaaaccccgcaggctttctgatggagtgtggctgaaagaaagggggagacaggtgccagccacattccctagaagagaacaccttaatgtgcagttgacttgtttgatctgcttcagctgtgacacagtggtcccatgtgtacaggtagtgcactcacagaaaatggaaccaggggcctatgaggatattcagtccccccacctacctaacaccgaaaaagaagtcatctatatattccataagaaatcatttcgttctttcccgttctggaaataaaagcttcctccataatgggtgggctgccaccttgtggccatgagtgggaatgtgggaaagtacaggtaaccacagaggactaaatgcctctgggtttaaatcaattcggttcctatagggtacgaggcagtgagctagatgcttgtgtggctaagactatcattatgttaccaagggtagagctttactgtgtgcatgtgataaatacgcttagcagtttgcatgtagtatctcctatagtgtgcttaacaaccctgacaggcaggaatcatcaccattttacagatgaggaaactgacactcagaggttaagtacatttttaaggtgacacagcaaagagctaggatttgaaaccaggattggctggccctaaagctcatggtctggaccactaggctatactgctagagagattagcgtgaatagaaaaataggaccacatagatagtctgggtgggagaaataggtcattgtgaatatgtgggagagattaacttggtgaacataaaggaagaatgcaaagcagggagtgactctgacatcaaaagcagtggaatccagagtaaagagggagagagaactagagttgtcaggattccaggttaaggggaaggtgggatttgaagtagctgttgaaggatggataggaatcagatcaacagagagagctacagcttagtgaccattaataagctggccaagtccgtgtttgataaatattagccttcttttattttttgagatggaatctcgctctgttgcccaggctggagtgcagtggcatgatctcagctcactgcaacctctgcctcccgggttcaagcgattctcctgcctcagcctcctgagtacctgggattaaaggtgcgtgccaccacgcccggctaaatattagcctttgtaaacaatgtgtatatcatgagttaaacccacactaaaggctttttatatatgtatctcattaatgtgcaaaggccctgcaaggtctttgttgttatgacccccattttataggtgaggaatctaagcagtagagaggtggtcactcacccatggtcacattcataataaaggagtcacaatgtgaacccacgtccttctgactccaagcctgtgctaaaactgcttgtggtggagaaaactcccactagcacaggaagggagggccatgctcacagcatgcctggatggtccaggtcatgcaagttatgataaaggagagagcgtgcaggggtgggatggacgaggacactgagaatggagatgggggcctggatgctgatgttttcgctgataaatatgttgaagcctctccctgcagctaccaatgtaccaatgtgagctgaaaagcatcatggtacccaaagggagaggagggctatggaggccatgtaagaagggcgccaccgtccaaatatttcctttcccttatctacaccactgggaagtgcggtgcatggctccttcacaaactgaccgatctcaagtgggttaattctccccttttggcctccatttcatcatctatcatatagggatcgtgatttttgccctacgtcatgaaatttgcctacttagcatctagcactgtcagggaattgggagaaccagacgtaagaaaagacatgaaagaactgaaaagtatgaggtatattacatattctgattttgtaaactgaatgcatatgccttttgagaagactcagtgtcagccccttatagaaggcatttcttcgtgaggctggacgtttcatttgaaaagccttactacatgatgaagtgcctttcagtcacaaggttttagggaaagcaaacccaagtttaaaaagagatgattgacttatgggtctgaaaagcttgggagtgcggcactcccaggcatgatttaaccaggggttcaaatacaaccaccatactctgtctctgtatctctcttcctaccccccgccatcatccctcctttccttctcttgttttttctgcattggctccatttgcagagaggagccctctcctcactgtagcaagacggccaccacagctgcaaacctcacagcctcccggttcaaggtgagtctttgtccctgcattcctgtgagcacatctgctcccattggctacagcatggtcacgggacagagaatgagaaatgctaattgccttagcccagaccacatgctgcgcccaccatgcataggaactgaaattagggaggagtggacctgcaaataaaaatgagggctgttgcagtaaaacacagggaaagaagtgctgggaaggcaagcagtcaaccactcagttgttcccatgcaccatgattgcttttctccttggtttgtcatcaccaggacacagactccccttgccggaagcaaagcctttgcatctggtttgctccacggcagttcagagattgctgaagcccaatctcatatgacgatccaagatcttaggaagtccagaaaaatgggcaggataaccttggaagccaagatggcatattcgtggctcagttcagatggtacaaggaactaggtcctgactcctgggctagttgtggaaaaagttcaagcgatctttaggttcagtttaattccccacccaggaattgaactcttcctgcaaggtgcaaagcccagggtggccacggaaggaactctgaacatccctgatcttagagaattcatgtctagtagagaacacagttgggggtcaagtaattgtcattctaagaaatggcctgaaaattttagatgactcccttaccggtttcttgttgctttcctcttagcatttctctcctatgtgtgatatttctggatcattacttctcaaagtttattattataatcacctggatgcttgaaagtgcagaaatagaggtcttactttagacctcctgattcagaatgggaggtgcagagagcagcaatctggtgtttaacaagcagcctgggttgataaggccactaaagtttgggatgtttttctgtgatgtatccatttttcctgtaactcacagtttaacacttaactgataatcagccttatattacatttgtttgcctctaaattctgaaagtagcccattaaagcatagaaaacagtgtaaaaggggcccttctccttggaaaagtagggcacaagtggttttcagagttaccctgacattttcacagcaagaggtcattaggccccatgcagcctcaccttgatatttcagtggggctggaaaaagctttcccctgttgttggtcttatacagacagcttggaggcccttaacttcacaatgatcagaggcgataatggttaaaagacaaagtgagccaaaagagagggtattgacaggaagcatgccaggtgacttaattgaatttgggcaattcagatggggtagctggttctcatttaggaaatgcagattgaataaccagttctcttgttaaagagggcgatgcaatttgaggagctctgcatcaggcaccgacgggcccagccagtccccacattgagttcttgcccctacccgtgctcaccagcactttaatttacttgagatttgcttttccttcctcctttgaaaatttctaaagttctatcattatttttaattttatggtactcagtttcaaaatcaagtaatattctagtttgttgcaagtacattttacagtatttatattaatacttattttatccattatttttccattaaaaaaaatatatatatattttgagacagggtttctctctctcacccaggctggaatccagtggcatgatcatagctcactgcagcctcaacctcctgggctcaagcagtcctcccacctcagcctcccaaagtgatgggattacaggcgtgagccaggcctctcttttcttttctagcctccttttaagatagtaatgatgtcttaatgtcattttaacctaagactcaaatttggggagtttggttcttttgagaaaggaagaatttgctgtgatttctctgctcgtatcatacctccaaaaaccttttggaaatagattatactgttttaaataagtacataattataacagctaatgtttactgtgcaccaagcactgttctaaatgctttataatttaatttttatttaccataatagcaggagttaggctcccccattttgcacatgaggaaattgaggcacagagccacttatgtgattttgctcggggctcacagcttagaacagagcaaagaatggacatcagcctctgcccttctccaccactgtgtgctaccaccccaaaagaatcttagctgcggagaaaccagacatcaaagtcccactgaggatttgtgatatttctgatgaagaagatattttctcccatcctaggggaacggattgcagggcttaggtgaagaaaactgtagcactaacttgctactgatttatgtgaaaagataaattggcaccagacagggaaatccctggctttaggtgatcttggggagtttacctgggggataaagcttgtgagatctctacaaagtgagatgcattttattgtatagaaagtgatgttttgatccctaagttttctggagccagtagatatcaggaaatctgacttagccttttgacattcaaatccatcttgaatgagaatggcaatgtggcttgagacaggagcatcaattcatccaggtcttcaggtcagcagtatgaccccttcttgcctttcagttttaactattccatgacttcaataacatgggaaaatacatgattattctttctcaaaagaaactaaaaatgtttcagtgaaattacaaggcaacaagggaccatggggataatgattgtgtttgaaataaggtctcagagccagtacaacaggagtccctcggcataaaataacaagattacactccagaaatatctcaatccattaaccctccatcagtttagtccaaagagattcttacaaggccctgatgatccttcgaagcaccactcagctagagttttagttcagagacaaggctgtaccccaaatgtcagctctagtccactcttgattgtcttaattaataaaaactttgtgaggactaagcccatgagtcacaggcccaaacctacttagtgcttctccaattatgtgtggagatggatttttttcttaaaagactgcaacctatagactaatacatttgtaaaatactataaaaataacttactagaaaaatgaaataaagatattgttttagtctgttttctattgcttataacaaaatacctggagttggttaatttgtaagacattaaatgtatttccttcagttctggaggctgggaagtccaaggtcaagggggtgcatctggtgagaaccttcttgttgttcaagactctctgaagggtccttaggtggcacagggtatcacatggagagagagctgagtgtgctagctcaagtctctcttcctcttcttataaagccaccagtcccactcctatgataacctgttaatgtattaatccatgaatcatctctcaaaggccccatctctccatactgccacactgggaatttcaacatgagttgtggacaggacaaaaaccatagcagatatacagaatagaagcacaaatatttaattattagattacacaggcataaaattacatttcaaaaaatatcagaatgcacataattagaagaaaggaaagaattacaaatctgtgcatgtgggtcatggaaagtgtggtggttaatatcatatataggtggttaatatcatgtacacaaatgcagcaacgtcacattgctatcatcatttttagatactctcaacttcagtgtttatgtcttcagggacctgtaatcaacagttcatggactggcaatgatcacctaagagttaatgggactccattcttagccttcagtgcccttaaacatccaggctcctagaagtttcttgggaaaccagatgtctttgatacaataagccaagactctaagaataatgtgctttacattaattcaaaccatttatcagaggaatatgagagcagatgctgtattttagaattcagacatggagttattgatcaaagaagaaattaagacttatggttattatagtaaagggcaggagggatgggggcagcagtgcttggagtcctggataacccattcagctctatctacaataatggaagtcagggagtgttggcaggatcagtgtctgctgattaggtctactcttggctcctctggtgaggatttgttttattttgatgggcataagggaggctctgcgcatggaacctccaccacatgcattggtgctactgcttaggaagagggagtgatcctcctgcctcagtccttgaggcccccaagcctcattgcaatcccgggaatctgtcatcttcacctgtctattcagatccaatccccaccctctttctcccctacccccatttaccaaaatctgaactgttgcgtagtcagtccctattggcatgcaccccacagtgagccaaatgcatattaatgaataaactgacacgtggtccaaattacatgctacacaaattgtagcaactttgcttgtgtctaatatcagcattgcgcacataatgacaaaatcatacattgagatagtttctaaatagcgccttgcatgtgaatgttgaatattttcaatgcttttattcttatttaaaaaaatatctttttgggaaaaatataaattagcaaaaagaagaaattcatctaagtcagtacttgtatagaactaaatcattcttttccatagcttcatggtatttcattgtatagatttaccaaaatgatggtaaccattgcttttgatggacatttggttacatattcaaatttttttcactttacatcgtaaacattttcccacatcactaaatattcttctaccctagtgtctttaatgactgaatacttgcatggtattctattgtatggatataatgctaaattcaatcagtaccatataattacttttctcccaaacttctgctgttatcaatagtgttactgctgataccgttgtaaatctatctttgtctgccttcataagtatttcttgggttaagttcttagccttgtagccctggatcaaagggcatgcaatattctggggccttcctgaagccttgccatattgcccaagttgaaatatcatgtgggaggtggaaagagcttgaagtgtggagaaagacaggccttgatcctaatctttgctctgccacttaccaagctgggtgacctttgccaaaaactgatattctctgagcctcaatttccttgtatagcaaaaggatgaaagtaaaagcatttacttcgtaggacggttttgggactcagataaaatcatgcattttgagccttctgtgggaagcagccttccccttggtcattttggaatggtgtacaagcaaggatgcatttttaattcagtctgccttctccatcaacttttacacgcatctcagaacccgggcaccactccatagaacattttagccagggaggagagggcgtgggggctggaatttcaaaggcatgtagaactggtctagctctcttataatgtgaacaaaatttccacaaacaaatggttactagataaaaagggtttgggattggagtcttttgagggctgtgtcccctgctctaaagtgtggggcctcggagttgtgtgtttttgctgcttggtgaacaggatgacaatgtctggttctgaaatcccaggagctgagggaagcccctttttgcccagttcctgttctccgagggttttttgtgaagtgagcctaggagctaagaagagagagagaaatgaggtctgctgatccccagcaaaactacatgcacctccctttcatctgttttggttgaaaacctacgaaggttaaaatagagaaaaccttcagggcaggcaagctatatgtggttagctttgtgtgggaacctgagtcctggagactgccctgacttttgcagcaggcacatttgtatgtttggattttccagaagggataaatcacacaaacagagcaccttgggaatccttcagggagtcctgtttggccccagcccccttctgttaaacacacaccccattctccaggctgtggagagtggttcaaacactgcccttgtctgaagagctttctctggaaaactcattcttggagagaactttctttgtgtaatagttcagccttttagactaaacagacgagaaaatagtgaagtacagaaaaaaaggagttcctcctggtaaacaggggaagagttcctttgggtttggtatcctctgcctctctgattgttgcatgccatgttcacagtggtaccccagccaagacagatactgagaaacagatcctcttttccactatgtcttgttttctcattgcttggatggtgttgcaagcctgtctggcctccaagtgcacatcttgtcctcttcgggccccaacacaggcctgtgatatttagcctgcagagcagcattcgtttaaaatcaaagctttgaaggttgatctggtttgagagcaaccccgaagcatgagattctttgacatgtgggccccttggggctgtgcggaaagaggagagtccagttttcccaggatgagcctggagtgaggttgaaggatagtctcctcatttatgggcctagctctgaaaccaaaggaaggacaattgccccaacctccatccccatcctacctccagtcaggctggtctgcagtgcacacatcctgcttttattacagggtgcatttcacttacagacccttccaccccagccaccccacccccacctacacccccctgaaatgagctccccattccattaaggtggatgacagcaccctcccagggttaagcttccaatggaggagggagagaatgttggaccagcaatttcggaagacagttaaaagattagatagtaaatttacttaacagagactaatcacctgggactgggtttcatatcctgttttgaaataatgtattttcttttgtgctctggtctgaatctgtcatccctcctctaataatgagaggcagtggatttttaatctttgaccttcttccatataatctaatcacatggttttctgatccttctctccttatgtggtgaagttctggaaagaaaaagaactcatttctcaggcattgctgggctattctccattgctataaggggctgagttgacaggtagaatcaggttctgcctgttagatgttcacctctaggcccttaaaatcaaagggtggaggaggagaaagaaaagaaaggaaagcccaaggctcttaggtctgaatcagatgaatgaagggtggcaattggaaactacaataaaacattcacaacatctgtttcataccagtgcagcgtagagagctgtgagtcacaaaatgggagcagtcataggtgaggcaatttctgagtgtaatagcactagaaatgagaccttaggtaatcctccaattgtctgcacatggaaacttctacgcacttagcagctttatcttcactttcaaactgggaggtcctgggtgtctttccttcctcttgggtttggctcataggcgggatgcctggggtgcctgaccctaggcaacccctccagaagtcttccctctgtgtgggattgtcagatgaggtgtctcttcagactccttgactttgggagttgccccaacaggagtcctgcaggctgggaggttggattcagttctaactagaaatgggagcgagaggacagaggaatgccttcacttcacctcctgcccatctccctattgatgtaattgttgcttgattggcagaagaggtgtagacaagatctgtagcccctccctcttcaccttttccatctctgagggctcagggacactttagatacagccatgtcttttggctgcttagccagagttctctaagttgaaagcaacaaaacacactcaaatttagttaacttaaaaaaaaaagcatttattgaaagactatggggtggggcatctagaatcaaagggaaggttgaaaaacaaggcttgcagatcatcttcagaaggtattgagagcagcaattgctcaacagtcagacccaggcatcagcgctagtgaacagatgccacttaccctcggtcttttgtgccctttgtctgtaattcaaatgtcatggagggagaacctcactgacccagcttgggtcatgcatttggtcagagcaaggtagggcatctggattgatagtcctaccagattgtacccagggaaaggaagttcctcaaaaggtaataggaggatgtgcttttacccaaagaagatgaagacaatggtaggttagccataaggccagcacatttctgccaaacatccacaaatccatgtctcactggagtctgaccttgctgagtaggtcttgcgatggggcaggcagagcaatccaaaagagatggcaggagaaactgatggtgctctcttctcttgcctccttcccttcacactgtgccactgtcgttaccactcctacacccatccccccatcattatcagaatgggcagattgactcccagaagttaaacttttgggttgaggttatttcatttcttatgaatctcccaggttctaatcgtcacttgtcttcattaacttccctcctgggcccctttgttccccactgaggacctcccccaacccctcccccaaattcacagctgagataaataattcagaggtaaaataaatgtccagcccccaccccagctctgtgtaattacctccctggtgtgtgttggcttcgcccttatgggaaatgtgagaagggaaacgggtccttttagcctgtgaatggtgctttattattttgatgcatgaatgcagaaggaataagagacaaaataaagttaataatacattgcagtgtagataattcatcacttaaatcaataggaactgcaggtcactgaactggaactggtgttactgtgatccaaacatggaattaataattgaaactacactgatctgtcttcctggaatgggaagacagacaaccccagggatagatgcacacagcacaggaggaacaaggcaatagagatagacagatgattcatttaattcctgcagctgtcacatacagtaaatatgaaaatctgctttctatctggaatcagcttcatttgggagcgaggctagttgaattatactctcagctctgtgtttatttttttcatttattgcaggaattttaaatgatggttagcatggaatgctatgttctctgaggttgaaaaggctctctagcaacaactaggcagtggtatgcatagcatctgtggccccattagctcttacacacccacctgaaaattgtgggtactcagtctcccaggaagtttggctctgcagccacattgagaacgattgaatcagtgacctgtagtttgcaaaagagtgtatcagaagagtcaagaaagtggactcagggagctcccaagtggaacaaccttgggcaagttacatagtctctctgagcctcagtttccctccctataaaagtaggtaatgacagcacctacctcataagagtgcttgagggctgagtgagatcatgaatgaaagcactgagaatcacagctggctcctggtatccagcggtgcctgcattactctcagaggtcatggagctactgggccagggtaagggtgaagttggtggtttatggagagagatttagtgttgtttaaaatcgacactccctgctttggcttttacagggatagagttgatcgtagaagttaatctctgtactgctcccttcctcttgcaggagatgggtgggagtgagatcaggacgcccacccgtagctctggatgcatggcaaaagtagtaactccatttggaggtagggattgggcacagttaaattgttctgcctaatgaaacggaaggaggtggagtgaggaacaggtttctagaggacttctggggagggaagcaaaggggaaaatccagggaagaatgtaagaaacagaatcctacagaaaaaagtggctgaatttttttagaacaaagatgcttaaaatttatttttaaatctccttccttctatacaaccttcacgtgagcctgcatcctgtgggtgtgtgcctgtgtgtcagtgtgggtgtctgtgtaggtatatagatacgtgcccatgtgtggctgtgtctgtgcagatgtctctgtgtaggggtgtctatgtggatgtctgtgtgtgtgggggggtgtctgtatgttcacaaatgaaggaaaaggggttggatttcctggctggactgacatggtccagaacaggacagcatacgtgagactggccctgatgatgtatgcactgatggatttcagcagaagtaggatttcagaagcagagttcactaggaaaagccccagtccttgccctaccacatgctctggagagcccggtggctgcagggcttcctgggcaggtgaggtgagtcttgcgtccactttacttgctcctccacctccacctgtgtaggctgtggagggactggctggggacatcatctgccaggtataggaaggcaccatgtccaggaagtccctttctacattcagctgcatttttgctcagtaggggggtctgtgtgccccttgtggtaacttttctacctgcctggagcaccagtctgaggatgctgtggttatgtgtggtcgatcttgggagcgagaatggtgatagaccagcccctgagcttagggaggaagtccagcaaatgaacagggtttctagaaggaccacttgcagtcctttccccattctccggggtgtgctaatatgtggaaggccagggccacctcctctggggatttcctgaaccccctgcagcagttgggatcagatgcatgggagttagacagtcagggtattttggaggagaggttggcatggctgagagccttttcggcagaggacctggggcagagttggtgggtgacagcccctccctaaagagagaagtgaccacattctgaactggtgtctttaaagggccacccctcctcttctctcaagatgattccagagcccaaaagcctcttctaagaggaaaagttctacggatcttagaacttttggaaggaatacagtagtctattaaatgcaggcctttggatctaaagccacagtgatatgaaaatctgtgcagtcaaatgtacccttgaaaaccccttcagtcacccttaaatctctagaaactggtctcttcaaaattcagaagccaaacaggaacttactttttaaaagtctgttttcttttgggatctggcctttcctggagtggtagaggccacaatctagtttgaactggaaagataatggggtcaacaaagaatgtttatcttcttgctgagcaatatagttgagtttcatgagtcagatgcccttagtgatgtgacttcagtagagtgtgaagcaggagaaggcagtgaaccaagaggcaagagaacttactgggtggtccaacaacgctgcaaagtagttgtgtgaccttgaacaagacgctgcacctctctggatataatttttcaaacttcagaacaaactctgaaaatatttagatgggtaggtagataggtaggtggagagagagagagatgccagcttcttaagaaatgtgtaatttagtgttccaaacaacacgagaatgagatgatttcataattatggttttctagttacccgtatttttcatgagagctccattagcaaggaatccaacttttcccccttgacattgttgaattgcattataaatgtccagaatttatatacaaagtgttaagcatatcccatttcaggattgaaattagctaatatttaagacgtcttccttgtcaattaagaacaattcttcctaacagtgaggtaggcatggtgtgagtcctgattagtggttgctcagggctaggtaggaggaagagggtataggagtttgtggctaagggatatggggcttctttttgaagtaatgaaaactgtctaatattgacgacagtgatggttgcacacatctgtgtatatactaaaaccactgaattctgtcctttaaatggatgaattacaagccgtgtaaattttatctcaataaggcagtttaaaatttttcagtgaaggccaggcatggtggctcacgcctataatcctagcactttggaggctgaggcaggtgaatcacctgagatcggagttcaagaccagcctggccaacatggcaaaaccccgtctcaactaaaaatagaaaaatgagctgggtgtggcagtgagcacctgtaatcccagctactcaggaggctgaggtaggagaatcgcttgaacccgggaggcagaggttgcagtgagccgagatagcaccactgcactccagcctgggcaaaaagagtgaaactctgtctccaaaataataataataataattaaaattttcaatgaaaaagagggaaaaaaagttatttctagatggttttgcttctgtgcatgggtcagaagccagcagttagaaaactgtagttatattcatggctgtcatggaaacaaggcatgggggactggtctttgtcccattattgcctttgggctcttcaaggacaagctggagcttaacatactgaagttggaaagaatttcagaggtcatctaaggaaagactgtgccagctactctcagcattttgcttagccaaacacttcatctctgcttttaccaggaacttacacctaaagaggaaaagaatccatgtgggggatatctgtggcacggcctggggggacggaaggactggggaaagaatgcatttgacctgcgaacagaaggagagagtagagtgacaacagctgccttgaagtgtggatgaaatgttacatgcttctcacacccaatgtgaggcaacaagcaaactctgagttaaaacaggcaaagacaggtatgagtctagagaagacagcaagaggaaggaaggaaaggaatctgacaggcatggaaccttcatcaggatttcattccacactgagtgcttcccagtggccatctcgtgtcatccctgcctcggccctacctcaaaggtaatatgccattttcacagataagaaaaccaaggctcagaggtgtgatgtaacttttcagagccactcagttgacaagtggggaaactgagattcaagcataagatctagggagtcctcaccaaggtggccctaaagcaatcctaggaaaagggtccgccataatccacccagttgctccagccaaaaacctaagactctttcttttctgatttctctcttcacacacacacacacacacacacacacacacacacacacatgttgtcctgcagctagccatcaacaagccaggttgaatctaactccttacctgatccctcaaggtcgtgcttctacctggcttcacctaccctgcccaacctcatcctgcaccattctctgcctggtgcttcctctttccccagtccactgggaggacaactgtgcttgctctgcctctgcctctgcctggatgcctctccaggtcttctcactggagccctccccttcaggtctcagctcaagagtcatcacctccccagagggaccttcctcgcagccctgtgtaatatggcctcctccaaatacttcccatcaccatgactacataacaacttttttacagaaattattttttgcagtttatctacatgtagtcttatgtgttccctatttccctaactataacctaagtccattgaactctctcgctccccgaggtagcctcagaacctagaaggtagccctggagcctaaaaggtggtagctccagagccttgctcatggaatatgctcaagggagggagggtgagagagaaggtggaaaggttttccctcagaagaaagagaatcaaagcagacatttctatggagcagagggctctgggatgctctggttttcggcttacttgctgtggacatctgcacatctttcttatgcatttgtctctacagatatttattgaatgttttttattaaaaacaaaatccacttctcaatgattgaagacagatatcctgggactcaggaaatatgtatgctaaagtttacatttgaccatgaggtgcagttatgaagtctgtttcgggattgggagtgggaaggggcagatcaactaggaaaagaaaaaaatcagatgtatttcagtttatactaggtacaaccatgtagaaagacagcgaaatgaaggaaatgattcctgcaatggggtacagtggaacctctggtccctgcatggtgcagtggaagctcccaccacctggccatgttgtcctcagactagatccacccaacctctcacatgtgtaatgcaggcataaagcatgaaaaccacgtgtccacagttgggacaactggtctgtcacagtgatctcaggtgattcatgcatggtgacgctgaagatgatgataatagggcaatggtcactagatggtgcacacttgaaatatgctaatagcgtactttccttgcatacatctcatttagcctcatttgtacaatttctccacacacatacactccacaagatgggaaacttgccttctttactatgaatcaccaacatctagagtaacatctggcctgtggatgatgtttaggaatgaattgttgggcagatggataaagaagatgggtccaccagcatgcaagctcttcatggaggggacttgtctgatttaccaccacaaagctgatgcctgcaaaatgcctggcataaaataagtcctccataaatatttgctgaataaatgactctccatttcacagataaagaaactgaggtccaaagatattacataccctgcccaaggtaacatagccaggaagtgatgaaatggtgatgatctgggctctttatagtaagaaaaagaggatctttctggtttcagggtgggagtaggaaactacatagaatagggcaggggcaggagtgagtttgagataccccacaacaaatgccataacttgctatgacagctgtaagcaatataatctgtggccataaaacagcccagtgctggactcctgcacaaatctgccttggaactgtcatacactgttttagttcagaggagctgtttgttttttgttttgtctttgttttttttttttttttatttgagacagagtttcacttttgtcgcccaggctggagtgcagtggcgctatctcagctcactgcaacctccgcctgcggggttcaagcaattatcttgccccagcctcccgcgtagctgggactacaggcatgtgccaccacgcttggctatttttgtatttttagtagagatggggtttcaccatgttggccaggctggtcttgaactcctgacttcaggtgatccgcctgcctcagcctcccaaagtgctaggattacaggtgtcagccaccacgcctggccttgtctttgctgttttttgtttgtttgtttgtttagacagagtctctctctgttgcccaggctggagtgcagtggcacgatctcagctcactgcaaactccgcctcctgggttcacactattctcctgcctcagcctcccgaatagctgggactacaggcgcctgccaccacacccggctaattttttgtattttcagtagagaaggggtttcaccgtgttagccaagatggtctcgatctcctgacctcatgatccaccggcctcggcctcccaaagtgctggcgttacaggcgggagccactgcgcccagccttgtctttgcttcttaaaggatgatgaggaagaaattagctaagcttgctgttaatgaatcttccatccccatgagaatgttagttttgagagccccaaagtgaacctgagccaagtgttcccttcccgctctccaggagctggggctgctataggggaagaaagcaagttcatggaaactgcacctgtcaccaacaaattcaaggtgtctcgttcccatttatcaagctgtcagctcctaacctgtcagaaaaccatctagatgtgtttatcagccagattgagcggagcagccccatccggttgcttttcttgttgatagctttatggctgttttcaggatgacctgcaagggagggattctcttcctgctgctctttccctcaacaggagaaaaacaaaaacaaagtcctgcaatttggggtaatgtagatgtcaacaacagaaccgcctgtggccaaggattgcacaggttagctttgtctattttcgtccagttaaacgctgactcccgggcagtaggcagctcaaagtacaacatgtcaactgaggagaaaattaaagccaaaaacctctgcataatttattcatcacaacctaaaattgactccctgcttgtctgcattcaggttgaggctcatttaactgcctccactgtgtctgtttaaagagaaaatagaggaattggctcagtggggtaagataaaccaaacacaaaaacgcccaacagttctttcattttactcctcacgtgactttgttcctctctgctggttaagatgagaatgactctacatcaaaatgattaattattattattacttcaagtttggtgtatcttgcgggggaaaaataatctggaattttttctgaacaaaactcctccagaccaagttggaggaaactgcacctatcaccaacaaataggctttgccctattcgtagactccacctgggtttccttctgcttctgaagtcatcagtgcacagtagacattgtcaacattttatagatgaagatcagagaggtacagtaacttactcaaggtcacacggctagaaagagtcagagctaagacagacctaagtctgtctgagtcaaagcctttaaattttcctgagtttcatgtagatcatgctcagtagggcaaagacctacagaggtgtgtagccaagacagtgtgaagttaggagatgaatttggtaaacaagagaggatactcttagctttagaagaccagttttggttgacaggtgaggtgggaggcagattgctactggatgagcatgttaagttttatgtcatgtctccccagtgagattttaagctccttgaagacaggtgctttctaagggtatacacaagttcataggaggattccctttgtaatgaacccaacagggccagatacaaagacaccttccaaagttggcagcgagactgttgacaatgatggcagtgaagagtggtgtctgccaaggtgacaacagggatgggattcgtctctctgctgctgtccaagtgtgaagtctggagctcctatgcctgccatatttgggaagagaaggagcttgaattccagggtaacagggagaggcaatgagaagatttacacgttgtgttgggagacccaagaagagtaatgattaagcaagggcatgggaggagaggggggcgctaagcttgctgataaggatggtgctgagcagttgccttagccttgctgacccgggaaagcagagggggagatgactggagagaaggaatggcatatttaatgggaggggagagataaatcattcttaatctttatgttcagggaggagaatggtaaggaatcttaaaaacccactctcctttccaaggcctggggagagccatgaggaaggaatttgaatgcctgccagagcaggtgagcaaagcttgggaagagaatctggtgcaggcacgaaagtgctagcaggaggtacgagagtgtctgaaatctctactggagagtgcagacatcatcttttctgccagccttgcatggtgggaagtagagtgggaacccgaggctttattcttcctgcagatgaaggctgaccacaccagatattgtgattgtagagggacaggtgcaatgaaaggaatgaaaaatccctcaaagatttgagatgggccgggcgcggtggctcacgcctgtaatcccagcactttgggaggccgaggcgggcggatcacgaggtcaggagatcgagaccatcccggctaaaacggtgaaaccccgtctctactaaaaatacaaaaagattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagatttgagatggcagtgccagaggaatgcaaggcagcttagaaaaattatgacgcaagtgttatatatttactgtagagaagttacatgagacagagaagccaaaaaagaaaaataatttaaactcatgattgttcacctagaaataatcactagcaatattttggtgcaattttaccccagtgtgtgtctctcttatatacacatgcacacacacatttatagcattggattatactatatgtactctttggaaacctaccttctcactttaaaaatatatacagagcatttttccaaattcataaataacatcctttttaatggctattgttcttccattgtagtaggtgggccatgacaactagctcctacagttgggaaatttaggtggttttcaattttttccatcatccaaagtgctccagggaacatccttgtacatatatttttggggggctttgtcatattatttccttaggagtaaagctcttaaataaaaagttatgtgcacgttaagagcttttgaaatatattgccaaattgctcaactgaaagacattaccggtttatattccttccagaaatgcatgagagcacctgtctctttctgtcctcacgttcatgggggatcatcatttaacaaaatggtagatgctgttaaagttggagaggctggaaggaacaccatgacctaactctgacttgcatctctcttgcaactctccagacagaagaggagtaggcatgggggatatttagagtgcccagaaataggttttgcagaatcaagcaacattttggaggatgcatttaagatatgtgtgagggcagtgactaggagattctctcaccaccaggtgtaatatgtagactcaagaagaagcttttgtccccagagctgacattgtaaagacaaggagggcagtcccatggtagcataccaagaggcagcactgggatggatccctttagttctctttcagtctcatacctcctggtgccctgacccaggctgccccttcaattccaagcaaagtcccaaagctttgcctttctcttataaaaaatcatgctggcttctaaaattaaaaaaaaaaaaaaatccagcgaacctctcagactcttctaggcaaatgattgaacttcatctgggtcccatttgagaagagcaggcatataaaaatctacatacatggcacagataagatcgagagctcacctggggagacttacaagtgtttcacattcaaagcacatgtctctaatgctaatcagataactgtagagtttaattcttacatctggcacaaaactcttgcttttatgttgcctattttttcccggaaggtaataaaattcacaatcgtatctcataatcaatatagcatctcttcaggcacttctgcacattatgactgcctaagctttggcctgcttaggtaagagaaccacacgctgttgcttatttttccttgttgagatactcagctctgaggtcttgccatcttgtggcttagaaagcagatcttgtttctcccactaaacagggtaggatgaagtacagagagagagagcgtgcgctggcatgagttcacaattggagaggttgacacctcacagtacatcctaactgggattgttgagctatttacctagaaaccagaagcaccaactcagaatcaagtggaaagtttgccctcggagagacagtaaacttttaggtgtcattgctgataagcgatagagaagaattctgtctgtacttagggtaggtgcataatagcagtttgctacactggtatgtcaaagtgctgttggcatgaagttcattttggatgagcaaaagatacaccagaagagacccatgtgtgagtaggcagaactcatattttcctaaactaacttaatattggtcaaaatgcaatgaaaaccacaaagatgtattttggggctatatgggcaaagtaatttagtattttataactttctcaagttcatatttgagagtaacaagagcaaaggtcccatcaaagcctgaacgtttgctccttagctattatgatttcaaaacccatctttctgttttagatccacttaaagtgagtatctttccttgttgaagtgagcaaagtcgcctaaacaacatgtttatctctcaaatgctaggagaataggcttatatcttaagttctaaccattttttcttccaatagatatttataatcataggagttttctctttcatagtacagtaccctaaatgaaggagatcatttctaccctttgagagtgacccaggtgagctcaattgttctgagatgaacaaagtcccacatacagcatagactgtgctgagacaagcaaggtgcccagggtgcaccatttaaggaggccctctctctttcagggatgtgagtgcttccttagagatgtgccctgggtgagtctcagacacgtctccctagtcttggttctggtcctggttgtgacctgcagactgcttttggacacatcaaccatacctactatcttttagagccttcttcactggaaatgtattaagggccctagtgggcatcaggaaatgtattttgcaatgtgtgcagatgatacagagcaggcatgccttatggcaaaggggtccctttgcttatctccagagggttcacctactaacaactgagattgactgcaatttctttgatgctcatcctggcttatgttatatctttgcctcagttataacatttgggccgaaagattcaaaacaaattctattaggtgacccgaaggctgaaaggttgactgtgtttaactggattattttacattttctcagtttgtgctttatttatacgcagtaagtttcactcaatccacctgacttcttaccttttgtccagcttgaaaaatgaaatgagtttgggctttggcactatgtgtttcataggctcctaatctctctttgtatgttttgttggccaataatacgtaaaactatgccccaggctttcttgaagtgcatgtaaatatctgcctctctcttatctcccatggtagtaattcatccaggaaacttacttccaacaggttaggtattaaactctccctcacataaatccacattggatgtctctgatcaaattataattttcaaagtattccatcactatgtccagttaaatcgttcctaatattttcccatgactgggtgactttttaaaaaatcttgattgtgctacagaagtgttttcccaaatgctttattaagacttgcacaaatgctcaccatttatcagcaggaagtgtttgcctgcttggaggaaaatcaaactagtaaattattttattttatttgcttttatgtagccccctgcatttctgtccatttgggctgccttctttgagcttgctattataactagggacaactcctcgtggcctcataaatcataatcgttgatatttattgctcagtaggtcttttaaaatccagttggaggggttccctcctcccttaaaactctgccttttattttgcttaaggcactatggtaggaaactgaaacatattttcctggtttttacttaaactaaatgtaaggcaagccttatataaagccaacaaaagagagcctgaggtttgaagatgaaggtcagcctcttggtcattgattcgacaagttccaacctggcatttgcaagggtttgtctcgcagcaactgcctatcagacgcctatgatggtccagactctgaatcaggtacctaacacactgctagacaagcaaggcttagtctctgccctcgtagagttgacagtctaatccaggggtcactgatctttttctgtaacacagcagatagtaaatattttaggcttagaatagtccctgtcacaaccactcacctttgccttgtgtggtgaaagcagccatagacactctgtaaagaaatgagcatgaggttaggcacagtgcctcatgcctgtaatcccagcactttgggaggccaaggcaggcagaatgcttgaagtcaggagttcaagaccagcctggccaacgtggagaaaccttgtctctactaaaaatacaaaaatcagctgggtgtgatggtgcatgcctgtaatcccagctactcaggaggctgaggcaggagaattgcttgaacccaggagatggaggttgcagtaggccaggattgcaccattgcactccagcctggccaaacagtgagtgagactccatttcgaaaagaaaagaaataagcatgagtgactgcattccagtaaaactttatttacaaaaacagggagtgggatcagattggccccgtaggccatagttcgccaacccctcgccaaatgaaataaagaagcaaaaagcaaaagtaagtaagaaactaaatgtaataatgaccatgtatgatcattgccataaaagaaacaaatggggtgctgagatggacagtttcggggagacttgctttggatggagtgatggggaaggaacggctgctgtgaagagatgtgatttcagctgagccctgagggaggggagcaatcagcagtgtgaagagtgggaaggagaggattttaggcaatgagaaccacaggttcaaaggccccaaggagggaaagtgcttagtgagtctaagagctaaaaggcagccactgcgcccacctttcatccctcccagctttcttcatccatgaagtgggatgtgtgggagtgttggtctaccccagagtctggtcataagagcgccagctcaggctgccctggggggcctcagtgggactccagggtatggataatgacctttcctttggccaaccaggggagatgggggttgggctcactttttttttttcttttcttttctttcttctacttcttaagcaaagacctttcatcagcacacggaatatagaaagcttgctcggaatgtgtcaggctaagcaaaaacacatggtctggttatattctcctaaaatagagcaagagaaaggcgggaaacagaacagcctcccataaatcattatttgtctggggaaaaagtctctgacagatatgtggggtaccactgtgtgtgtgtgtatgtgtgtgtgtgtgtgtgtgtgtgttgtggggtggggggtgtggtttgatttccaaggcagaatttcactgtctgatcctgtctggagggcagaatgcttgtgctctccacatctggaagctgcatctccagtgtgaccagccacttgggagatgccctgagcctgtgggacattgaagcccactcccacccccacccatgggtacagaagctgcccagagatgctggtggaggcaggattccagcaggtagatcaccagggaatctagatggaatccatagttctgccctgcaagaatgctgcaattctgtaccgtggaggagccaacagaatcaccaggctctgtgactcagtcacaacaccctgacctgcccctgtccattctccatatcatacccagagtggtcttttcaaagcacagctttgaccaattctctgtctttcacacatacacacacacacacacacacacacacatgcgtgcatgcatgcctgaaatagtatagtattgctcttaagataaacattaaagttcctaccatggtacagaaaatatatgtagttaggccccgtggctctttcttttccagactcctcttacccttttctgcaaccacacagagctttttaccaattctactaacccatcctgctttctgcaccacagagcctttgcacatactattctctctgcacagaaggttctgttccctggtaccggttcaccttgttctcagatcaagcatctgccttcctcattaggtcaattttctctaaactcctataacactcacattttgtcttcaacgtacttattgctattatagttttatattatttgcttgtattattaatgttggttaatctttgattaatatgggctctcacctcccactctcaccctgctcatcagtcttggtgcaagaaacagcatagagtctgtctacagcttttagttttgttaattttattttcattttgttatgtttgttcatcagtgcactcagaccatgtctggtacatggctgaaataaaatacatgtcttttgaatgaatgagtggatgtgctggctatttcttcctgcagtgggcacctgtgtagtctttagtaattatgtcctgttacctaggggtttcctctctaccagggctttgatccagtcaaagacgcagtggtctctcactggatattttagcagtgaagggggaaaggggaggtaaggaatggccatgccttctgggaatgaagattttctgagctggaggggatgttagagattatccatggactcctcattacacaggtgaggagatggagctttttaaaggtcaatggctggttagattactagccatctttacagtccaaattgtcagttcttaggacacaggctcttgccaaaagccttgcttcctggcccctagcctcagtccaagatctttcctgagtacaatgcccccacttttattccttaagtaagattagtgttggcaaactaataaagctccagctttaggttctatgactgcaaaaccctgctggagccccagatagcttcctttcaccaatcataactcgggtttgtgttgctggccctgccttagaatcttagcattatctgggacactgaggaagcagccaccacttcctgtcattgagctgtcatccaacccaagaaggtaacttcggccagggtggtttcattttggactcacactaataagaacatgcctcctgtcatggaatgacatgaatgatcatggcactttggagtcaaataggcctgagtttgaatcccagctctgccacttaaatctgtgtgatcttaaacaatttactataatcctagagcctgagcttcctctgcatgtaaaggagatatgggattgtacctcgtttggttgttatgatgattaatgaaaccaatcacaccaaacacttagaacaattcctggcatatagtaggcatttaatacatagtttaaattctttcttttcaaaaactttgtaattcagagaagaggcatggctccttaacttctgccttctggattctatgcactcatctatgtgtgcatacattaaccagagaatcaccaagcaccgactattacctgccatgcagtacgccaggtaccataggtacagaggagaatgagtaagacatggcccctgccctcctacagtttaaatccaaaaggcaagacagtcatttgaccatgctacatagacaatatacaacagaatacctgagactctctggagccaccagccatgttatatggctaaaattcaggactctggagcctgcctgcccatgactgattcctggctctgcctcttactgctgtgcctccttgggcaagttaacctccctgagccttcgttcccttagcgctaaagtgaggatgatagtagttcctacctcacaggactgttagaagtgtccaggcacctcacagtgcctggcaccctgtgagaactcggtaaatgttggccattatcatctgggatggcacgaaatgccacagccagggtcctgaatgtctcaattcagcaaaggagaagcaactccaagctgactcccagcttgggagggaagacaaagagttggggcctgggagctacagaagaactgagcagctgtgtcctcaagctccagacgccctcttcccacgtcacttaggatggattcctggcccccacacctgaagttctgttctggagagaccacctactccaggcagcctggaggcggggcctgtgacaggtggtttctcataatgtgaacaactgacactgtgtttgctttttcttccacttatagatgctttatcctgcacagacgcagacaatgaggcacaatgggctctccagggtggttttcacgtgtgggatattttcttatacaggtttgatcacacagtcctgtcaacacagacagggcctttctttcccctgatgagctccatctggctttgaacacctgtcagaacctaggatgttattcttggaagagactttaagttctctatagcacaggcataccccctcacttacagatggataaactgaggcccagagtgagacataacttgcacaaagtcacaagttggcatcagagccaggattaaaacccaggctttgaagttctcagatatgtggtatttctaattcgccatttctacatgctatttccattactgtgtataaggcttaaggctgaaaagcaaccacattcttttcaaatctcagcccagattgactgactggagtcgtctgccaggaagggtggcatggccacattcagctcctgaaggaaagagctgtcatcgattagcaatgcctgccatgcataggagatgggggagccccctgtagcacacattcattacccttggccaggtggaagtaaaaggggtaccataccactcatggtggaggttcattcataagccatggataggaaggagatccaaggggttaggttagattatgtattgggagggagaaggatggagtttggagaaaagaatgtcggtacacatgacaccttcttccaccacagcacacacaaaccattgaattgccccttgcaggtgaccttctgatctcttcccgaaaccctcttctctctctagggggaaaagtcttcccaatctatatcaaagaactgtcatggattgtgtcaaagattgtggtagatgtgaaaggtggaagtgtcatatggtgattaagggcatagtctgtgcaggcagagagttctgggtttgaacaccaggttttcacttgatagttggcttacattatcatttaatctctttggggctcagctttctatctgtaaagtggggatgacaatacatctttcacaggtttctgtgaggattaagagagaatgcatataaaacctggaggacagtggctgacatataataaattctcaaaaaactggcagctggacatgaatatatctttaaaatacaaaatgccatgcagtttcctcaagcagttgaccattcataaactatccttccagttagatactgatgtgcatgtataatgaggtccttgaaaccctattcaccactaggaggttttctgaatccgtgatagctttaaaaaactttcagtgctaagtggattttcttacatcctaatcctttgaaatatatgatgagtaaatggtttatagggtcaccatatatggttaataagaatgcttcatttatcacactactctatccactcaatatactggagttatcttagtggcaggtatgaaggcaacaattcttaacagtccctcaaaaacatttcagaaagacatttgggtagtggagagagaaaatgaaatagtttgatgatgattcctatgttttaatatttggttaatgatgtttcattaaccaaactgggttgttttatagaacccccaccccaatgcatgagttgaacgactcgggactcagagtggttaagtgacttggataaggtcatgcggtgagtaagtagctgaagcagatctagcagcggtggcacctgtggccctcccgcccccaacacatacacagtggagggtgcaacagaatcaccggaggagcttgttaaaaacacacacccaggaccctgtcagcagaacctcttgtaggggtggggcctggaagctgtctgctttgaccagctccacaagtgattctgagacacaaccaggcttggcaaccattgctaggccctggctattcaaagcgggcctgggaaccagcagcatcagcgtcacctgagcttgccagaaatgcagggtcctgggcctcaccccagacctcctataccagaatctgcatgttcagaggatcccctgggggatgtatgtccaaagtgatgtctgagtcactttggtctacaagacacagaaacacgaagcctttcacagccagttccaaggtcaacacactaaaatgggctgaaggggctgggcacagtggctcttgcctgtaatgccagcactttggaagtccaaagcagaagatcacttgaggtcaggagttcaagaccaccctggccaacatagccagacccccacctctatttttttttttttttttgagacagacttttgctcttgttgcccaggctggagtgcagtggcaccatctcaggtcactgcaacctctgcctcccaggttccagcgattctcctgccgcagcctccagagtagctgggattataggcacccgccaccacgcccagctaatttttgtattttgagtagagacggggtttcaccatgttggtcaggctgctctcgaactcctgacctcaggtgatccacctgcctcggcctcccaaagtgctgggattacaggtgtgagccactgcctttttttttttaaagtggatgtggaggctgagattaataatgccttgaggtgaagagaatatgcagacctgggatgaggtaaaattaggccttgatcttgtgggtatctcagcagtatttcaaaatcttgctaccttctgattctttttgttgttgtttgttttgatggagtgtcactctgtcaccaggctggagtgcagtggcgctatctcggctcactgcaacctctgcctcctgggttcaagtgattcttctgcctcagcctcccaagcagctggactacaggcgcccgccaccacggccagctaatttttgtgtttttagtagagatggggtttcaccacgttggccaggctggtctctgtctcttgacctcctgatctgcccgccttggcctcccaatgtgctgggattacagatgtgagccaccatgcctggccccctctgtgattctttatgaatcagctggttgagccttctcattgtaggtaaaaggtaatttgattttttttaataaacctaaatatttcatcatatatactttgtgtcagtcttacttactattgcctacataaatgtagacagttttctccaagctgtccttttctcacatacggagaacatctttaccttaactttctagtactccgatttctcagagatgctactggccttttatgccctttagaataacgggctggttttgaagatgacttttgttctaatgttactttcaacattggatatatgtgaagtgggagatagacaacctttaccttcaagataaggtgggaaggaattgatttctctctgggaaagtttattgcttattttctagtttcacaagtgctatttgtctatattttcccctttaaaactcaaaatgagttttgcttgttgatggtggggctgcatccagagtttggattggaccagaccacccaatcactgcccttcattttgccgctatggacacagcccagatgcttgttggctggtctccatcttttagcactggaagaccatattcagcaggcatggcatccctgagcctgaagtcgtagctcctaatggagatactctggtgggggcaggaagggagattccatcacatgtcacaatgcaaaatttaaacagactcaccattagagatctcctccctgtgggtactctgtggggcctcatctccctccttggcctcaacacagtctttcaattcccagctcttagcctgggccttttggcagtgggcctaaggccattgtgctttctgggctcaacaaagacttggaagttggttccacagtgacaggtctcccaagcctgcccccttgcaggcaccagttcacctgccatcgggtgggtactggagtgtgtccaccagggccatggggtttgagctcattccttccccatggcttaggttcctagaccagcctaacccatagaagagactcagcaaacacctgcagcctgaacgagtgaacaggctgagcctgttggtggtgaggaaaagaggagaagcagagctgtggggagggagagtggggagcaattgagtcctaaccattaatattcgcaacctagagaaggcagccacacagtcccccttgggagagcctctagggagcactgctgtctaacctgcaaaaatagaaaaataattttcttttcaaaaatgccacactacccaattgatttgctaatgggttctggcagcctttgtattagtctaagcagccattcagaccaccattgacaatgtcaaacttataaattgctcttgttgaaatctgtacatcaaaattaaataggcaacacccggtaagctgggcctcacccccaccccacccccaccaccccccaacatcaggaaggccaggagtgcctctaggtggcctgggctgtgtagccagggaacaggccttcctccagaatgcccaaagacattctgaagtctctggaagaaaaggtcaaggaatgaggccggaacctggaaggctttggacgtaaggctaaatctgacacatagacacgtttcttaaagttttcaccattaaaactccagagctttcattttgcttgaaaactcagaagatctggccactgtgacctgcattctctcaaggcaacaatcagctagaactgtcctctttaaacaatctctttactcatcagtttaccaaacaattgctttcctgccagccacttccccctcctgccttacctgcctggccccaattagcctgagtttgagctccctcagtgctagggtcttaggctttggagacagaagaccttggcttcaaatgacgttggaaaggctacatcctttcttcacgtgttacttgtctcatctgtaaaatggaaatatttttgtaatcttgaagtactttgttgattaatggatagattatctccaggatcctgctttgcaggagctaaccagctttgagctgtgagccgggaatctgacaggtgttaggagtaagtgttcttcctttactctcggagagtcctagtgtttatgctccccaggccccacctaaaactaagccagtgtttctaacaaataattgctattcattatatatataattatatattaatgattataatagctaaccattttggagagcctcatatgtgccagatacagtcctctcacattgtgtccattatctgtgctcccctcctccagcccgatatcatttggggtaattattcccagtttgtcgctaagtggttagggttcaggagggtaagtaacctgcccaaggtcaaatactctgaagaagccagtgccaaagcattctgccccccttcttgcctccttcctcccgacgcttgatcatctagaataagaccattttccatgaactgttgggctctggagtgacacttgtttccccccagcagaaatgacacctttgaagtaaaatgtctcagttcccagctccacaggaaaagcctatttgggggcccattatgactgtattctagaagtcgtcaactcagatgcttaaatatagcatttcttcagtgctcagccgccggcagcagtgaaaacattttgaagggcaaataaatatttatgtatgagagctctttgtgcacagtaaatgtttgattctgttgccccaattccctgggccgagagtaaattatggagcccaaaagagagtgtgggtgagaatatgctttcagcgcctaccttcatccagcaaggctatatcaagcatctgccacggatgtgccaggcactgggctctgccaggcactgggctctgcagcagtggtaacaggctataaagtgcttctctgtgcctggagacctatacagtgctttgcaccaattatcttacttaattgccacagccttgtgagatagttatcattagcttcacgttacggaggagaaccagctgtgtgttcctatttctaagtgatctgttgtataaagacatgggccaagaatgtaatattctgacatattctccctttccccacgaaactgtaggctcattgaggagtaatggatgatcatagtagctaagatgctgttaagtccttcctgggtggtaggccctttactaagcacttcctatttctttgaatcctcacaacggcactgatgagatgggcatagtaaattgctcagaaatagctgctaagtcaatgcatgaaggtcgcactgatttgcttgcagccatgggcgtggaagaagcatccatttgggttatactgaccaagaatctctctccatgaccaaactctagtcaggatcctttgagtcctgttcccaactaggccttgactttgggactttcatgtataatttttgcaagaatcctactaagcctgtttagccggaatcctccacccttgatatctggtcaaggtcctcatcctccacaatcccccaggtgatgtctggtctccccgacccgtcctcagcaaaaaccttgttaggtggctttagccagaacccccttcacccctgatgtgtgttcttggtcattttccatctgctgacgccctccctgctctttggctataaacccccacctgcccacactgtattcagagttgagcccaatctctctccccgactgcgaaacctcattgctgtggtcccacacccatcgcaatggtcctgaataaaagggtcatgaataacttttatctttaacaaggcctaatctctggaaaaagtacaagagcagacagcctccaattgggtcagcccattcatgggtttgtccactctctttgtttcctctcacttttccttttctcactacccttgccctttctttcttcttcatggtagttccttttgccttttgttctctccctctctgtcttttttttttttttttaaatccctttgccttctcccctcttttttttttttttttttttggcattttcccttcttctctgagattgtggggaaatgttggaggggacttctgagggtgacagggccgggtgcctggtgcagaatgcagccacttgggggaagtaataccagatgtgacgctggtgccaacaatcagcctgaaatgtaaacgtgagctgagctccagtaataaacctcttacagctggagcaccaggaatgccagaaaagaggaacgaggccttgcttcttaactcaggatggatcaaaatctggtctttgcatatatttatgcccacagcatcctattttgcgttttcagaaaggtgatccgtcttctcccaagtttattggaggcggttttccaacaccacttttaaaatattacaggcggccccatgatgcatggcttcgtttataacccacagcacttgcgatctttgggggaatatttctcattaaatctatttcctaactctttgtagctgcctcctacttccccaggaaactctagaagattcaagacaggcttgagcagccaggcgaggtggggatccagggcggtaagcatggatgctagggatgagggaagtcagagtgaccttcccactttgtttctctggggtggcaccatatatttcttacatccctaacagccctgtgcatcaaagaccttaaatcatgggtgtctttactctgcatctttctttggcagaggtctctcttcatgagacagttttatagggatagacagagacaggaacagatgagccttggcctggatcaggctttggtcagcaggaacctccttattatgaagagggttcccttctagaaggagtagggcaggagctcatttcttggattttcccatcaaatgctgcaactccttcctattgtcaaaagcaacatttttcttactaataaaaattgtttatagctgggaatcagttgttgctgtaaccagtgttgacattaagtcactatgccttaaatactaggccaagtatttgtaagggtttcacaagaaccttcgtgctttgaccatttgaaagaaaacactggtgctagtctcttgcagaatgctggcagaaaaacatagcctgaacccacctcccccacccagtggctgtccttgcctgatcttctacctggggccaatttttctccttgtgactgttatctcctgagataaagggacagaaccttatgtataatattccctttccctgccccccatggcttagatgtgctgtatgctgaatctataagatgcactataactcactgaaattaaatagatttgatgggttttgttttgtttcgtgttttgagacagtcttgctctgtcgcccaggctggagtgcagtggtgcaatcttggctcactgcaacctccacctcccaggttcaagcaattctcctgcctcatcctcctgagtagccgggattacaggcagctgtcaccatgcctggctaattttcatatttttagtagagatgggatttcaccatgttgccaggctggtctccaactcctgacctcaagtaatccaccagccttggcctcccaaagtgctgggattacaggcatgagccactgtgcctggctcaggtttggtgtttgttttcatatttatatatcgaattgtgaaggctagtatgcaacttatggaatccgacactgtgctgagccatgagaggcagataaatcatttatatactgggcaattgcaactgccattttggtcagcgtatgtgcagggtgagtctgaggtaaaaacatgaatctgctcttcagacctactttcacatccttacgtggtaatgttttgaggcaggtatttttttgtaaaatgggttttccccctctttattatgttttgtaacagaagttcagcaaactatggcctgggaaactggcccctaggccaagtctggcccacagaatgtttctgtaaataaagttttatcgaaacagagttcattcatttggtactatcaatggctgcttttttcctagaaacagaattgagtggcaacagagactgtgtatgttgcccacaaaggctaaagtattgactggccttctaagaaaacgtttctcttcctctgctctatatattaacatgcacatatgactatgcagagcttgttttgttccactggggctcttataataaaataccatagactgggtgacttagaacttcagaaacttactcttcacagttctggaggttagaagtgtaagatcaaagctccagcggatttggtgtctgttgagggtgtttcctggatcatagaaggtgccttccagctacttcctcacatggaggaagggacaaggcagctctctggggtcccttttataagggcacaatttcattcatgagcattcctccctcatgacctaatcacctcccaaactccccacctctaaatagcatcacattagtgattaggcctctacagatgaatttgggcggggtggggtgggaaataaatatttagaccacagcagactgtatgtatattcaaagccatccaatgctgtattttttcagtggtttaaggaactttcaagggtaattttaactagctgtgacctcaccttacacactggtttctgaatctaaacctagaaaagattcatcttggccaggcatggtggctcacacctgtaatcccagcactttgggaggctgaggtgggtggatcacttgagtccaggactttgagaccatcctgagtaacatagtgagagcccatttctacaaaaaattagctgggtgtggtggcgtgtgtctgttgtcctagctactagggaggatgaggtgggagaatcacctgagcccaggaagttgaggctgcagtgagccgtaatctcgcgccatgcactctagcctgggcgacacagcgagcccctgcctcaaaaaaaacaagacaaaaaattcatttttactgttgtatatttgacagttgttctttgggtcttttgtctacatgggtcagctgtttttggccttgtgtatctagtcacagcacacacttttgaaagatctctgtaaggaatctttctctggaggataggctggctataataagagtgaaaccatctctgtgatacgttcccaggactgagatttcatggaaccacatgtgtatgacataccacagatatgaacttcatggagcccccagttgctttgaatttctcatggtctcattcctcctggactgtctgcaaagacgctgaacggtccccatgactgcaggattctctgtggcccatgctcagtgacacttactggaagggaagcttagcttaaccaaatccagtcaggtttgcctggagataagagcctcagaacacccgcaggtgaaactccgttcaccccacaggtcagcttgttcaggggtgagctgacctgactgttagagtccccagacacactcatgaaaaatacagatgctcatatgccccaggaagttctgatcctggagaggtggggtgggcataggcatctgtgtttttaacgacctctgcagaagagcctgaagggcagccaggtgtgggaactgctaagctagtccacactcctcccttcatagctcaggaagacacacccaaagttgactcagcagatgaccagaaaggaccaaatcccaggccctgacaattagtccccaccaatgatttccaaacccactttagcagagccctgcggtgctcacagatgtctttgacactatcctgggtaagagaataacccgggggcagccctaataacagagttctggccttcttcatggttaatcagaatccatgtatatgctttaaatattggggtcacattagactttgttcctagagcaagagctgctgagacaaacaactgctaatgggggaaaaaaatacaattgaaattctcagccctgcatcttgcagtgaaatcaatccaccaaagcttccttttcttaaaaatctccagaaagggaaaattccacaacttacacctgcctcagaaggacttgcaaagtgtctcccgacctcacaatcatttctctcaggtgctgagagggagtttctacctgcagcctcacatccatctgcagccccctcaggctccggctctgttctctgtatgcacctaaatcacatgacacctaaaccctgcctgttccaacggagcctcttccttcgctgagtctcctctgaacccaaaaatccacagcccccgtttgctgtgggggcttctgttgcccttctgttgccatgactattaatagtgggcaagcacccactgtgtgccaggcagtgcatcaggccccggacaaggcaggggtgttgctggggtggcgcgtcaggtccggcagagaagggaaagtgtggcacacagtcattcactgcccttcctgtgggtggcagttttcaggataataataaaaacaacttggccaggcatggtggctcaggcctgtaatcccagcactttgggaggctgaggtgggcggatcacttgaggtcaggagtttgagaccagcctggccaacatggcgagacccccatctctactaaaaatacaaaaattagccgggtgtggtggtgcatgcctgtcatcccagcttctcaggaggctgaggcaggagagttttgaacccaggagacagaggttgcagtgagccaagatcgagattgtaccactgcactccagcctgagtgacatagcaagactccatctcaaaaaagaaaaaaacaaaacaacaacaacaaaaaaactacctttcaggctctccttccccattattgcccagccccagcccttgggtctgcatccagcctcaggccctgcatgtggggcacattcttccaggaggattccaccaagccagctcagtgtatgaagaaccaggcccccacttttcacactggcagccctggtgcctctgtcagccaggacccaggtggccctgcccctgacctgggcacagctgtggggcagaaatcctcaaggcccaccaccccagcctgttttttttcttcctatgcctcctttttgggccacagtcccatgcaacatctctgcactgccacctcctggccaaagagagcagtgagcaggggcctgggggagtggagtccaggcaccagggcggcagacggtggctctccctgcagctcccgagggacccagggaacatcccagagtgcagtctgcagagatgacacccacaggccagggaaaggtgatgggcagcatcagcccaaatgttcccccagaaaagtccccagcagaggcaagcatctgttttttctctcgttgcatttctctttcagccttttagtttatattgcccttggtttctgtttaaatgtttaaatacttgcatatttatgtgtgtgtgtgtaggatctaattccttttgtgcagtgtatgtttcttacttccatagacaatactgactttctcatgcagatcaaaacaaaggggacaccacaatatatagaaactagaaaatgctagtgtgagacataatagtaataataacaatacacccccatacattcaccatttaattgtgaaatcttttctctttgaaaaaaagactgagctaatttttagttccagaaacctgttctctatcatcagatggagctgataaaaggctttgcaaatggagaggtgttcgaaggggaggggagcagctgtgtgttccagtaggtcaagttgaagacaccctttctaaaccctggagtaactgagcaaagagtagggaaggggtgagaatgagggatgaaggctgggctagggggtgagcgtgtgtccggtgtcgaaagaccccaggcaggccgcagaggggattgtggacccacaagcccccagatgcctgtcctctgatgattcagggcctgtgcttgcaaatcagcccagaaacctgcagaagatgctggagccaggtggtccctgccatcaccaagcctctcccctggatgtcactgttgtgctgcgtgaacaaggctggggaacactatgggaccatgagaatccctccctaacagccgctgccccttggggcttggggaggcacagtaggaaaaggcagggcccaggctatctgcaggcatttgggaggttggggcccaatgtctccagcccaatgctgctgccccatggtagcatctgtgggtgatactaaggctctctggtcctgtaggtcctgcagcaggactgattctctattacaaagaggctggggaggctgagaggactggggtcaactgagtcccctcccttggtctctcaggcccttggataggttctcaaatcagcagccataagaaagagctaaagggtcaacgtgtatagtgattgcaagcacagacacaagtcccaatcccagcctcattgaaaaccagccaggtaaactcagggaaattgtttcatctcagagcctcactgctaccacctacatttgatgtgactcccccctagcattgtcgtaagaattaaataagaatacagcacataaaacttagtacatagagtgcggctattattgtaacaaggaatttagaaacagtacgcgagaaactttccaagttcatagcctgggaggaaaatcttgtttctaatccaatcatgacattaagcacaagcccaaagattagaacaaatcaagagatatttggcccaggcctagtggaaccactgccctctttctttgtacatggttttgggtttccctaagacgctggctgcctcttcacagagccacatatgcatgcgttttgttgcacgtgttgggaggaggaaacacccgagtttagccctaaagcagtcgggattgttttctctctctcagtgttgatatatttggaataactgaaagcagacctagaacatattaaaagtatagcatgtggagagggttccaggcggagacacagaacctctgtggagaggccaggccagaatgtgtgatcatctctcttgcctaagaccggatactgggccgggcgtggtggctcatgcctgtaatcccggcactttgggaggctgaggtaggcagatcataaggtcaggagttcaagacaagcctggccaacatggtgaaaccctgtctctactaaaaatacaaaaattagccaggcatggtggcacatgcctgtagtcccagctacttgggaagctgaggcaggagaatcacttgaacctgggaggtggaggttgcagtgagcattgcgccactgcacatcagcttgggtaacagagtgagactttgtctcaaaaaaaaaaaaatgtggataccaatcacgaagcttttgatcttcctttggttttcttttctggaatgcagttttgcatggtcagtcattaaagcaactccctgatatgttatcagtgtgatgtgactttgtggggcatgagctagcagggtcccattccctttccagaagttgagtgtcagtgttgccaatcttctgagctgaacaggtaccaccctggggcctctccttccctccttcctcttcctttcctcgggtgtcacaggtcagtcccagttggggtcctgatactcatctctatttcatcagcaacctgtggacaactggaggtacagacccttcacgaggttggcatgggtttattgaatggagccactgttcttacctcagagtaagttagggatacaactgagaggcccatttgatattaaagagccatcaagtcaccatacgaagtagcttaggggatggcaagcccacacttgctcacgactttcacccatagacaatggacaaactgggaggtggaaggtacccttttagttttgttatacagttgaattttctgtttttaggggacagttttggcatcttaactccatattcactgactcaacccatacttcctctttcaggtcattttttgggcctactaccccaaaagaggtgttatgtctttgctgtagggtaacagggacagcagaggcaagtatggcatgcttcggtgggggaaaggtaaattgaaaaatgagaagggaagcagtgcccaagcagctgcaaaattgttcaaaaccattttctcaactgggttaattgttcttccccatggtgcagagatacctacgccttcagaagtctgcatttctttattgcaaggagcagcctattaagagagacagattgtctaccaggagtggctgactctccacctctcttccctttgtctctctctcactcctctcctgctaacaccctgccccacaagacacagctatctgactctccccgccccattggtattagctttatcactgggaagggttgtcagcgataggaggggtgggcagactcaaaccagctctgcttgaagagtaagaataattacaaaatctcgggccgttatccaattactttgacatgtggccattctagggagttctaactggattaagttcattataaaaagattagtcctaggatggggactgtgcataacaaagtgaaccttcagaatgtgcgctgctgggccaccaaggactgtgggggtaaaaccgagtgaatggctttgtttattgaattactgcttagggattcgccaaggagttttgttcagatagagtttgtgacttaaagcaactgtcagcagtttcctgtttgttttccttttttcaacactattcttcaatgccattgtagttactgtcaaagcactaattcaaggtgtttgtccctaatgttctgtgtgagcatggaggtgagattattgatcaaaatggatctgagacacagggagctcatatattattcataaactgtgtatatgtgcacatatagagagagtgtgtgttcactcatataataccttgcacttgcataatgcttcctagctttacaaagcactttcatatttctcatttgacctacacagcaatgctttgggataaataggcattattatactgattttacagataatgaaactgagacttagagaagctaatctagagtcacccagctagattgtcccagaactgagattactactcagatttgctgttcttagcctagcatgaattcagtttacacatacattttaaacacaaagtacgttcagttcatggcagttgactatttggattcaccagctggttgagatcagttttctttctctattccctatgagaattgtatcagatatcagttttgaacaactaatttagttgctaagtacttttttctccttcttgaactcgggaaaattttacatgcagacaacaccatggagctgttctttggaagttatcccaaacccttcttctggtgtattcactacagtttgtcctactttaggaaaactgatcatcatttcatcttcctagaataagtgccccagctccttttaggatcctgggacatggatattggtgtcagtggaaagatgtaaattaccaatcaatcttttatattaataatttatcttagcaccttactttcttggacctcaaactccccctaggtgaactggtaagaattaaaactctaaactgataaatctgagctctaaatgtttgttaggatcagcagtgcctcagcttcctccccctagcccactgcaggcattgttaatggatcatcacacacttttctacttagcctaggcttggacttccacaaatctcaaaacaaatcgccaagcagccatcagcagtcagaaattggctagtaagatggtctctatttatcattctgatcctaggctctggtcaccccccacaaactccagaggccctgaaaggcaaaaccagaccagccaatgtctaatgccatctttatggcccatctggtgatcagcaattcaagataccaggaaaggccaaggggaatgtggaatgaataagtacatatattcgtaggatagttacagtaaagtttagggcagaagccagtttgctaaaacagagaggtttctgtgtaagcagaaatctagaatgctgtagactaatgattctgtctacccctcttccccagaaagaaatgtgcatagatacattttgtacaaatttttacttcttaaagaatatctagcttatagaacaaggttaaagacaatatctactgttgaagtatagtcgagattctcatttgcaaataatagaatgctaattcaaaatggcttttttaataaagaaaggaaacttgctcataaaactaaaaattcaaagagtccaggcaaggctggatctagtggctcaataatgtcattgagactgtttttacatggtggctcccagcattttcatttaccctcttcagcatggagtttggcagataaaggagcttctttttctaatagttcctgtaaaggttctggagcttattctcattggcccagcttggtcatgtgcccatccctgaacaagtcactgcttctgggggatgtactgttcagattggccaggcctgggtcatgtgacctccctggagactagcctggccccactcctccctttcatcccgaacagcaacactgaaaaagatgcagatgtggtggctggaggaaaggtgacagcctctcaattggctgcttgctatgtcccagacccagtgctgggtgctaaaaggagatgttacagacgggtccaaagcttaacagtctgtagacctctttcatgtaaataatcttatttgaccctgacaaacaccatgaggtaggtattttattatcatgattatacagaccaggaaagttatgttcagaggggctctgaaattctctcaaatagacctggtgcttaaccttcctttggtccaactccagattctgcaccctttcgatgagccttttatcatgatccgtgagaattttaaggtgcagagtttaatttcctccttcagttacctgaaagggcaagtcagagactggatttccatttctccacttgggaagaagtcttgaaccccaaatgtatgataaggagaattgtatcccctactgttcttcaatacttaggtacggtgcagaaataatatcagctataggtccttgaacatgtactatgtaccagacactgcactaagcactttacaaagaatgtcccatttcatactaaaaacaaccctatgaaatagtatgttttaccccgttagatgctgagaaaaggaggtgtgggaaggatgaaatgacctaacctagggagtatatagagccagagtttgaactcagctctgacttcgattctgctgttcttcctgccgagagatggatggccctaatatctttgatttcagccacagaccaattagaattcaataggacgctgggtagacaggagacaagaaagtcatcaatcccaaactttgtggaagccccccaaaaagtggaacaaaattaaattttagacaaattggtggtgatttaagagacctcaaaataaaataaggagaaacaaataagctacaggttacaacaggaatattgtctttcaaaggtttcaaaagttaaaattgactaggttttcattgtccaagtcctgtggcctggtttgcttttatccgagagccttgtgtttcccttgcttctataactcaggaatgacaacagtcctgggggatcctgagtggttgcatctggagaaacgggcatgccagccagagcttcacttaaacacagcacgcaccctcctcctggaaaccctgtcccttgccacatctggttgctgcagattggcattttcacattggttatgattttcagggtatacatctcatgacaacactggcagctttcaatttattaggcatattagcaaataaaactgtcccgaaaagcccagatttaatatctggaagattcatttcaggactgatttaatgcaacctgcatagtggtttatttcacatctccaagttgggactaaatcatccttgtcttgttgatacccataatacaatggttggtatttgcaaaatagaccaggctataaaagaatctgaagactctagttgctctaaatgttttttacttaaaaaaaaagataaagatactttataattttatgtgtctaggagatttagttttttttcttctttgctctcagcgatgtcatttaaatagaaataataggaagtatgttcagagatgtggttcttcttaactgttgatttgcagctatggggaatcaccttctttctctggaatcaccacactgcacaaagaactagtgacatctggcattcaatatgacaaactatagaagcaccatccagaaacaattcatcgtttcagtatacttgttcttaagccctgggctgctatcatactttttcaagatgaagacttgaacagagcaaacctgttattaccaaaccagctaatggcacttaccaagggctattaccctctgttagcatttatcacccgcatctcatttgacacttatcatttattgcctgacagttttatttatcttttcttttatcctccccgactgtattaccatctgctgaaagcctgggccctagagttagcccagttcaattcaatcccatctctgctacttactacctaggtaaccacagctgtagaacttaaccgctaatctcagttggctcatttttaaaacaggcataaaaataggataataggattaaattaagtaatatatacaaaatctttaacacagtgccaggcacgtggaaagtgttcaataacatgatagccactggcattaagattaagacaaggataataacactgatagcataaaatgtggtcttaaatgttgctttccatttcatgtaccaaagtcccttgcataaaagtagataatgtgcatctgtggaaagtcttgattatagagcatctatgaaaaagagccatttgtttgcattttaagattgtgtacatctgaaagtgaacttgtgacccatcgaggtgcttaaggaagcttattttataggagaactcttaaagttgctgaatgtgtttacaatgcttggtttttctagaaacttgtcttcctctatcttgtttgcattattaagttgcttagctaagccttcctttatagaatctacttagatcatcttaagcctttctgagttagcaaaaattccaaacttctgcagtgtaagttttgctgtatttgtgggatctattaagctcaccagacagcagttccagccagaattccttgtccagtatacatccgtgctcttccctattacgtgttataatgtagtgattcagaggcctgatgacgctggcttcctttggtaaaatgtgcccgagcccagcggtgatacctgaaggcccttcctcatcaatcatagcgctgacccacagcgcagctacgtaagttgcccagggggtttgtatttgacctggtgctgctttgtctgcattgggttcttttagtctgtgtttccggttcctcgcatgcttctcccaaggcgcccattcctttgctgcctacagggttttatgtacccggtgatgagatttttccatatcattgtcctgcagtggatctgtagctctatcatgccttccactgtgaacaagtatctctgccttccaaatcagggtatatctctatataatcattgtataggctgggcacagtggctcacacctgtaatcctagcactttgggaggctgaggtgggcagatcatgagatcaggagtttgagacctgcctggtcagcatggtgaaaccccgtctctactaaaaatacaaaaattagccaggcacggtggtgcacacctgtagtcccacctactagggaggctgaggcgggagaatcgcttgaacccgggaggaggaggttgcagtgagccgagatcaggccactgcactccagcctgggtgacagagtgagactccgtctcaaaaaaaataataataatcattgtgtagagaaaaggataaggcagaaggggaaggagattcaaaataaaatcactgtatctaaataccctgaatttatactcttaaaaatcacaatacccatgtatcagtatttgttctagaaaacaacagtatcatcattggccactgctgcaacagtacaatcaggcaaggatccatctgtcactttctcagtaccaggcaatatgctaggcactttctatatatttctttcctatttcctgtttaaatgccactttctctcacatactgatgtctgctattagaatcaaacattctctgtgaaagttagagatttatccatatcattaaaatctatccatagaatagcacctaaatgctggcaggatttttttggtggggatggatgcttatttgcctagtatttagccagaatatgttctttgcctcatattctgccatcatgggcaaaacacagcaaatgtatgtatcagaagaagttcactcttcctccaagtagtttactcccaactgtcagaaaattgttgtgatatattggtacgttagaacaagatttattgccgtattctgaggaaaaagtaatgtaataaatatacagatccgcagtatctaccatgtggatggagcccctggatttatgactgcattgtatacttgcattctggaagtcagaagttgcacctaaggtatttctgatcagaagctttagtgtgaatctgagggtttgctttgggaaaaaaaaaaaatgcataatgattataattgctatcgtttattagagtcttttctttgccacgtgctgtgctaggcaccattctttattctagtccttaaaaatatacaggatagctgtaagattcccattattcagaaaagaaaactgaggtgcatgaagagctatgtggctcacccgaagtcatgcagcgaatcagtgaccgacctgggatcctcacccaggtctgtgatccccgcctaccaccatcctagttgcttccaggttcacaggctcagagaatgccaggcctcccgttccgccgcacaaggccaatgccatctagatccaactcccccttaccccaaccccttatctgatctgcctagttgactggacctgctaggtgtatactcagtccatttcacctctgcccctctgccaccctcgaaggccaggctgccaccaccttttgcctggtctgctcccttctcagtgttctctcctcactcactcagtcttctcttcgttcaattcatttcccacagagtgaatgtctgtcttccaaaatgcatgttcgatccctcactctcctgctcacaacactttaatggttttaccttctcttagggtagaaacgataatgaaaatcctcccacatggccttatagggacctgggtgatttgaccccagcactcaccccttggcctctgtgctctgggtgcactgaccttctccctacccctccagtacgctggactccttcctactccaaggcttcatatgagcttttccccccaacttcacctggttgagtcctcaaccagcgaattcttccaatgccagctcaggtgtcacttccttcagaaagccttttctgattgcatccttgcccccatatacactgccttgtgtgataaactcactttgattgcactaagcccagctatagttaacaagctatttgtatagttgtttaatctctaagtacatcccccaaagtagaagctccaggacagcatggattatgcttaaatttttaccacagtagccccagttcctaggatgagacaagcacctagtaggtgctcaataagtatatattggttgataaaatgactgaatgattccagtgcccctcccttcactgaacgccaaccaccctgtatccattaagggtcagtgttagcatgtcacccagcctgggaacaggccagtacaggaagtcaccggatatggaaagctgccctgcttgttattccagcataatgtcagctgcttttatcattcattttctcccttctggggagattcgttctttctcagtggtgactgttgcttgggaggtctctcactggccgcttgctctaagaggaaaagctaccaggcgcggtggctcacgcctgtaatcccagcactttgggaggcctaggcgggtggatcacgaggtcaggagttcgagacaagactgaccaacatggtgaaaccccgtctctactaaaaatacaaaaattagctgtgcttggtggtgtgcgcatgtaatcccagctacttaggaggctgaggcaggagaatcacttgaacccaggaggcaaaggttgcagtgagccgagattgcaccactgaactccagccaggtgacagagagagactctgcctcaaaaagaagaaaaaccgtggcccaggaaggcatgtgaatgagctggtgcagcatttggtcttggcccagtggatgttgatttcctgtctacaagtcatgggacccaagtaccttaatgccatgaggcagctttggttagaatctctttgctctctttcactaatttcacatccacgtggttctccctaggctagcagccctaattttgtgggggaaactaattacaactatgggatttcagagctttcctttggtatgccaggttcgttgcattgtttgaaatttgctttcagcctgatgcattttttcagttgccagacaaatataaacagatttgcttctttaatgtttgccatcttggaaagaatattctttaaacaaaaatcagacacaaatacaaaggatgttgctcaaagaaaccgtaccacagttgtctgtgagcacagtgatgggattgctctgaatttctccagagccctaagagcttagaacagaatgtcatgatttgtgctgaagctttcttttcttcctgctcattgtaatcctatatatccctatttatgaaaacaccatgaaagctgaaatgcactcaaacttcccttttggccaggagttagaggcatgtgtagatccaacagagttttccacttaaaaggatcatttcatcagtgtggcgtcatgaccaaagaatggtcaatccattaatacttattgaggtgctatggtataattaacggaatgaatgaacacactgaaacaaagaatggaggctgcattccctgactttgaggaaggtactctctggttgtagagataagatggaatccagagctgaccacaataggaacaaatcatccctgcaggctgatgaagtcagggaaggcttcctggagggggtgtggccagaggccctcaatgcacagtgtagtggttcagactttaggaagtggagagagaaaatgaatcccaacttcaccacattttagagtgtgccctcagacaagttagttaccctctctgagtctcaacttctcatctgaaaaatgagggcaatacctctttaatagggttattattcttttttgttgttggtttttttttttgttttttttttttgagacggagtcttgctctgtcacccaggctggagtgcagtggtgcgatgtcggctccctacaacctccacctcccgggttcaaacaattctcctgcctcagcctcccaagtagctgggattacaggtgcacgccaccatgcctggctaatttttgtttttttttttttttttagtagagatggggtttcaccgtgttggccaggctggtctcaagctcctgaccttgtgatccgcccatctcggcctcccaaagtgctggaattacaggcgtgagccaccgcgcccagccttcttgtttcatttttgaagatatgtgaggtaacatgcataaagcatttaacataatgcctgacccacaataagtgttcaggaataggcagcaagtattgttgttgttctaattcccaaaatagaccctctcttgcctccagacctttgcagaagtgctcccctttcctacaacactcctccccagtctcaaaggctgcctttgctcttctttggggattgaacttgcatgtcagttctagtaggaaggctgctgtgatcctgtgtgctcccacagccgcgtgcctttcccatcatcttgtggtatcagcctgtctcttccaccagcctgacatccacagaaggcagacactgtaagattgtcctctgtttcttcccacaatacagtcaataattatcagtagaattaatggatgagtaaatgaattagcaatttctctcccatagttccaccccctgcagagaaaatgtgaatcattgactggatcatttaaagactggctatttaagtagaatctcaaccagcaaagaggaaagccagacttgggtggctcaaaatcatcaggctgttgagctctccagtctcttccctcaggaagatgcttcccataggttaattattcctttggggagttgatggcaggtgattactgctgtgccatctacgaggagcgttctccctctttggcaaatggatctctttagaggacaataaagctgaaatcctggtgggcttccgggaagcaggtggagcccatcactccctaaggaacatggcagtttgtgtatttgccacaactccagagccaccacggcctgttagagcagagtgcaggctctcagtcagaaagggaggaattgggcaagcagcaccagcttagtaccctgctcaagaagtattggttgaataataaatgaaggatgaactccttcttgcccctctgtattccacaggccactcagcccttcctagccaggctcctcctcttaaatcatctgttagcgcatcactcttgtgctgaagatcttcttttcctttattgcttattcaataaaaatccaaactctcccattggcctttgacgacctccagggtctcaaccaagattatccttgttttctctccaaccctttactcacatcaatgcttcggagctagagaccctagactcaagttctggctccagcacttactaaccacgcttttaggagaaggtacccagctctttggagcctcaatttcctcatacttaaaaagggaatcacagttcttacctcctctggctgttttttttgtttgtttgttttgagatggagtcttgttctgtcacccaggtggagtgcagtggtgccatcttagctcactgcaacctccgcctcccgggttcaagcaattcccctgtctcagccgcctgagtggctgggactacaggtgcataccaccatgccccactaatgttttgtattttagtagagatggggtttcaccatgttggctaggatggtctcgatctcctgagctcatgatccacccgccttggcctcccaaagtgccaggattacaggcttgagccaccgcgcccagcctcctctggctgttttaagaattagcagagatgctgatcagaaatccttagtgggctaaggtcttaaagtcctttctcatatgctaatgttattaaataccctcaccctcagccccatttccttatttcaccacccccctgcacatctctgccttgcatctttgttaatgctgtgttctcttcaatcccacaagcttctcttgatccattgatagtgaatattgttcacctctgtaagctggcaatgctttctctttccctggtatgcttgccagtattattcatgtggaaagctcagttacagtgtaagcttccgaagacaaggactgtatcttataatagtggctactgactgagctctttctatgggccagactaccacacaaggttatgcatgttgtgcgatgttcagctgtaggtggggcgatactcaaatcgtagcctaggctgctagtctttacatgcacagtgtggtttagatgtgtgcttaattctcacagaagccctacggggcaggcattcccgttttacagatgtggaaacaaactatgagggtaagaatttggccagggtttcacagctaggatatggagttgctgggatctgaccgcagtcctgtttccttcctaatccattggctgcccaccaggctgccccacggggtgtccctgggcagtcgcttatctatactatctacctttacatacgttgattggctggctgaggtgagtacactaggacttgactggaaaattttacaaaccaagaaagcaagggacttctgttcctcctacctcctagtctttctgtctcctagggaaagagaaaaattacaaagaagaaatctctgtgtgtgtgtagggtgtgtgtagtgtgtgtgtgtgtgtgtgtgtgtgtgtgtgtgtgtgtgtgtgtctttttcccctcttccctttcctctttttatctggtccagaagaatgatttgaaatatatagtgccttgtaccaaaaaaaaaaaaaaaacacaacaacaacaaaaaaactgtgtcaggaatgggtagggagttggcatttggggctgaattaggagaaatcgtccaaacaggtcctggctgcttaccagggagcacctggcatatggcagccacaatctctgcggtgggcagcctccatcttatgaagagcctgtggttcttagtgataaagcatggtcttaatccaaccatgtttgacaccaccatcccatctgggactttgtgatggctacagacttggcagagtcagggttcactacagagggagctaggattcccttccccacagttctgttactcagaagagtagagcgtcaaggagcattttctgaagtctgacttcagctcttgggtacgtgacacagacatctctagggagctactaaagtggttattgcaaaaggaacctccgggagtcaactcaggacagaatatcacgggcagttcttcctgtgcagtggtgtgtgctagtagacaccctcatcatacacctacttgctatgagtcactgtgttattcactgacacttacttagcacaatgtagggacagagctatgaaagctgggaggctgggcctgcagccgtgagattgcctgacccaccctccggcacccagcctaggtcctatcccctcatcgtatactcagtacacactttccctttccttctccaagagagctttgatcagatctctaaaattgtgacttgagatttttgcagagggagcaagtggagtaaaggtcactctcccccttcaaccttaggctcagtgacaccaggggccatgtctctcttttgctcacccctgaatccccagatactcccacagtgtcttgcacataaagatggacaataacatttgtatgacggatggatagaaagatcagtcagtcaactatttgttattccaactccctcatcttgcagattttggttttgtttgtcttgttttttctgaaaaggcaattgccaggtaaaaggtagtccatacataatataagataaaggggaaaatgaaattaaatgcgttctttctctttttcaagcacctttacagcaacttccctgacttccctagggagtttgatctatgcctttgtttacttcctcccaaatcatgggctataccaataagacaattagagagagtcccccgagttttccctgacagggaccaggagggtgttgggccgggctggctgtcagcaggttatcaggagagggggagacgaaggcagtggcattgccagacctgtgacgttccaggaggctttgcaggctctctgtggatttgcggtatttatcctctgaaataggatgtttcatcttcactgggtccaaaagcccacaggttattgtctaggaggcacatcactcatggcatgtggcaccaagaaagtggccaagggactcagtgtcctgggtggatcaggcctctcggggggctgctggtttgagagtttccagaaccggaccttagcttctcatgtgaactgagccacaggtgtcagctgccaagcgctctccaggcctatttctagacatgatggagaggggttccaggccacagacttccttcctaatcataataacagcagtactgtgctaagggtctgtattcattgagtacctattatgtgccagacactaaactcagccctctgcatgttttatctcttcagagcctccccacctacagtaggagcaattactatctctactgccccgatgaggaaactaaggctgggaggggtttacatcacttggtcaaagtcacacagctagaaatggcagactccggattggaaaccagattgcctgacttcagagcctcaaacagcaaaccattcagcatgcaaatgtgtctgcctatttttattgtttgcttgaatatacacctttttctctggcaagcttgtgtagagaaaattaacaagggtttactctcctcctcactgatagccctccttacagcgtatggctctccccactttccagccaaattttcttttggcaaaaatgcgggccatggggtgtcaaaggtaggagggataagaatcacttgaagacacttaaattcccagtcctcactccccgaggtgctgtttcacctagagaaatggccaggaatctgaactgtcacttctccccaggaatgcaggtgagacctccctggcctgtgtgacactgactaggacctcacctctgtctcatgggagtgacttatgctgcaagtccgtgggctcactgagtctcttctaagtctgccttccttaagctctgagtcctaagacactgagctcaaaggtagatgtggtccccgaggaaggacaccccacagaataaggcaggccagctggagcctgactttggggaaacacccgcctcctctgctgtggaggccggcccacgccatgtccccgtggcccatatgcattccatagcaccttctttcagctacagcccacgagccagtatgaactatttgcagtttcccattcatttcttttccccataggtgctaggttttactatctgctcatgtacaaatagacttctcaggtagacttcagataaataacctgccactcaacagagacagctatccctccagattagccaaggaaagttttaattccaagaagtctcatttccaattgtgcagaattgaccctctctttctgctcttctctggcccatgctggccttgattccagagcatccctgggtttgaattttgcctctacctctgtgtaattatgaacagcttttgctaggctggttaactgcactgtacctcagtttcctcatcagtaaaaggaaggtcatgatagcaactactcattggattgtcatggtgattaaatgatttaaatcacataaaataaaaagtttaacacagtattttgctcatgttaagtcctcagtaaatgttagctatctccattataacagcaacaataataactgttcttaatattattatggaacattaataatagcatttccacacttgggggtaaaatggtttatccgatggtttaaggtagagttgggaagcacttgctgttgtaaccctgagcaggtgacccaagctctactagccttggtttccccatctgtgaaatggacacaattagagtgcctaattcagggttgttgtgaggattgaacaggttcctaaaataatgcctaggaataagtatccaccaagtactggctattatattatcatcgttattacttaacatttttatgaataattattcattattgagtctgggccagtcatatataacctaatgggaagagtcttacgccaagaggcagaggcagactagcccagggactttcagcagaggtgcttggattatctcagcctgggttactttctctatccataaaattctgcccacttctcagcttccttccagaaatatcatgaaaatgggagaaataggtgtgaaagtgccttggctctaaaagtgctattttaagtaaagtagtacctacagtattaactacagccattcctgtttaaatgcttttttaaaaaatttcagtcctccaaaaaagactgtagaatgttaaacactggagatatgtttttaaaggtttttggtatttcctccttctagaaagacttgcacatacacaaagaggcaggcagtgacctattgagccacttttccaggcagaaggagggaaggtaggcagagacgacatacacggcagcctttgttgcctgacctgggacttggccccagacctggtccttgccagagatcctcaagggacacccgaggagtgtgaactctcacggtggttcttgtttaaacaactgtttttcaaataatgacagtcataattttagtgctatacagaagaacgttctaaaatttaatcattactcatttaatgcataatagagcaaaatataactagcatattaaaatctttatttttactggtatttccttcctaaattattttcttcttaaagcagtttttaacatatgagccaattttaaagggaagagtatttgtaaatacgacgcaaatcctgaaggtgaaaaaaactgcaaaaatttggaacatgccacattaaacaaagagtacctgttatttgtcaagcactctcctgggtactgggaaggtaacacttaataatgtatgatctctgacttgaaggtcttcatctgatgtgaggaatagctacatccacgctaacgggaatgcagtgggataggtgatgtgctggcagctcaaaaagggacaaactaagccagataaagcagagatccatcctgctagggcagctgagaaaagctgaagaaaggaaatgacatttgaactggctgttaaacatgtctcagttatccaattcatcataggcacccagtcctgcagtatgtaataatatttaatgtccctatgtcatggccctgacattcttgcaggcaaaatctcaatggtcaaggacatatgtgatgtaattgtgagttttgacaagctacatggtaagggcgggggccctgcgatgtagagcagctcagggagacagagacatgaacgggcatggtgagtgccaggaatggctgtatggctgattttaggaagaagcagtgggtgaagtctaagagcagattggatcccaggggtctccggtgttgaatgccacaccaggtaccttggacttttatctcttttttgattgtgataaaatgcaaataacataagatttactatcttaatcatctttaagtatgtaatttagtagtgtcaagtctattcacattgtcgtaccaccaatcttcagaacccttttcatcttgcaaaactgaacctctatgcccattaaacaaaaactccctatcccctcctacccccaaaccctggaaactactagtctctgtctctgtgaatttggctactctaggtactcatgtaagtggaatcatgcagtatttgtctttttatgactggctgatttcacttggcataacgttctcaaggttctacccatgttttagcatgggtccaaatttccttctgttttttaaggctgagtaatatctcattatatgtatataccaaatgtttatccattcatccatcagtggacacttgaattgcttccactttttagctgttgtgaataatgctgtttttggtatgcaaatatctcttcaagactctgcattcaatttaggggggtatatacataaaggtggaactgctggatcgtatggtaattctgttttttaatgttttgaagaaccaccattctgttttccaaagcaattgcactgtcttccattcctacccacagtgcataaagattttaatttctctgcatccttgacaacacttgttttttttttgatagtagccatcttaataggtgtgagttgatgtctcattgtgattgtgatttgtgtctccctagtgattaatgatgttgacaccttttcatacacttgttgaccatttgtatgtcttcttcgtagaaaagtctatccaagtcttcttcgtagaaaagtctatccaagtcctttacccattttttaatcatgttgttttgttgttgctgttgagtgggatttatcttttaagcaatgacaagctaaaaggtttttaagcggggctttaacacggttagatccagattgtagaaatataggtctgccggtaggaaagatgaattgactggtagaaacacaaagtagggctcccagggagttggctttgtgatggtccagctgagaaatagtgagagctggaactaaggcagtggtgatggttatctgaataattaataattactgtctactcactcccgaaaaactgcagtccctctaattgaagatatatgttctctcttagagaaatgagccccttctcaggacctcatacccacacctttccccacagttggatagacagacgcatccgtcctgctctgggaaccatagcttatagttttttggctatcctgaattccaagtcaccgctcccaagagaaaagcagtgttatcactgagaaccctgttggatgaaaacatgccctcagtagatcactttctgagtagtgcacacctttccccacagttggatagatagacacatccatcctgctctgggaaccatagcttgtagttttttggctatcctgaattccgaggcaccgctcccaagagaaaagcagtgttatcactgagaaccctgtggatgaaaacatgccttccgtagatcactttctgagtggtgagatgctgaaacaaacagtggagattccaggattctacctgactgggttcctgggctatcccttgtccgttgactctcatcagtttctcagcaaccggctgagctctgaaatgtgttgttttggtagttaggggactaatacctcacttgttactgcctttaaatataacaaacgacattctctttccttttattggaaaaagcaatggagcttagagttggcaaacctagagcacctcaccctcaggagctcagcttccatttctgtaaagtcaaggaaacaacacctccccctcttttttttttttttttaacagggcagagactacagattgccttactcaatatccactgtggcatctttctcatctaccttctggtcctgcagagatgggaatgctagaaatgacagtccccagactcctctgcatccagggctgtggttgtgattcagtatctgcctgtgatggcagaagactggaatagagaaatgagttaggtgggaagagagacctgccagggaaccctcttgctggtgcaagtcatggtgtcgctctggagctacagctctggatatagatttagaatctccacatggcagctcagatggtctaactccagatctggcagctggggtggctgcttcccacttccccagcttgtgcatagtagcagctcccttggtgcgtcagttctgcaatgctattcctgcaagttactcccagaggtgctcactggaacctgctccccgagcccattcaacaagtttgtcagcatgtacaagtttgtcttttgctacagaattgacagatgcttaccaaattgttggacttcctgcttaaactgtctataatggcttctgttacttgtagccaaacccagactggtttacagaatttaggaggttaacagaaaataacaagctaacactcctagcacagttcctggctcttagaaggtgctcgataaatattggttgactctgaaactgaaatcagggctgatttcatcttagtggaggaggcaactgcttaccttatgatgggatctcagggatgcgttctttctttctccgctctgctctgcagagtccacttacctgctcgttggtttcttgaagaaaacaactttgccaattagaaacaaggctcaaaactcaaatgcagctgggtgcggtggctcacgcctgtaatcctaatactttgagatgccaaagcgagcagattgcttgagctcagaagttcaagaccagcctgggcaacatggcaaaaccccatctctacaaaaagtacaaaaaaaattagtagggtgtggtggcatgtatctctaatcccagctacttgggattttgaggtgggaggattgcttgagcctgggagttcaagattgcagtgaactgtgattgtgctgctgcactccagcctgggtggcagaggcagagtgagctacacacacacacacacacacatacacacacacacacccttacacacccttaaatgttccttattaattatactggcttgcattgaactgaggtgtaagtggtcgatttggactcctttcctaaaagaagggtttgagaggggaggagtgagagagatggagggtactgggtcccaacccgcaggaaggagagaagcaggacatgggaagaggaagccaggcaaagactgggggctaggagtgccctggatcccaaaagtctgtgccccagaaacacatggtccagtccaggccgacacatgaccacttagctccatgtctatggctcctgtgagtggccaaaagtctgccaccatgactgaaatgacagagcagaagggtcagaggtgtgaagagagactggagaagcagacgggtcagatcatgcagggccttgtggacccgggtacagacttctatctagtccagtggttggcaaacccattctgtaaaggaccagatattattttaggctttgcaggccagacagtctctgtgaccctattccattctgctgttgtggtgcaaaagcagccgtagacaacatgtaaatgattgagcgtggctgtgttccggtaacctttatttcaggcagcaggctggatttggcccacaggccatagtttgccaatgcctggcttagtctaaggacactgagaagcctttaaaagatattggcaggacgtgatggctcatgcctgtaatcccagcactttgagaggctaagttgggtggatcacgaggtcaggagttcaagaccagcctgcccaacatggtgaaacccagtctgtagtaaaaatataaaaagttagctgggcatggtggcaggtgcctgtaatcccagctaactgagaggccgaggcaggagaattgcttgaacccaggaggcggaggttgcagtgagtcgagactgtgccactgcactccagcctgggcaacagagtgagactccatctcaaaaaaaaaaaaaaaaaagatatttaggaagggggttacctaatcatatttatgtttgtgaagagccctgtgacttaaggtggaaggtaattgtcaggaagcagagggatttgagtagcccagttgaagggatggtagcttgggggaggatgctgccagtggaggtgagaagtggactgaacagatatttgggagtagaaatgctagaatttggtggttggtcagatataaggattagggagggggagcttcaagactgacgcccagaactgtggctcgtaggatgttctggggcttagcttgctcaccctgctgtttatctgccatcctgtggtttgttaaactgtttcccccaaaacattctcaatcaaggcatttctcttcagtgtatggattcacctgtcattgccccagtcctaaaggttccgagctggaatgattcttgactctttatttcctacaagtcccctctgctcccatctagtcaagcacatgatctggtaactccgctactcaacctcttaatgaaagtatcctcactttccgtatctactcagttctaagttcagatgctaagactttcgctacatatgttcaggtattaagggaatcccaaaatgtttgtcgaaatcacttcagttcctgcatttaggatagtgagagttcacctagcatgcagcactcatagtttcatattcaacacaagcacctggccctagctgagccctctttgtcttaggcccagacctcttacctgtgtatttatctcccttatcatcagttgatacatcactgcctgatcaagcttcatgaagctctgttcctgtgtacctgctggaaaaacttctgatggttgcccattgcctccaaactgaagctccttgccctttccctggcactccagcatctgcagttgaagaccagctctgatctgtgccctttttctctctctcttccccttgcagactccttaatcttggtcagcctgttctcaaatgcatcatgcacgttcccacctctacggatttttacttgctatggttcccaccttccacttcttttttttttttttttttttgagacagagtctcgctctgttgcccaagctggagtgcagtggcacaatctcggctcactgcaagctccgcctcctgggttaacgccattctcctgcctcagcctcccgagtagctgggactacaggcacccgccaccatgcccggctaattttttgtatttttaagagagacagggtttcaccatgttcgccaggatggtctcgatctcctgacctcatgatccacctgcctcagcctcccaaagtgctgggattacaggtgtgagccaccgcacctggcctcacttcttgtgttctatacagaattgaaattaattatttgcagtttgaaaccttgctccttgacttactaacactgcagcatggggccagttacttctcagagcctcagtttgctcatctgtaaaatggagttcatttcattaaccttgcatggttggtatatggattaatatagaaaattcccataatgcatttaggatatggcaggtgttccataaatattgcttttcttcccctatacttcctaagagtgatttacataattaaatgagctcataattaaatgagcttagaccagtgtctcacatgtagtatgtgctcagtaaaggttagcctttttgttctaatttaatttgaagaaggatagcatttataaacaaagtgttctccttctccttgtcattccatcattatgataatcagttctgggtactcaaagatcaaggatgctccctgagcgggtgggaggaaagtaagcagcttggagccgggacaggagatgcagccggaggaaagaggaaggcattaaatgtgtacatttcccaaaatcaacatcacctaatttttaattttgctaatggctagtctttagttgagatgtcatgctgaaataactcttttaataaaagagaactaatgcgctcatttttccccttccttcctctatatcagcaaagacttggtgcaatgatgtatatcacccttttattttaattaagcatatagctttgagaggcttgtaaaaatgttgccaacagagaaatgctttaacagatgtgaacttgaggttggcttctcccatatatctttactacagaaaattgccctcttcattttgtacgtgaggtgaatggatgagcctgggtatgcgccttggagtggaagcgtgagagaagtaaagtattcaggaacatagagtgtgggattataagcatttttttagaaggctggggagaacagagcaaggaaaggagagctattttctgtgcaggatcatgtgtggagaagtgtcctgttggacagaagttttctatcattttcctttccacatgtcagatgacagatgatgtccaaataccgattttgaggggaaaaatcagggttttaaatccgagacccacaacttaaactccagcaatctgactccagagccagattaccaagaagctaaacctcttgacagctcaaggagcagagcaatgtgtcatgatagtaaggctgcaagcagttatcccgtaggatataaatgaaggaatgagcgatgtgtggtgggtatttatgcaatggcttttacctaatctatcagtgagtacagcatggaaaagcttaatgggtggtatttctgattcctgttttttaaaaaaaatagggagagagagacttggagtttaaataagctagaaaaagaaagaagcagagacagactgacagactgacttgtacaaaagagaacttaaaagtcaaaagagaagttcacccacgccaagagaagtaagcctgaaccagaagcagagagaagcagcagttctggaaccagggcagaagctgcctgaatgcgaacacacttgcttcacaccggctggaaagacgcattaaaactgaataaggaagtcggggagctgtagcccaacagcaggcatctgtattccttccgtgccgccgtgatggtctcgctggtgaataattcattctgagattatcctccctgcctctagttaagttgttgcccctgctctcagcaaaattagcccaggtgtgtgtggctattgtgattcctaacgtgtgaggcatcctggagaagggagttagccacccggtgaagtctgtagataaggggcctctgtacatgggggctgcccggaaggggttagaggctccagctcgctaaaaatcttgactcccaaaataaaaaccaggtgaatcaggtaagtgtgcatagcttacccagagacagggctgacttcctcattttgtagctatttattgtcctcttctagaattctgcccaagtgaggaccagatacccaaaaagcctttatatcccaaaaagaaggtcattgttgcagagagcctgatgtttcagcaatgcaaggtgctagagatcccttctagaaaaaaataaacactcacttccacgtagtagaaacccaaaacctcgcttgattttaacacctctaaataacttagtactatatctactgaatattgacattaactcttctcagaggaaggtactagaatagaagaaagcatattgaataatatcaaattgagtgtacatcaaaacctcgcatcaaagaagttcccttttttatgtgttctcactttttaatcaatgaaaaagtgacttgaaatgacaaatgtgtagaatccaaaacataatgttactattaggatcgaaaaagtaaagccttttggagtttaatctgaaaaagaaaagactaaagtgtaactttatctttgttagacaagggacatttcttaaagtttttataataattataaagttaatgttctttgttttttttttaaaaaaattacatattacctaattttacaatacaacagttcccatccacccccatattctcctatacagaggtagccattattaaaagcttaagtctctttccagagagtttctcagcagaatcaaatggaatcagattacaccccattttaaagtttactgttttgcttaacagtatatcatagttatgtctccatctcaaaacataattatttttcttataaactacatggtgtcctggtagctaagtgcactagaatttagtgtaacattaatggggcaatcattgatagagatttaaattgtttctagtactgctaatacaatgctgcaacaaacatcattttgtttgtatatatcctatgtttcttttttttttttttttgagatggagtctcgctgtgtcccccaggctggagtgcagtggcgcgatctcggctcactgcaacctccgcctcccgggttcacgccattctcttgcctcagcctctcgagtagctgggactacaggcacccgccaccacgcttggctagttttttgtacttttagtagacatggggtttcaccgtgtcagccaggatggtctcaatctcctgacctcgtgatccacccgcctcagcctcccaaagtatcctatgtgtattttgcacattactactagtatatctataggataaaatctccagaagtggaatgtctggggcaaagggcatgaacattttatgtataaataggtattgctaagtggttatatatggtgaggattttttgactttgaagaaggaagttggtatgtctgcagaaatttttaagaagaagtgaaacacataaattaaatccagagttctttgagctagacaaaaagtagaattttattatccacatataaccttgaatgtgtcactgaagctgtaatgtctcctttcctgaagaactttaagaagagcaatctcttatccaagccccaaatgctgcactgtctcattgatgcttagggaggccatagccacatgtccgtttatggatccaaaccactaagagctgaattcttccacctgagcataataaatggcaagtgcaaggaagttgtcagaaacacaaatcgggttcacaaacctcttataaaatgtcttctcaaaccctcaccttagtgcagccgttgacaaacaggctggggccctcagtgacaactgacataccaacttcccttatcaaagtattactagccccaggggccctttaaatttcattttatttttgttctgatgcaagtcagaacatcaggcagaaatgcatatatatgtaagatgaatgcagtgcgcagttgaaatttctcctgctatgagtctctccacaccttgaattttggactctcaagtcgtttttaaatgcagcttcatttttcttccctgtcattacctgatttcatctgaaaatctcagcatgtggttctcttttcccttaattcattagatttggcattgctgtttattatatcaacttgacatctgtctaatataacatctctgaagcaccaggatgttgggaaaaaaaaagggagagggagaagaggatttaactcttcagggctaactgaagactgtttaaatttatagaggtgactttagccctttgtagatcttcctctagatagaaatatatttgtaatcaaaatgataatccatactccctctttcttctgctgagatgaagggagagagacttgggggaaggctgagctatttattcacagattgttttaagtcagagttggtctgtcctgggagagaagattgtattagcttgataaagctaaccctttcagcctggggaaaaaagaatcacacaatactgctgcgaaggtttccttggcttctccaaagaggaattagattttaacgtgccaaaaccttccagattggagggtatgcttctagagataatatggacataaaagcaatactggctttgtgttttttgatgggaaataggaaacattacaacagactccaggttttagagagaaggctgacagggaaccccagaagcagggggaagggctgtggccatctttctttaatacagagtcttgtaaaaaattgttattactatctgcatcaagatgtgtcttgtttggagtactggttggaattcctcagcatggaatatcaataaaaaacaagggatttgactgagatttatgtcaggggaccagttctttccatgcctgtagtgccacacacagattcagaggtaggcaagaacacaagctggggctgagacacaatgcccaggaccacagcagagcaggaagggttcagagccgttaaaatccaactcgtaagtctcaaggtatagtaagactaggacttggctaggaattgctgttgattctggtctgggaaccaaagctcacctccacttgatcttaggtagggtattgatttctgattcttttcaagtctctcagattctaaacctgatgattattatgcaatgatgttgggtcgctgtctattcctagttactcatcatcccactagagggatagaaaaactcctatttagcaatcccttcatttatttccgtctcctttgtacctctgaagctgaacatattagtcatgttgtatgacaaggaattcccagctgttcagaaggagagagggagaaatgacagggagagacgccgctatcaataaaacaaagcaccgtgggtgaggtgtgcagcattttggtgttgtcagcaatctagccagccccgagtcaatctacctgtataaggcttccccagtggagctggaagaaaagttgcctggagaaagaaggagaaaaaaagaagaagaatctccttaagactgagaaatacattattttttaaattggcaatcctttttgatgagttaaatggaagcaagttgtgatctaaatcaatggaattgatagtgtttttatcttgaaaggttaactgtatttttgccactctcctaactcccaagcaacttggcttttaagaaaaaagaaataatcctctgggcaaggagcctgggatacacttaatttagggctgatgtttatgactggtcattgaccttgaaattccattagtgctaatgaaggacagtgctggatgcatccgggctgagtccagtaagtgacgtgcttggcgcctgcagggccccgcccctttgtctctgcacttggctgggacctgtcttctctgggtcctgatgcctcagcagcagctctgtcttgcagagcgaagcacctcccacagctgcaggttctcccaggccttccctccagaggagaggagaaagctctgttggattaagagtgtggtgcttgctctgtgtgtgtctcccttcctacagcaatgacattcagaggcagaatatgcagctggcattctaacattttccatctaaaaagagccttagagatcactcaaatgtgggctccacatatgcccatcacttagatttaacaattgtaaatattttgctatttgtgtggtggtggtggtggtgattttgccattttaaattacagacattgttatactttattcttaaatatttcagtatgccccaccaaaaagtaaaaatatgtctatgtaacaaacctgcacgttgtgcacatgtaccctagaacttaaagtatcataagaaaaagaaaaccataacactattatcatacctaacaaaatgaatattaattcctgagtgtcatcccatatacagtccatattacaagtccctcagttgtcctaaaaatgttttccaacaattggtttgtttaaactacaatctatacacagttcacatatgacatttacttgttaggcctctttttgtccaaaacgatgcggttccatacagcagcctctggacacatgtagctgatgagcagataaaatatggctagtccaaattaaggtatgctgtaagtataaaatgcaaagtggatttccaaaacagtattcaaaaaaaaaagaatgcataatatctcattaacaattttaaatagattatatgttgaaattatattttggatatgttcgcataataaaacattaaatatatttaaagttatagcttatatataagctgttttataacaactattaatgtattgggatagaaaagcaactttacaatagagggattggtaaatcttggcctgacaacagcgaaccaattcgtacgaggaacctctcgattggttcactgttgtcatgccgagattgatcaattgctctattgtaaagtcgcttgtctaccctcactagcagcaatcacccgtcactgataatttggcatcctaagaatcaaactttaacttcaaggttttagcattcattgatgactgttgcctgaatcagttatttaattagaggttgtaaaatgatttttccacacttcgtttaaatatattagtcagaattcatatgaaaagcaaagttcagaaacccagactatgtggttaccgtgaagtacagttactatgggaaagaccggataaaagctgaattctcccccttttaactatcaagtttcagaataaagaattggtaaaagctacctcttttgacagattacgtattgcctgctttcacatttagagtattattatgaactcatggatttttatatactaaatataaatagaatttttaaaatgtttgaattagtttctagcatttaaaaaaatcaagaaaaagaaatctggctagtgacagtaagcctacatttttaccccccaatgtcctctacagtggagtttgggctccatcctcagatggggcatgtgttcttttatgaacgaccctccccacccagacacaggattaggttgtctgccatgttcctgtgagtatgtgagtttgtagccccaagtccaatcacctatgtcataaattaggaaattacagtacagaaaagagaagcacagtacagaaaagagaagtacgctacggaaaagagtacagaagtatagtacagaaaagagaagggactggctgatggtggaatagcaaaacgagtggcagagttgggaatagaatccaaatgtcctacttcccaggaggaccagtggtctcatcctcagttaccaagagatgttcccagaaaagtccaggtaacggcagcagcagctagtggaaagtgcccatttagcatatgctctgcattttctgtgtgtagaagaaagcttattgctattgccaatgtggctctctctgaccatgatttaatcttccccaaaccctgggcagattcagaggctgcccacaacattagctctagttccgggccttcctctgggactatgatctacagagtcaatgtgaactactccaaataaataagattagtgcaacctaattaattcggagacccccttgggcaatatatttatcaaaaatttaagtgcacatagcctttttgaccaagcagtcccactgctaggaacttttctaaaactatattcacaaaatattccaagacatgtgtaccttgaagttcactgttctcatagaaaaccggaagcaaccttcaactgggtaccagttaataacttatggcacatctatatgaagaaagagtatgtggccatttaaaagagttaggtagagttacatgtgctgatactgtaagatacacagttaggtgagaaaaggaaaatgtagaacagtgtgtatattttttaattgtgcttattttaaataatacgtatatataccagtatatgcataaacatttttaagaaagatatataagaaaatattaacctctttagaggaagagaccagaggtcagagtgggggagaaagatatgggttttacttttcattttacgtctattttttgtttgtttgtttttgtttgtttgtttttttttttgagacggagttttactcttgttgcccaggctggagtacaatggtgccatctgggctcactgcaacctctgcctcccaggttcaagcgatctcctgcctcagcctcccgagtagatgggattacaggcgcctgccactgtagagacagggttttaccacgttggccaggctggtctcgaactcctgaccttacgtgatccacctgcctcggcctcccaaagtgctggtactacaggcatgagccactatgcccagccagattattttttaaatcatgggcatatattctttaatattaaatttatcaacaagtttgagtgtttgaataaatcagctgggttacggaaaagctaatggtacctttctttttaatctggtgttgtggtcacttaatatgagggcgttagtaatgcttctcaaaccaatggcagccagttgccttactaggcgcatctgttgaactccgtatgtattgattggtgcaaaactaattgcagtttttgccattagaaataatggcaaaccctaaccctgaccctaaccctttgccattggaagtaatggcaaaaactgcaattagttttgcaccaacctagtaagttctgagcacttagccaggtgcgatgggcagtacaggcaagtggtaaggagcttgcagtcaagttttggagaaaaggccaaaaataactcatcagtagcaggggtctggaattcaaggctgatggggacttctagactttcagtgcctcagaatacaaaagaaaatctatcaggaaaccagccagacagggtggaatacctaagccgaatgagctgtaacaagtgaatccaggctggatggcacaaaggggagggagagcagtgtgggagaaggatgaacaggaccagagcagtgggagagagaaggacaaagtaagggagccgtgcagaaagtttgaggatggtgatgtggggaggagatgggtttatagcccagcctggccacttgtggagggaccatgggcaaaccctagtttcttcataaaatgcataaaatacatcatagagacatagtaaagattcaagtgtataatgcatgatcagtgttcagtatgtttgtaatatacacccaaactttgctggctctatgtaagtatgtaggggaggaaacagtaagaatagaggcagctaatggcagagccctgagtcacatagtctagttccaattcttgactctactgctttctggctctgtgacatgaagcttccctgacctcctggatccttggttttcttttctggtaagttgggagaaggtgaaaaaactggtgcatgctatatacatttgacccttgaccgaaataggggttagggacaccaacctccctcctgcacagtagaaaatccacatataacttttgactatcccaaaacttaactattaaggcatccagttaacagtaggctcttaccaataacataaacagtcaattaacacatattttgtttgttgtatgtataatacactgtataaaatatgttaaaatactgtatttttacaataaagtaagctaggggaaaaatgttattaagaaaatcataagaaaaaataaatttaccgttggttaaatggaagtgggtcatcataaaaacctccgtcctcatcttcatgttgagtaggctgagcaggaggaagaagaggaggttagatttgctgtcttggggtggcagtggtggaagagaatccacatatgagtggaccagtgcagttcaagctcgtggtgttcagaggtcaagtatacttcatacatggcagtggattgttgtgtaagtgaaagtcaatgcaaaaaataaacgggagttcagcacaggcaacattttactcatgcagtgtaggtttcatgcagttttaaaacattattctatcaaatcctttctaagactctctaagataattgaggcaagagagagctacaacacatgagggaaaggtttctctaaaaccacacatgatgagactcagacttgaacctgaatttgctatgctctaaactgctggctttcccgctatgatcccgacatcttatatgccatctaatcgtaaaccttccttattccaaaatcttggactggaattatttagaagggtaactgaaggatggctaaatgatggcatttcatgctgccagaatgcatgtatgtattttcattatgctgacatgacttgtatgtggcgagccggtttcaagaaataacttcctaagctatgcatttaatttagatactgtgaaaccctgtttttaatcagagattcttcattaaaagcttattcactgggagccaatgaaaagtcatagaaagtacctttaaatccacaatgcagttgttctcttgtgtgtggtagtcacaccagcatttagagaccatgcagaaaggtcgggtggggtggggtgaacgctaataggatagctaccggcagctccaggaccccataaatcattcaaaatgtgtgcacgggagtttaacatacatatatctattatatgcacaataattattccttcacaagtgtttttaaataatcattttgtatttaattaacgtgcagtatttgtcttgggatgttgagggtaaggggcagagagaggagagttacaggcagagagaggaggctggcattcgtcaaacccatcaagaggctgcttgattttaaacgtagcttttctgcttttggtttcgtacctggtacagaacagcgggctgctctccccatttctaaggtctaatattttcatgagtgttttctttacaaaaaggcatgagggctgtgatttccatgccaatctcatgggatgggggctctagttgcccttctgaaggacacaaagcataaactgtgttttaaaagaggttctctttgcagaaggcattctgatcaagcatacagatatgtttgttattaccatctcactttgcaattgtgatgtttttttcttcttttttcttttttttttttttgagacagagtctcactctgtcgcccaggctggagtgcagtggtgccatctcggctcactgcaagctccgcctcccaggttcacgccattctcctgcctcagcctctggagtagctgggactacaggcgcctgccaccacacgcggctaattttttttgtaatttttagtagagacagggtttcaccgtgttcgccaggatggtctccatctcctgaccttgtgatccacccgcctcggcctcccaaagtgctgagattacaggcgtgagccaccacgcccggcggcaattgtgatggtttaatccatcattgatatatggccaaatatgtgtgtgtgtgcgagtgtgtaaatatacagatgcatgtaagtgattatgtaaatttgtatgtatgtgtttatggatgaaaatatttctttaaatgtctggagtgagctaatatagtagaaattgttcatttagacacttgagtcttaaagatgattgctctatgacaacagaaagagaaagttacattgagccttcagtttccatatcgtgtaaacacacagacttcactacatagctagcctgaatcagccagagaagtaaatactctaaagtgacccatcatcaaggggagaagacaattcttttaagaagcttgttttcagcccagatggtttggtcctgcccacaatcatttgatgatgtgctgctttcagctttggaatcacatacctctctgtgcatgtttcacaagaagagaaatgcagatttgtaacaaatttagtgaatgggtttaaagcaggttgtgcaaaaaggaaggtgggcttcttttgggagacagaaaggtttctctaaaatgtgatgtggctcagacttgaacctgaaaagtagagccaagtctaaagagataagtccggagatcttggctcaaaggacggtgaacttcaatcccttaaaacgtgctcaaacccagaccagaaacccaggtttgctgccaggaggagctgagtttggagactagcggagaggaaagcaggaggcatcgttttgttctttgtgtctctttcttcttataatgcctaaataaatcttcaggctctattctcaaaactccaggccagggattaccactcaaatgtcttcaagtaaagtcattgagtgaagtgggcaggcataataaaattatttctctacgataagaaaaataacaacgcaagctcaatgataaatggcagtggacacaggggccttagtgttaggaggcaacagggactcctgtgggcgatgctaaactggaaataagaattgcctgtaccttctacagagggcggctgccactaagctttgcgccatgggggagaggacctaaattgatggatatctggagtttgcaaaggaaaccaaaaatccagatagatgtttgtgtgaatttcctgattataaaatgttgactctgatttttttttaaagaatttgcaagccaaattaaacaccagtttccaacacatgctgtaagcaaaggaggaatccataaaaagtaggactatgcccaaaatatcagtactatgtgtgagagcagctcgggggtagcccttgctgtcctagctgctgtttattcacatacgcatgcaggcatgatagatgtgtgaccggaggacgcaggcctgtgggaatgacatgggtctgcatagacaagcctttgagttgttctatttggagaaaatgcaagaagcctggcgggtacctggtggttttcatgtcacctttcacagctgtaagggaggtcacacatccaagtaggggataggtaggcattatgagcatttttcaggaccctcttatgatggacttgtaaggtgtgcacctctctgtgagaaacatctgccattcctcctcaggtcttaccatgggaagcatttttagttgaaatagtagttgaacacctccatcgtttgtaatagatggtatagggtaataaaggttgcagtgaaccttattgtctagcctacttttcgtatgatttcaggataaaggagttctgtaatgaaccctgcttgctggtcctcagagttgctttcaagtgcaggtctttgccttgttcccttgcagtttgttaccctgattataggtgttccaaagtcccttgtcttaaaagcagggagaagtccctggagccacctcaggaacaatcaatccagagcactgcttcccttctcagtttagcagtgcagtccacgaaaggtctgggaattggagacactattaattcaggctcttcagtgtctcccgtcctctccaccgctcatccgtcttgacatcacaattcattcccacagggtgacatcatctctgctggaaacctgccctcactcttccgcagaccaaaccgtggactgcatggcattcagacagattaggagagggcaagggtatgagaaggtcaggacgacccaggtgactcgtctaccactgctaagcatctgccatagacactgtcccttccaaaatgtttgcaaggaatataatgcaaccatttaaaaagacgagtattcagaatgcaacagcatggaaaatgcttactgcaatatggaattatattttaatttattggaaaataggcattacattcaaatgattcaaaattcaaaagatataaaagggtataaaatgaaagtctccttgcctctcctgtgtacagccacccagtttgtgatgtttggtgaaaaaagaatatgaaatgaaaccccccacctctctctctctctctctctctctctctatatatatatatatatatatatatatatatatatacacgtataatatatatataaaatagatatagatagatctatatatatatgatatatatcatatatctatatgtatctatagatatagatatatgtatacttatatgtgtatgtgtgtaatgaaacctcgttctctatacacacatacatgtgtatgtataaacagataatttatccatagaagaaagactgaaagaaataagcaaaatatttacagtggttattttgaacagaaaaactacaggtaattgcttctacgcttcctgtgttttccaaaatgtgctatgctatatgtatttctttcaggaaataataaatgcatttctttatcatacatgtaatacacagtcattgaagtcactgaagcaagcttggacatgactagtcatcaaaaagaggaaaatggaagtcattcgttttatcacaaacccagaactcacgactgatggcacttaacatggtcacacactaccttcctggccttttctttgcagatacatgattatactttactacataagaaagaaaggccctctaactggggaggatctaggtacatttgcaaccaatcaaccagcaacgtggaagaggaaaaaggatagaaaggaattaggctcttatggtcagcctgtcagtgtgaggccttatggctgagactacccctccaagctgacccaaagctgtggctctgcaccgacacagggctaggtagggcagaaaggctgctgtcagccttgtggagcacagagacttaaaagactggtgagaaagtataaaaaaatcccagctgggcgcggtggttcatgcctgtaatccctacattttgggaggccaaggcgagtggattgcctgagctcaggaattcaagaccagcctgggcaatgcagtgaaaccctgtctccactaaaattcaaaacattagccgggcttggtggcgtgcacctgtagtcccagctactcgggaggctgaggcaggagaatcgcttgaacctgggaggtggaggttgcagtgacccgagatcacaccactgcactccagcctgggcagcagagtgagactccatctcaaataaataaattaattaaataaataaataaacaaaaaatcaatccctgccttgctcccaaggacaaagggcacttcaaaaatacaatcattccctgaatttcaactttcaaacacacacaacctataaacactttattattaaaatgatttaaaatgcagaaatatctagagttacaaagtacatgtttttggccagaaatttttcttttcctctatttcggaaaaaaatatatatatagaagattcccactaaaccctcttctcccaaggccacttatccacgtagaggtaacccctgtgacggtttgggatctcagcagaccttttctgatgcacttgcattcaaattcacagtcatgcacaaacacataatggatgcaggtattttaagaaaattaaactctctgttttttcgttctctgagctctaaatctcacttattttaaactcttttccagagcaataatgtttcccatgtatgaatcaccaaatgctaaatgtgcttttctcagcaaatgcaattcatttgagaatagctcccaataaattgcctgtgatgttcctttatcgctagagacaatgggcaacacaaaggcaaggaagggtcgcaccaaaccagtcattagttttaatttggtctggcagttttaatccttactgtatttttaagtataatagcatagtacggtatgttcagattttcttttcattcttctttcctttcttgaacattaaaatattgggcaaggtggggagaggaatgtgatctcttccttatgaaaaaacacaccacctaccctattttgcagactccatggaatgtggggtggaaattcgggcttgctgatgattagagttcaggacttgctgtttctacagctccagctgagtcctcaatagatcttcgtatctctttcgcgttcacctcctttaatgctttgcttcctggcactccagaatgattggtaatattaaatcagggagataccaccttcttctttccaaagtcaaaaagtctagacatcatctctgtgcccacgtgtgcctaaatatttccttctttctaaatgggtgatggtggaaaggcagggcaggcatgctaacccaggctcctccaaggaaacgctgtggttcagcaaggggtatacgagtttctggaggcagacagacatgtggaattccaataccacttttccctgtaccctagggaaagttgcctagtatttgagctgtagtgtctatatatgtaaaaccagaatagcagtacctgcttctgatgttttgaagttgagatgagcacactgtagatgtgttcacctctccgagtctgtgtacagacctgaaccatgactcctcatattttatagtcacacactactttccttgccttttctttgcagatacatgatcgtacttcactactgttgaataacttgccttctgattaacaaaatattaaggatatcttgataatgaaaaaacaattttcaaaagaagaaggctgcaccagcaagcatacaggtgttgacaaaaatagaaaggccctctgactggggaggatctaggtacatttgcacccaatcagccagcaacatggaggaggaaaaaggatagaaagggattatgctcttatggtgcttcatgggtgcacctctgttgatgagcagggtttggacatccccattttttttcttttttttggagatggagtctcgctctgtccccaggctggagtgcagtggcatgatctcagctcactgcatcctccgcctcccgggttcgagcaattcgcctgtctcagcctcccaagtagctgggactacaggtgcacgctgccacgcccagctaatttcttatttttatttttattttagtagagatggggttttactatgttgcccaggctggtctcaaactcctgagctcaggcaatctgcccgcctcagcctcccaaagcgctaggattacaggcgtgagccaccacacccagccggatatcaccatctttgtaaagaaggctgtgagtttgtaacattgagaaaaccccaggaatgtctagaactcctgtggcagcctggggcgtccttgtgctgctgaaactggcacaaactgccctcccccagagaccagaggcctgatccctcttgtttggggtttctctaattgcacacacatgtctatcagaaatgtatgatctccatagcagttcaccttcctgacgtcattcttgtccccagagctggaattagcattttgcagtgaagtctgggagttttttctatattcagaaagggacattgaaggctatgccaaaaggcttagaaacatactagcacatgataagtaaagatgaatgaggtattattattattattattattattattgttatttctaaagtaagattttctggattagccccacagaggagagtcagaggctttgatattttataactgcctctctgaggggagctgatttgttgctgtgaataccaaaagactgattatcaggactggagaattagtctatttggtttatttccccccattggaaccttctcaccagtcttctaccagaagcaaacttagcagaaaagtccaggagggaaacaaaggtttatttttttaatccagaatgtgtgatccccaagttggcatggtagtcagcaagtgcaggcgaacaaaactttgagtcttcattgtctccccctactcagcacatctctaagcttctgggagcggagtgagaatgaggagggcgctggacacaggggcaacagggcctcagtttcagttcccactttgccaagtgcctcacacaaggtatttacctcatgcctcagcctccacagtagtaaattgaaggggttggtaaggtccaaaatacatcaaagtgctctaagctactggggttcaacaaactcagttcccctgtcatcccacccagtgtccccacttcgatcagagaagcttcagtgtgatgatttctgtacatcaaggttttatggaaatgcccatttgacaaaacaattctacatttggttatttaataataattcaaaccagtgaacgaggtgctgggagggaccgccatgattctctgatctttatgaattgtagagggggatcatagtgggaggtcagggacaataacagagaggagaagaaaggaacaagatgggcaaggccctccaggagggccagagacaggcctttgtgttccagccatgcatgcacagcagaaggaccattcctgaagaccctgctgcccccgtccttcactccatgcccccacaggtgtcctctttttgcccgagcaggtagaacaaagagcaggcaagtcaggggtcatgccctggcttactgtgaccttggcatcatgctgcaaagcctcagccctctgatctagagaatgggatccagctctcacctcaaatgaaacacaggtgctgagaggtttataactcatcagaaaatgccaaaataactaaagccctgacagggaaaactgtgctggaacaggaaatttcagcttccagggacaccaggtttgcacccccaggaagcctggctgcttgtgaattccttgtcttttcatctccagccctatgtgtatgtggagactcacggcttatccctcactgcagagaactgaacgaggaagaggcatatggtgagagagtgccagtctgtggctttttaaatgaaaatttacatgtaaatatgaattagctgaaatatcagttattttttaattggctcttcaaatcagcacaaggaaaacctgtgcctgttggtctgctgattgagtgatgttggcttagagattctcatcaacagtcaatgaagaactacactctctcctgctggaaacccttccatggctccttctcgtcctcagatcatatccaaataagatcccatctgcccatcacctcctgtcctcctaatcagccgctattcccattctcattcactcagccactacccccattctcattcaacagcctcccctgcccatgctaaccacagtcaccttcatctgcttctcaaattcatgtatgtcatgtgctcagccacctcagaatcctcgtgcagtgtcccctctgcccagcaagctttacaccagtggattctcaaactttggtgctcataagcatcacatggaggggttatttaaagcacaggcagttgtgccccaaccccagagcttctgatttagaacagctgagattagatctgagcatttcccatttctaacaagttcccagatgatacaaatgctgctggtctagagaccatactttgagaacggctgcatcagtcccccactaacacacacccttcccttgcataattcctactcttccttcacttctcagtttaagctgtacttcctctgactgcttatcacgcattgagctctcctgttgtgcatattcccatcatacaaacatcttgtacttctttacagcacgtaacaaaagtataaacgcttatctgtacagttgttttcttacgtctatcttccctacaattctataagctttataaacaaagatctataatgttccccacctatgccttttgcctgacactgtgcctggcatacggtgtttaacaaatgttcgttaatatttggatgaatggacaggtacatggatctagaaagactatccatttcaggccaggcacagtggctcatgcctgtaaccccagcactttgggaggccaaggcgggcagatcatgaggtcaagagatcaagaccatactggccaaaatggtgaaatcccgtctctactaaaaatacaaaagttagctgggcatggtgatgcacacctatagtcccagctataaggcaggagaatcacttgaacctgggaggcagaggttgcagtgagccgagatcgcgccactgcactccaacctgggtgacagagtgagactccatctcaaagaatatccatttcaactatgggcagagcactaggaggactgtctattcaaatgtcacagggcatatggcaaagaggtagccaaggagagagggcacctgcctagttagccagatcagctgctccacccagacttccctcacgccctgccctctttatatacagcagagagacacacagggaggatcagagtgttccacacagtcaggacctgtgttcttgctttaggctatatgactttgggcgagtcctttttctttcggagcctcaattttctcatctgtaaaccaagatggttggatcttttagctctaaaatttgttgataattatgggttctgaaaaaaagatgcttcctttttaataggatcagtaatagttggggtgttggtcctcttccctaatcatggcaagatcatgtcagcaaaggaagtcaaactgggaggactgactgggttgttgggttgaggatggagattctttttattattatctgtataaacttatggggtagaagtgcaattttgttttgttttgttttgttttgttttgttttgagacggagtctcactctgtcacccaggctcgagtgcagtggtgtcatctcagctcactgcaagctccgccccccaggttcacgtcattctcccgcctcagcctcccgagtagctgggactacaggcgcccgccgccacgcctggctaattttgtttttgtgtttttagtagagacggggtttcaccatgttagccaggatggactatctcctgacctcgtgatccgcctgcctcggcctcccaaagttctgggattacagatgtgagccactgtgcctggcctgcaattttgttacatgcacacatcacagggtgatgaagtcagggcttttaggatatccgtcaccccagtaacgtacattgtacccgttaagtaatttctcatcatccagccaccttctacccctcacgcttctgaggctccattgtcattctcctctatgtccatgtgtacacattgtttagcttccacttctaagtgagaacctgtgaaatttgtccatgtctgacttgtttcacttacaataatgacctccagttccatccatgttgctgcaaaagacatgatttcattcgtttttatggctgaatagtattccattgtgtatatataccacattttctttacccaatcatccattaatggacacttaggttgattccatatctttactattgtgaatagtgctaagataaacatacaagtgcaattgtttttgttttgttttgttttgttttgttttgtttgagacagggtttcactcccatctcccaggctggagtgcaatggcacaatctaggctcactgcaacctccgcctcccaggttcaagcaattctcctacctccacctcttgtgtagctgggactacaggcacataccactatacccagctaagttttgtattttttgtagagatgagttttcaccacgttgccctgactggtctcaaattcctgagctcaggtgatctgcctacctcagcctcccaaagtgctgggattacaggcataagccactgtaccaggccataagtatctttttatataataatttcttttcttttgggtagatacccagtagtgggattgctggattgaatgggtagttctatttttagttctttgagaaatcaccatactgttttccatagaggttgtactaatttacattcccaccaaccacgtataagtgctcccttacctctgcatccttgccagcatctgttattttttgactttttagtaatagccattctaactggggtatgatatctcattgtggttttaatttgcattagtgatgttgagcagtttttaggtatatattctggccatttgtatgccttattttgcaaaatgtctattcacagagaatgaatattctcgcttctcttttcccggggcctctgtgtggagccaccattcctcaggaactgggagggggttagtggtgaaagggtgagagaccacagacacagcctcataggccagagcctcagggacatcacagagcacagaagtccaaggggtgcccacttcctgcttcctgtcatcttaggggcaatgttccatccaatggcctggctaaggtttcagaactcaagcgtttaaccaagattttaaatatatttgtgaaatattgcatgaaggccccaaagaaatttatactcttttctttctttttctttatggcaatcatcactgtagataacaactctgaacctacatggcaatgcttatagcttcattcattctgtctctgatttattggaagggatccacaacagtagtacaaatgcccagcatcatgtacttgtcatctttgctttttgtgggcttttttttaagaggcaggatctcgctctgtcacccaggctggagtgcagtggcatgatcacagctcattgtaacctcaaacgcctgggtttgagtgatcctcttgcttcagcctcccaagtagctgggactataggcatacaccaccatgcccggctattttttatttttcgtagtgatgggatttccctgtgttacctaagctagtcttgaacttctgacctcaagtgatcctcctgccttagccccccagaatgctgagattacaggtaagagccaccagatccagcccactttttatgtttttaggtttgcacctgtctagaagttctctttgttttctgttcttaagggaatacaattgtggttatctacagaaataaactgatgaataaatgatttagaaaagctgaaagagcaaaagggtaggagaagaaaagagaagccagaatttttactttcttgactcatttagagaaaatatgcttttagcctgacttttacaaaagagattaagaatacttttacccaaatgtttggatgttatggtaatagccttctcacataatgtcttttaaccttataccctgttttctttgggcttttgtcagggtggaggctgtttctcctttctgtgggtgtaccagggagctctggttgcatgttattaaaaagcaagctctaaggaccagaagaaagtgagggcgtttgcaggttcaatggtgtgagacttagaaaagttgataagaaggattagaattgaaggataaaaagactcttacaaagccaagccattataggccccattactttatatacattctccaaaaatcacatgaatgaagggaaagaaaggaagaaaaaaactggctacagttcagaacgtcaattatgtcctcttttaatccccttttcacgatttatttgacattttgaacagtggccaaaaaagctattataactataaaacatattcattggtataaatctcattcgttgaatgatttaattaaggtattgacatgcttaattgatatgctaagccaggaccatttttatatctcatttccatatgctttctgctttaagagaagagaggagctggatctttaaaaaaaaaaaaaaaaagtctccctccataaaaatgctatagattcatctgtgcctgacatcccgggggaccacttcctgccacttttcttgatttcgagccagccactcctctaagtggcgctgctcagagggaaggtgatgtatacccagcttgagtgcctgtcaggccctcttatgatcaataggagaatatttatattaataaagcaccaagttaattaaataaaatggtcctctgggtaaacttaagatactagaggatgggcaggaatcgatatattctgcaatttgaacattaagtatgtgccttgaaattttatggagcttttaaaaactcgctttgtaatgtaaaaagtttgaaaccacaagttttctctgccaaaaccttgtctctggcttctgagctgagggggactggaaggactggagctgctggagatgggagcttaggggaagccccagccgaccttcccctgttctggagctcccctctggctggatgcaaaggtgggggggtgtctcagaggacaaggctgggctgaagcacagagacctgagctcggtgcagggtccagggaggatggcacgtcctcatccccagaggaatctcaggaggagatcctggggaagcccaaatgctaagatcttttgcaagaacctctgtctgccagccccatacttgcttggcctttcccttttgttctctcagcctgtctctttctgtatgtccctttgtgtgtgtgtgtgtgtgtgtgtgtgtgtgtacgtgcacctgtctccatcctctttctctttgcctcacatccgtatctttctctgtgtgtctcttcctttcacggtctcttctgtgaaatgactgtctctgtgtatgtgtgtttcagtctccgacttttatttctcttttgctttctctggttttattgtctctgtcccactgtgtcagtctccctctttaactgtctttctctccctctctctgtctctctctctctctcatctttatatctgtctatctttaaagggatcacacgttcatggactcagcccctcagcactcagaggctgactttctggtctgtccctggctcctggagcagcctcctccatggggtttggagatggaaaagaggaaagacatccaaggagtcctgcctcaagcagctgggtccgcttgcagaggtgacatcatacttgtcaccccacttgtccgctcccagggactgtcttcttattttcttagtgttgacctgcaatgcctaacgccctgggtacatagtagtcaccctagtaatgatgatgcttcattgaaatgtaagccccaagacaggtttaatagggttgtgaggatttccttctccaaagagagtagccacaactaaggaatttgttttagtggtgacagatgaacctcccattcccaccttgcataatgatggcttttcctgcacggctctggacccctttgaagctcacccagaccccagcctcctttgaaaggcagaagggtgctttgacttgccctgagccggcacagaagtggctggaccaacattctgctcttggcccagatcctgtgcttgggcaggggccacttcccagtgtcttcccactgtcccaccgacgcccttcaggccccccttcttttcccttctctttgtgggagtctcctgccaacttctcctctgcacagcaattgctgcacagtcaaccattttccaaccagcctcgtaggggctgggaggctttaacctgtgttcccatctttgccatctttgggagattgtggtagattccacgagagagagtctccctgcaggccccaggaaagctttgaggcatgacaggccaaatggaaaccaattactactttctttcatattgaacttgacctggagttgctgctttacagtcttagtgttcctctgtaatattctgtggggcaagaaggcagggtttttcttttactcacagtgttgaatgctgacttgaacagatgcaagtactgataagaaccagtacttatccagtgctggttttttatgagggacacagcatgtgatgaactcgaaattcattaactattttataataattcccgcacgtaggtattttcatggtccgcattatacagatgcaaaaactgaggcccagtcaagcaagtgacaaagctggagttcacaccaaggtcttttaggctcctgagccgtgccttcactacggtacctcactgcctcctggggtcttggccataggcacgacttctagcaggcatgtaaggcaaggagttgagttaccaagaaaagtatggcttgggctataggggatgaacagtctcagaaacacaaaggaagcattttagaagtttcccccctgcctcctaccttggaggtccttttctctttgctggggacaggggagttgattctatttggcacgagactagtggcagcagtctcacatttgtcactaatgaatttcatctctgcagttcattgggtcctcccagtgctcatgtcccttgtctagtgcctttcaggcttaatggccagaagcaggtctgggattaattattagtgttaacttccaacttggtgtaaatctattgaactgcatccatttttacataaataagcaagagaacagcatctattctcctgtagtcaatatcagcacatccacaggtgtgagttattagcaataactgtaattgctttgaatggaacaataaatagcgcatggggtcatgatgagaaacgtcattctatagtattaacatagcttaatggcttaagctcctatatatttcatccgttactgggcttctggaggccagctttgcaactcagggtgctgagctcttgctgaattgctttcctgctttggtggaagataattttgagcttttctgaagcatactgattttatcagcagatggccccaggatagcatctcacctctaccattgaggtttcacttgtttaatggtcttctgaaaagttacaagaaagcacagacatatacaagtcccatgtccttgagctgcagtgctgcctgccaaactccaacctctgggcagccgcagcccaggcacagcccctccccaccctgccctggcatgttcatgtttcctcagtggaacagagtgggccacataagaggaactctagtgccatatcacaaagagtgttagggttaggtagatccggagcaatgttccaagaatcctttcttcatgatcaagctgaacatttaaggttacagtggggtagacactaggaagtggcttcaacttctcccaaactgcagtgccttagcccgctgacttcctctctttttcttacctcctcacctcactacaaccctcaactttatttctgtacatcttcagcctctgggagggtttccagagcttttagacaatttgcctggaaggagtcagatcacagtgtagattatcccaaagatcatcagaacttcctcactgccaatgaccctcttctaacatctcctggaggctgttgcttaaagtatctccttctgtacctgagcttcattatctgtattatcctaatctctatgagtgccagaattcagaaaggaggaggggagaagttgttcttggagatgaaacgctgtcaggcacacagcccttttctggattgaatgcattttccaaatctattgtaccctctcaggccaggtttaatctgtattccgaaaaatcaagttatctgtccacttagcctaccttcccactgtaactgctcattcccacgcctcagcttagctcactaaacctttccccatcaaaggctttatctgtggctccttagttcacaagcctgttctaggagcattagttctcaagcatggtatgccaccagggttgtagaggtagaaggatggaggaggacagccagagctctttgtaatccaaagggacaaactggacttgggggaaaaaaagattcccatagcttgagatgtattctcagtcatccatggaccaagcaatggcataaaatcatgttcacttattttttttatccacttaaattttttaaagctatgcatcaggcctcatgctgagcaaatgctcctgcctacacgaagctaataatttagtcagagagccatcataaaacactacattgccaacctccccatagtcggcatggtgaagcaaccagcaacctttccaaaaccaaacttactctttcctgtgcccaggtagctactctgcctttaggttttttgataaagtcaaatttgacagggccctgggacaagttactgagttaaaaaagaccaccttggtggaggatctgccattttatttgagctttctttttcaggaaaagataagaggatgtagaaaagaggttgaatcaatcagcctcactcccctccttcctgacaccaacagaaatgggcccaagtggtaactgagaatataaatttaagaaaaacatgttagaagcacactccccatccccttaatttttgctaattatcacataagtagatcttcacctatgggatactatgcctctgaacctaggctatcaggccacagacctaggaggcaaatgagggggcccaggtcagcaattaatcacagagcaggccaaatgcacacacttcatttcagaacaatttcataaacgttcccctgcccctgccacctccccctcactcacaagatttcatctcctaattgcaaaagctttttggcatgggaatgtctttgtgaagaagagaggactcaatttgggccatctctctaaagaagacacgggaacaaggacgcttctccaattaatcagcaaatgcttggctccagctttcgggccaaaggatcgatttacataaagctacttcttgagatgaatttgcctccccctctcctccccctgccttcccctgccttccccttgtccagccagcattagacatgctactggatttcagattgacagtgttagctatgacaatcaaattagggatgaaagcctcagatggctgccaaggaaaagggacagagggggtggggaccagtatgtcagcctcagaggaggatagattgtatagaaatgggttccctttcccaaaccccactgggcagacacacagcttcaaacaataagagataaacaaaacgccagtctccatccttttgaatcaggtgaacaagctccctgtccacacccaaccaaggttgataaattaaaccagaacttctcattgggtccaaaattggcaggggactatctcaggtactcaattagatctttacaatcagatgattttcagcaccagatttctgcacacaatgtgaagacaccaaaatcgcagttgtaccccctgaagtgtatataatgaggtacgtgtggactgtggaatcagacgcctgtggttggaaccccactgatatttcctggaccacttagtgacacagggaagcctggaccagaacagagggcataattgggctgataatgagagctccccaatcccacctaatgtaactaactgccttgtcgctaaattgagataatcccagggattagtgagctgttgagaagctcagcctctgtcccatttgctggagatgatcagtcaattataatgctgtttcatgaacacaaagagccttagttggagttgcatatgataattaaatgaagaaagcttccgtttggactggaagcatcagttaactctgatagccctggaagagtggtggtttggaaaaactcagattaaatcctatggctgcaaagaggtatctgttcacaggaggaatggctgaatgaatggaatattctaaaccatggcttgctgccctggattcagggctttcaaccttgactgattttcctccacatttcctatctgtatactcagaacccccaagcagtcttgtatcgggctccttagattggttccaacatctgaagactttttccctcctttggcaatgagatgctgcgtagctacagcatcaagttccttattctaaaacatactgtccaatatagtaggcactagctatgtgtgatcactgagcactcagaatgtggccagtccagattgaggtgtgtgtaaaatacacatcagactttaaagacttggaatgaaaaaaggaatgcaaagcatctcattaataaatgtttatattgattacatcttgaaatggcaatcttttggatatattgagttaaatatcatattaaaattaatttcaactgtttctttttactgtttttaatatggctaatagaaaattttaaattgcattcttggcttgtgatatatttccgtgggacagcgccattctagaattagcagatcgcccctgaggaggtgacagtctctgcatcctcactggtcacaaatctgagcctgcaggccaagttcttcccagggtgaagcatccaattggctggcacagagagttatttggttttgattttgttgaaataacatccccagctcgctttctgactattcctgttgtccacatgcagcccgacttcctcatttactttacctgcacaaccctgaagcatctgagtttgcaatctttggaacacctgcccagaaagagacaaaacaggcactcgtattggtaactagtcacagagcaaacctataatctcaactccatctgtagcattttgtagaagcttgcagcctaacaggttcttttcctttttccctttggtcagaatgctcccctgggaccaagcatcttatctccatagtgcttggacctcaggccttcaccctcagtcacagctccaggactgtttctcagcctggctgttcagccctgttcatcacctgccctctagtgatttctcccagatttcagccttcctagaaaactgtagggaatccctggtctgtgaggccttaccaggaatgtcctaatcccagcaaccagtctcccctccaagcttgaaggagtccaaggacaaagtgcttggttttcttctgccacgtctctggctcccaggggagggtgtaaccatccatggactcttacccttctaggtcagcctccccgggctcctgagtggctttctgaaatacagattaaatgtcatcattctccccacttcagccttctcctgtgcctctgcctatcccacaggcattttgcccaacatcagcagtctcatgtctgagacacaggaggcctttgcatcctgctcccaaaattttccctaaaattagactttaacatttaaggtagtaggatgctatatttgtgaacttcatgctagaacatgaagataggaatttgcattatatactgcataagagtttagaaagcactcgcttgtccattatctctgatgcctatcccagtttcttagaagtgcaagttgagattcagagaattgaactggtgctcttaaagacacacagcatgttgagtagcagaaccgggatgtgaacttagcacctaatccgatgcaatcatcattccacccatggttctcaaacttgtttaaaattagactgaagcccatccttagggtttctgattcagtaggtttgggatggaccccaggaatctgcatgctttttttattatggaaaatgtcacacatacataaaagcaaagcacagatgataaatgaaactcccttgtacttatcgccaagctccaataagtatcaacccatggccaaccttgtttcatctattcttctaccacttctttctctcctatattattttgaagcaaaacttagagatcattttattcttaattatttcagtatgtatctctcaaagataaagacataaatgaaagaaaacataaccacaattctattctcactttaaatttttaaaaattaacaggaatgaatgtgtattttgttctcatagcaaggttcatggtctatctgatcagaagattattctatgacaacaacagccccataccatcccaattcttgataatatctttgtactattctgatttttctcaaactgtccaccttgaaagataaaaccaaagtacctgatgaaacaagcctgcattccctgtgagtcctcttgattcagattggcatctctctcttttccttccgaaaatttaaaaagattttgggccccagctaaaataaactgtaaaatcttttgcttggtctgggagcaatccatagtgtgagtttagagacaagctttcttctggataaaacggagaaacagtgaaactggtgctctctctcttttttttttttttttttttttagatggagtctcgcttgtcacccaggctggggtgcggtggtgtgatcttggctcactgcaacctcccgctcccgggttcaagccattctcctgccttagcctcagtagctgggattacaggtgcccaccaccacgcctggctaatttttgtatttttagtagagttggtgtttcaccatgttggcgaggctggtctcgaaatcctgacattggtgatccacccgcctcaacctcccaaagtgctgggattacaggcatgagcggccacccatccttgctctcactttttgaggtgtctagatgtttattttatatttgtagaagtaagggggtctatttctttgtatctgggataaataaggatgtaaactgcaggaggacagaaacttaggactatccacttttctatctcaacttcaaccatagtggaacacatagtaggtattcaattcatttttgagggaaataagcatctgagctgacacttaatccatcagtattaaacatctgaatggcatggccaggacttttctgatgaatctgtgagggaaaggattgcagaaggagcttttattgatatccttcatccagtaactttttaacctcaagggaacacgtaaagtaaactctcactgcaatgaaatattcagaaacacaactggagcagtgggaaataattggcgtttttttgtcccccattgatactttgattccctggatccctgagataggtgtcagttctttcaggaaattagtcattactccattgtaatcttcctcagacaaaggctgccattgactagacacccagctggaggtaccagagcttagctgggacatatgcttggtgctcatttgattttgacagtgacccaactgcaaacatacaatcttgcttattaagataaattgcctgcagaagagatgtacctattaagataaatcttccctgaagtccacattgtagaatccccaggggataatttttcctgcatgtttgtccctcctgctgtataaaataaagtaagcaaaacagtgtctttccctttagctcctagcacagagcgatgtgtcactgggttactatatattagaaagttggggttcagggggcaggaagaaagagtgcagctttatgtaagatggtagtattgagagtacaggaaattttagatttgtagattatctgtcaaaattttttaaatccctaaatgagttttgattgatactgaatgcaccaatgggcaggtttcctcctactgggcagagaatgtgaaagtaattttaatatatattcaggccaaagagaatcagaatggtaattcactgccctgatcccaaatccaataatggttccaaacataaatgctttgaagatcatcccctattttagcctaactaatcaagagttgatggaattttttttaatgttattgaaaaggcaccacattggtctcagtgcagagggattgaagaggtagtcaaagaagtgcaaacctcatcagatgccagattgggttgttcccacattctttggtcagttagtttcccttgtagcctcttgatctgtggtcctagatatgccgtcttttgagagtgatattttaatctgctgaggacttgtagattcagaactatccccgaagccttcttaggaatactttggggtggatccccttgggttccttctgttgctactgggtcctatcacctgcttctttgaacttcactgctaaagtctcctagctgggaacatcttcagcaatctgtccttgggttgctggagtcaccatacccagcattcatggagggcaggcagagcctgggagtttacatttctcttgagtggtccctaaccaaggactgtctgatgcagggctgcagaagcccagctcccttgctcagagacaggagttccccatcatattgggctaaggccaagacttcacctgattgtacttttatttgccttttccattaggtttccatcctcactggtctctcccgggagcacttcattaatcacttaacccccgtgtccttggctcggtgtctgtttctgagagaacccaacataagacagacctcttatttctgaatccagctctcttgttttatccaaaagaatctagaatcaaacatggctacccctgtctagatgacagaggagagaaactttttaatccctccctcagattttatggaaagagtacagcaacatttacgtattttattctttgtagagttgaaggcatatgtcctgggggtgctgaaaaaggacattttcagcaatgtcaatccagtgctaaatgggaggaaattacaaaaaggaaatgcagctattcattgagtgcctacggtgttctaggtgctgtgcagagtgctctgcagagcactacaagctgtagtctaataagtcataatggcacctgtatagacttccaggtgggactgtgatgtttctgggcgcactatccgtatgacttaggaaagcagtcccatttgacagttggagatgtgagacagagtcatgcagttgaccagattcacacaactaatgtgcaaatgattccacacggtgctctacgtgtaatcatttcgctctcacaactaactgatgaggttagtaaaactaacaaccccactgtaaagatggggaaactgaggcaaagagcattttagtaacttgaatgatcatacagctcataattagccccacccacttcagaaacaagaaatctccaagttttgaggaacttccaaaccccattttgtagcttcggaattaatttgggagtgacctctaggatcaaattccctccaccaactgccatttaacacagacaggatttcctggtagcatgaatgtgaccaagacaagtgcattgtccccagcagggcaaagaggagaacatgttcctcctcctagtcttgcaggggtaggggtgaaggtgggaactgtcattctctgctcctccaagaacaaagcatgcctgacattgcagggagagccccaggaagcatttcaaaagctccactggaactagacagcctttcaatccatttatcaaagtgtctgcagttcccatttcaagggtagatgaagcaataataaatttgcgaagaaagttaatctgtgtccaaagcattttagtaaattaaaaaggtggggagggtggctggaagggggatatattggttcttgccaactcctatttgacttactgtctccttaataagtcctctttggtcttgtgtttttggatggaataatcagttggttaatcattttccggaagctggaaaatgcactttagctaatgcagttctccttttctctcagagccctaattatttaaaaaggcatcccaattcctagccctactccccaaccaagaaagcctttcccaccagccatcttcctttacttacccagaaaaatactgcacacctcccactcctgcaccctactccaatctcatgcctttcttctagtgtttagaaaaacaaaaatccccttctcaggtcacttctgagcatgtctgccctcctcagccctgagctgcttccctcgtgaaaggggagacactaaaaccccaacaggaaattggccagcgctaggctcttgggcatcgtggatagattttgttatttttatttaagtgtcagtggaaaatggtggctcttgtctctctcgaggatagtacttaatgatagctccatgctctggcaccacgtagagataaacacactattaggaactctcacaaaggccctgcgataattgtgaagggactgttaccgaaaatgaagcgcccagccctgaaccctcctccacgccccatcagtaacaccattgaagctgtcagtttgtcagcccactggaggtatttatgaaatcaatatacagtcctgcagatggatggcagcagtattgttagccggagaagggaagctcaatggaaaataaaattaataaaatttacaagcagattgtcatggggatcagataaattccctacaatctactgttttgctcaattgggacaggaggaaagcagtgacagggagatgggaagaaagctgtgtttcaactggctccgtaaagtaggagcaaggctggttatatttacagcaagaaaatagtgaacagaaaccaaagcgctgccccacccaagtgcaggattttgcctgtgtgggaggtctcccagcaacatggccagatttttctgcttaaatatcgctctcctctcctcatcccaccgtattgcaaatcagaacctttgtacgactgctactcctcccagtgtattatgggatgttgtctactcaaacaaggttagtgcattactggaacacatgccccctcatccagcttccagctatggttcaagctgacagctctaaacctctctcctgtttgctccccctgcctctgattttgatcatcaaccattttccaaaagtgtgactggggctcatcttccagagccgccagagagagcagccaatcctgggagggtagtgggcaaaggctcggtggcctacagaccagcttcatttggcagaaaagactggactcattgtgactgccagagcctcgggtgctgcccagatgcctggtggaaattgcattagtcagatgacaggacctgggcccctgctccggaggctgatggagagcagctgagtggccttggtgacaccgcctgacctctgctgtcatcgtgggctttgttcagcgccccgactccaggctggagccctgctcattgaatcaggcctggctgggggagcctgagacagcgctcattgtgcatctgaatttacttacatcggttgcagacagaggaaactggatttgagatagggagcaccctgttactcagccccagaagccactagtactcacaccggcactctaccccaagtcagccttgttttgtgggcctaaaagtagccccagatgatcgtcaagtttcgttttagctagctgctcagagcacatggcttgtcccagcagcagatgggagatcagaaaaaagtggacacctcttttctgcttcctcttttccctcctgcccctttgcaaaatgttcatttagactgcccagattttagtggagggcagtcgtctgatgtctcctgccaaatataactggagtcatctaaagcttttgattaggtgcccttggaaaatcagcatggagtgtccacaggtacaatctgtccgtaggtcaactcaggacccatttaacctgtgaccagcaagttctccttctaggaccccgtaccaaggagatagttagacaagtgtccccaaaatgtgcatgcacagaagttcaccctagtgttttcattaaatagcaaataaataaatgcctacccaacaatttgggacccatatagccactcatacaattggacgatatacaaccattaaaaatgttgatatcaatgcactattaatgacagggacagatgttctcaatatagcaagcaaaaataataggttataatagactgtatattgtgaggtcatattggtggaatttcatatatatatatatatatatatatatatatatctcgtaattggtagcagtagttagatctgcaacgttttttttttaccttaatatttgagggtttttcgggtgttcttttaaaaaataatgtgtatgtatagcactgtgtgtgtgtgtgtgtgagagagagagagagagacaccttttatatctgaagaaagtgtaaagagctcattgtgtccctagcccccggctctgcaccccccgaccacgccatagtcctcagagaggcttctgcagcctgtggctgtgcgggaacagcctggaaggaggcctggcatgagtgttttgcagggccagtttgcacgctctggaggcctgatgggtcggtctttacagattgattactcgttgagatccaagcaggcctgcgttcttagtgaaaacaagtgcacatgtttggtctagcaaaaactaaatgtgggaaacaaaccaaaaaaaaaaaacagcccatatctttcttagaaaggaagtaaggctttgggaatgcttacagtctggggacataggtttagccagctgtagaacctgacactatccctcaccctcctcaaagcaacatgctggcactgcttaatgctagatgaggtgcctgtgggacccccactttgcatggacctgtggaaatgcaatttgaaattatcgtgcctgtcactaagaaggtctaggggcccccaggaatctctgggactctcgagtaagctgaagtggtcatcccccatcagaaaatcagaatgggcaggctctgttccaatcccctgtgacaaaggcagattgtcctgagcagcagaggacagcactgagagatgggagattgagcggcgttgaccccacagtgggggaggaatgccgtgtgggggttggggggatggggggcagggggttgtctccgggaggtgggaaaacagagaattgggtgcagtgtgtgcaacaaataacccagcctcttggctcgtggcctggaggtgcgagaccacccacagagcctgccctggaggcgagctgctccgcctggtaaccatttcagcaacggccatcacttgaagaacaatgtgaatgcttgtagcagcctggggcccgagaccaaacagccgccatacactctgaccgcagaggcagcagcctgggtgggggggattgttatcatttaatgagatgcagatcaagacagcctgggtctttaatgcagtgtgcctcttctcttcttgtttagagatttgagtgaaaaccagatccaggggatcccgaggaaggcgttccgcggcatcaccgatgtgaagaacctgtaagtgatgttttccttgcttcactacgtatgtggctaacttgggctctctgaccagagtgagggtgagggatgggacaagagggtggtccaggtgccttcagagatgaaattgagggctgtgcttgagtgatttctagggaacacacgttggatgccacaatactgtcacagaaacctgtgctttgctggttagtcatccccagatatgagcactggagcctcagtgcctgctgagttagagcctggccctacagagccttggtgcaagccagctttgcccagcatcattatcatcttctgtaaaatggggatggtaaccttgtgggcatgttttgtgcaactgagaaagtgttcaaaaggaagaaatatcttagtgcctcatacatagtacgtggtcaatcaattggaaccttgacgatgatggtgctgaagctctcactcttattaataggctcatcatcggctcctgagagagcatggggacttacatcccaggaagttggagagacatagccagatccatttccactggcctaggatttttttttaaactttttattttaaaatgatttttgattcgcaggaagtttcaaaaaatagtagacaagtccgtatactagtttcctccaatggtagcatctgacataaccgcagtacagtatcaacactaggaaactggcattggtacaatccacagaccttagtcttcagatttcacagctccacgtgtgctcacttgtatacgcctgtgtgagcgcaggcataggtagttctgtgtgatttcatcacgtgcagatttgtgcagctgtcaccatagtcaagcgcaggactgttccagcgtgacatttttgaactttgacgatttcctacctggcttctcctactgaccccttattcgtgactcctgggcccctacaaggactatgccttgaattttctgcctaaacctttgtgcccacggggtcggaacatgcttttggagaggggtagggaagaaggtctgatttggctgagcaagcacttctgcccagcagccttctctgcagccccagattcaatttgagacgtcttaagggaggcttaaaaaaaagacattgtcacttttccctgtaatgaatgcaggggttttagtttactggcacactcaaggcagctggtgatggcttccagatgcaggttatctgcctcccctgtggacttagcggaaagcttttggtgttttacatgcaaagcacgcaagagggcagaggcgtctctgggggtgggtggagggaacagagaagcagagaggacttcgcaaggggctcagggacaaggaggccgcctgctgctgcttctgagggtgttttcccaagagcaggagagggcggggtggagcagccacacccacaaagaatgggagctcctttgcaggacaggtgtaggcttctcgcaagaaacagcctcctgagtttatatcttcctgagaaaatgagatacagaaaagccaaaccttcaaaaccactaaataaataatgagagatctctcatcctgaactggcacttttaacatgtcagagcgcttttctagtatttcgttccatgcattccaagaactcaagactgttcacatgaaccaaaaacaactatgttaattagcctgccagaacgtcagggtatgagaaaatggaggcccagagaggggcagtgactaactcagggtcaaccagctttctggtggttgaaccccaaaagaacattttgcgtatataaagtgatatatcagtcagatctcatgacactaattttaaatggatccattaaccaaaaagaacatattgtagtgatgtataaccagagctggacagttaattgctgactatgtttttgattgttaagaaagtgaataaatcccacaattgttcttaatagttgctagggtttctcagattttgttttacagggtctcttttcccctcttacaatatctctaactacgcaaaggcctcaggacttgaaaggttcaagattctacaaacccagactcctaagtcactccagcacccaccatcagaccaccctctaagccatgcaaatgtgtattactcaggatcctaaactcagtgaggatcttctctttgtttatactcactactagcagctgggcttgcggggaagaaggaaaggggagtgaattcactgcctaaaggatgaattaaccaaaaacacctaaggggaattgaatactgtgtacctctaatcagttcagtcagcaggcacttgtcaggcaggacccaaaggccccagaggtacaattcatgttctccagtagcttacagtgtaactggggacaagaatcatgtacatacaagaaaatgtttagtaaagtaccaatcaacatgaaagttggctaataagtagctatacgtaatgaggggctgtcagagctcagaaggaacagacagctttaggcaatgtagcctagcggttagaagcatggttttggcggtctgatagaagtatgtatgaattccatgtgttctaggttcttagtctgtgatgttaagtacattacttgacacttctaagcctatgtttccactgtataaaatgaggataatagttggacttacctcctagggtttttgtggaggttaataaaataatgcatatgaataacttagtcctacgcttgatgcatgaaaggtatttagaaagttctaactactgttgctgctgtattcctttgttacaatagtgaagactgtagctgggcctgaatggtggttagaattcacaaagtaataaagatagtacgtgcaaagtgtaaaggcaaaactgtataagatgtgtttccagcagagacatctcatgggagtggagggatctggggcagaagagtgtgtgattgggttagaaagagaggtggaagccggttgctggagagccttgactgcgaggagcatgggctttagatgtaggcactgagaatgtggatggcttttgccctgggacagatcacggtgaaaacatttgttctggaaggggaaccggggacaggaggaggtggcagaaggaaaggtcggggcaggagatgaggctgtagtccaatgtgagggtttaggctcgtatctctctctcacgctgtctcttgggagagagaagcaggaagtggagaaagaggccaaagtaagcagtccctggggacaaaatcaacagagcttcgcagtcagtgagttgctagaggccatggaaaaggaagtgaaaaacgattagttccaagttcagacaatacagagaatgatggcaaattctcataatcattcattcacactattttttgagtgccttctaagtgctagttctgggggaaacagcagggagtaagatatatcaatataaatctgtgagctctgtcttcttggagcttccacttcacagaaatgggaagttcaggaggaggagccaggcttggaagatcctgagttgggttgtaatcacattgggtgtgaagtgatgtcaagtcttctgtcagcattgtggacagagcatcttctctgtgtgaggaagtttgtgatctgacatcctgtccagttcctgctggttgaaggactttgctaaagccacgctatgtctctggtcctcagcttccttggttttaataagagggagtcagactaaataatcttacagcccaagagaaaaactcatgtgagtaattagaactgtaggacctgagctgaggagctgatgcttcatggaggagaagcatctggacagaggtgataatgaagctgtatgtttaaatatgcatcggcacatggaaaataagagacatttagcacaaattaaatttctataaaacctgctaaggaaacactcctcctcctaccagtcctcagttatggagattgtctaccttgtgaatgataaatagcaaattttaaatctcagagatgcatatccttgtcatcagcttgtttgagaaccactacccagcccccaagcctgctccaccacagtgtgtgagctcagggaattcacaccattccactattaccttaaagactagaagataaactgctggcatatccagcttcaaactgcatgctatgtaaaatgacaaccagttgggcctatgtgtaacaccatacgctttactacacggagaaaataaaaaactatctggtttaaaaaataattttgtagttttgacgtatattttctttgcttgcgctgacatttcccttcaagaaagaagaggctgtggccaggtgtggtggctcatgcctgtaatcccagcattttgggaggccaaggcgggtggatcacctgaggtcaggaattcgagaccagcctggccaacatggtgaaaccccatctgtactaaaaatacaaaaattagctgggtgtggtggcaggcacttataatcccagctactcgggagactgaggcaagagaactgtttgaacccagtaggcagaggttgcggtgagccaagatcgcaccattgcactcccgcctgggagacgagtgaaactcagtcttaaaaaaaaaaaaaaaaggaagaaactgtgatacccacattttccacataaaattaagttttcatcaatgtgtataagttggtaaaagtcagcagataaaattaggcctaggcctctgcaactaagctaccatccatcagtaacacacccaaccatcttttggactttcgccatggacacttctgtctacccgggttccttttctcacagccatgcctgcaaacaggaacaataaagtgaccagaagctgctacagagcagagtccctattcacctaagcaagtaggcaagcatgcaacttttatcagagcccagagaaaggacgcaggcggcctctgagccctgtggacctgaggagccacaagcatgatgctctcagtgaagggactggacgcctgcccctccagacagcagaaggaagtccctaattgcttcctgcttctccagagaagagagagaacgtaattatctggggatgccactctacgcaattactgaaagctggtttaatgggctggtctcattctccactacttgcctagaagggcggaaggtgctgtatttaaagagagacaggcggttcgatggacaaagtgatctggatgaagaaagagacccttagagagactgtcctgtagagagaccaacactcaccactccagtatgaaatgcctactgtatgcagaaactgtgctaggtactgggcaaaggcacagcgaaaaggagagaggagggaaagaaaaagaaatcacggaaagacgtagagatagaaccaaaggaaatgaattgggaaaacaagagagatgacaggccacaatccagccaagcctaataagaaaaagacaaaaaccagtagggattgtttttttttaaatgtccccttgccctgtctttctcagcagttatgttttcctctgtttttcagtttctatttgcgaggactgtgtaggacatgcattccagaagggaaaatcaataacccctgtctctgccagctagcagaatttggaattgacgctttgaaaacaaagctgggcaggcagcctttgtgttctctagttagtctgtgttgccgcaccgcccgtgtctgccctcctgcttcctgagattaatgagggctgtctccgccccggtgagcaggtggtaatctcatgtgagggtgagggaggtgtggggagggacaccagcacccgttcgttggtagcatctctgtctgctcatctcagcagccatttgttttgtcactgcacctggagcagtgtccacactcctggtcttgtcctgcaaggctgtacgtgaactgggtgctctcacttatctcatgcttcccatgctcctttacattccctgaacaccccaagctccttcctgccccaggacctttgcacttgctgctcccttaacataagatgctacaccctcagacctccacacagccagctccttctgatccttcacatcccggctcaaatgttgcctactgtcccccactgccttccctctctatcccatcacccagtcatatttcttcagagcacttatcaccctctgaaattatctcatttatttcttgttactggatgttatcctgttattacttgtctctggatgcacatagcaaacctgtgtacacagatatcctgcctgtttcaatcactgtgttgtccccagtacccaaatggttcatggcaggagtaaagtggactagaaatgtattgaaagaatgactttgttcattcatttcacaggtgtttgccgatggcccgttacataccagaaatcatacacattgttaaaatgctttatatgaaaattatatataccatatactatagaaataataatataccatattgtattattattgtgtaagaataatatactataggaaagaataaggtgccattcttgtatccgaagaactcacagtctaatgatattcccattttccagatgacaaaattaagtttactagtgagggagtcaattagtaaacccgcagtcataggccatggattaaggcttcgttggagctaaggacaactatatgtggaagcccagggagacaggtctcattctggcttcactcaggaaatgacatgagttgggtcttgaaggatgcataggagttcatctaggggaaatgtattgcaggaagaaggaacagcatgtgaaaattcaccaacatatgtaaagggacagaggtgtgtgaaagagttgatgctcgtgagagatttgtggctggagtatagctagcaagagaggcaataaagagcaatgaggttagggagatggggaggtgcaggaaggtaggacctagaaccccatgatccatagagcaatgggggtttattggggggttcctaataggggagtggcatgatcagattttcacttaagaaaaacagcttcagcagcagtggggagggtagattgctgagaggcagagactgaagctgtgtgggcagagaggagacttgtgcagttgttcagaaatatgggggacctaaatcgagcaagtaaagtggatctaaaaaggcagagtcaaactgcagggactcaggggctagctgggtgggggaactgagtgcctgttaccagggcttatcaaccagagacagaggtgtacttcagtgcaagccggctctgacgcaggaagagtgcctggctctcgtctcaaatggggtgctgcatcttgaagggggatttaggaaaatctgctcatccgaggcaaggccatgcagatttatcatctctgggaagtgcagcaagttccccagcctttcctgctttgcattcctgactgagagtgtcaggttcagaattgctgctagaggaagttgcactgggccccagtttgctgagtgctacctaaaaatgctatctaaagacaggggtcatgtctaccttcctgcctgcctccctccacccttctctttcccttcctttcttcctttttttcctccctcttatcctcccttccccctcattccttcctgtttccctcccttcctctcttcctgtctccctttctcctttcatttctttttctttttcttctctttctccttctctttcttcttcttcttcttctttttttaaggcggagttttgctcttgttgcccaggccggggtgcagtggcgcaatctcggctcactgcaacctccgcctcctgggttcaagtgattctcctacttcagcctcccaagtaactgggattaccggtgcctgccaccacacctggctaatttttttggatttttagtagagacagtgttacaccatgttgaccagcctagtctcggactcctgacctcaggtgatccacccgccttagcctcccaaagtgctgggattacaggcatgagccaccatgcccggccaccttcctcctttcatttctccctccttcctcctctttcttctttctttctctccctcccttctttcctgttttcttcccttctcactctcttcttccctctctcttcctccctcccttccttcttctctcttccctcttcccccctttctctcttccccctctgtcttcctcccttctttcctctttccctctcttccctccttcctccctctcattctttctccctccctccttttctcccccgcttcctcccttctttcctccccctcttcctcccttctttccttcctttcttccactcttcctttttattccattcattgttacacaaattaccactgagcccttactcttgtcagacctgaagcaaatcttaagaaagatgactaagacacggtcctgctctagtgaatttttgtctacagggggagacatgcacagcaagcatatatcacaggataagcacgccccagggcactcttctctatttgccccggggccaatggcataagtgctcgataaataccagctgattagttaaatttcctgaaatgagaaaaatagtagaagaaacaggtagatttgactccattagtctgataaagacatatacagtattatctaaaagcaaggagagagtggtggtaaatgccccatcccagaatttctgcctgggattggaagttgcattggtgacaagtagaatttcttctaggccaagatgacacagtttcatagacagtaccacaggtcttctggcagactttgcatatttcctaaaacacccctccctgcgttataactgtctactcagctgtcctcctcctcctatagcctgtaagttacgtaaaaggagaggttgagtctgcctttttcattgttctgtttttaagagttagtcctatgcctagtatgtaatgctcaataaacaataagcgaaggaataaatgacttgcagaacaaagagactcccgtttttagggaacagctgaaaccctgaatgaatgaatgaatgaaggggcatgatgatatcctagcaaagaagaataaagtcaaggcaacaagaaggagcccagagaagcactgatgttttttcaggataatggagactattattttaaagccagcagtacaatttattatctgagacaatttgatttgtggacgaattttttttttaactcattacaagtatttaacccctttgagcactaaatgtacagcaagcaagttgtttaaaacaggcatataaaatataatcctgtcttttatatactctggcaaaaaggaacagtgattctgaccccctcaaagtacgactcaggggtcttaggagacatttgccattggactgagtctttgcctggtgatttttagctccacagagaaatgtaagggacttaggaggagatgagtattaacatggagatcatactttgaggctctggtattcgttgatgttctgattctttatcttattgggaccaagtgagtatagtgattaaaagtatgagttttggaatcaggtttggttttttttttcagctttgcctctcactacctatgtgagcttgggcaggtttctcaactcttagtctataaaatagagaaaatactagtgaggagtccaggagggagaaactctgtgcctcgcatttgtacgttgctttctggtttgcacgcagccttcacgtgtattatcttatctttgagagagagagaaagtaagtctcgctgtcaaccaggctagagtgcagtggcaggaccttggcttactgcagcctctgcctcctgggctcaagcgatcttctgcctcagcctcccaagtagctaggattacaggtgtgagccaccacacccggctaatttttttttttttttgtagagacaggattttgccatgttgcccaggctggtcttgaactactgggttcaagtgatccgcctgcctaagcctcccaaaatgctgggattacgagtgtgagtcactataccggccatatgtattatcttgtttaattactgcaacagtcttgcaggaccactagggaaaagttgcttatcctctaggtatagaggtggaaattgaggcttaaattcagaaactctcccaaggccacaaggccacagaatgggtcatggcaaggctacagcgggatcccaagattagcgtggactctcaggcagtgtttttctgagagattggccgggaaaaaccctgagatttggtgagcatggagggatgcctggaaggaaacagcagatacagacagattcatggggagtgttggaaaagcatttctggcttggtatcagccaagacccaaggtaggagcaggctgtgaaggtcacagttgggacagaatttccaagaagaccatcaagattgtctgaaagtatgaacttttggccaggcacagtggctcatgcctgtaatcccagcactttgggagtgcaaggcaggtggatcatgaggtcaggagatcaagaccatcctggctaacacggtgaaaccccgtctctactaaaaatacgaaaaattagccgggtgtggtggcgggtgcctgtagtcccagctactcgggagaggctgaggcaggagaatcacttgaacctgggaggcagaggttgtagtgagctgagattgtgccactgcactctagcctgagcgacagagtgagactctgtctcaaaaaaaaaaaaaaaagaagaagaagaagaagaaaagaagaaagtacgaactttaaaaaaaaaaaagactttaatttttagagcatttttatatttttagagcattttgaggtttacagaagaattgagtggaaagtgtagagagtttccatatacccccaacacacaaccatacagtttctcttgctattaacaccttgctttagtgtggtatgtttgttaccactgctgagccaatattgatacattactaactaaagtccctagtttacattagagttcaccgtttggtttgtacgttggatgggttttgacaagtgtgtaatgacatgtatccactattacagtgttatacagaatagtgtcagtgccctaaaatttccctgtgtcccacctattcatccttccttccattcccccaaaccctcaagtgtgagcttttaatcatgcaggtaaattctttcattttcacaacagcttatatttatttggtttttcatactctcagataagagtctcctttttcttctttgaaaaagggtaagtgactcccatgtgtcaaagtgcatagagcaggtcagcaggacagccaagccctgactcagcttcccagccacagtgtgaagcgtatgagtgtgaaagtctctccttcagagaaaagaccagtggtccaaagaccctgcccattcccgtagctgtgcttccccaaagaatctctgaggaggttgacataatggtgaagtgctcagactctggagtcaggctgcctggagtcaaatcctggttcttaccacctttatgaccttaagcaaattgcatgcctcctccttagcctcagttaacccatatgttaagtggaaataatataatccccctttatgatgttgttttgaagagtagtaattattattgctgcttttattccatctctgagaattaactaggcccaggttatcacatcttagagactaaatcttcccttcctagacaaatatgtgcccccaaaaaaagtcatatttatagtttcctggctctgaaatgaccctccctaactagtaaagatatttaacttcatcactctttctgttatttctttgagtggggctgacctcttccggcatatggcttctaatgggctaggtataaagtaggccagagaaaaagagggtgtaacttccctgccctgtcccttcctcttgtccccaccaagacatggaaaggacgaaaagaactgaggagtcccagctccgctattaaccgctgcctgcctagggtaggctgaaaaatggctcttctaaaaatgcctacatcctaaactctaatgtatgtgaatgtgtactccacatagcaaaaaggattacaaatcaagaattcaggttcttcaagtggatagattatcctggattatttgaggggatccaatgtaatcagaagggtcttcataagaaaaaagacatgtgctggaagcagagagagagaaaagaccacgtgattcagggaaggaggacaaccccgatcctggaaaagacaggaaaacagattgtaccctggggcgtccagaaggaacgcagtcctgctgacaccttgacacgagcacagtgaaactgatctaggacttctgacctccagcattctaagacaataaattcgtgttatgttaagacgctcagtttgtggtaattcgttatagcagccatgggaaaccagtactagaaccaccctcaggctgtcaccaaaccctgtcgtctggatttcctcttctattaaaataaatcattgacataaaatcagtgaatttcaccttgtattctgagaaactctggtgcttcaagagcccacaaatagttattttcaacagtgataaagatttaaattgcctcttttgacattagtgtgcaacatgagattttgtgtcacaaagagcctatggggagaaaaaaggcttgaaaaataaccactggacttgataaataatctttcaggtctactcatatcacagagtttgatggttctttgaggccatcttccaccaggaaggagctaggttttgtcattgaggtaaaattccgtggcagggtcaagaagccagcaccaggtagggacagcataaaagagaatcaggataatgccaggtctctggactcagagctggactttggaagctcaactccaaggttgagggtctgagctgggctcactgtgggaggaaaggaaaggagaagggttggtgttgactgggaggtgattacctggaatggggcttagggcttttgaaagtttccagatatccttgggactggttagggatttctgcagcagggcaaagtttaactggctttcttggccattctcccttccttcttgtagccccagataaactactttgcatctgggggcaacagccagttctggaaagagaattattagagactcatgtgaagacatcgtgagccagtcatcaaaaatatttgctagatgaataaataagttgcttgtgcagagtgcaggacggtggttttcagagcctgagatctctgccgcaatactgctcatggtacatgtgggtctcttttattggagcagatgtttcagagcaggcttgtatcagaactgacacatccatatgcatagcgcctgccgtgccggcacggagcacttctgtgtctgccacaagcattcagctctataaatggatgtgttacgatgtgtccatttacaccgacagctattatttgccattgttaacattctcctttaaagttctctctgtacgcagtccccaggcacaagtgcgcaaacctaaattacttttaaatgccaatgatccgttcctgggtactgtgtctgccaggaaaacttcctagccagacaagtaagtacccagtggataaggtttggtacatacagcacatggtccagtagcagttccaagatttcccagctaattagcattctgtttttaaggttgtactcctctttctgctaatagagacaacaccatttcttgggctgagagatggggtatttgtctgagataacttctaaagcccataatttacccccaggtgatcatatctccccactgccgacatgtacaccaaataaacagaggctgtgtcaaggaaggaatgaagcctcagagactttccttcttagtaggcaataagcttttgtcaaaccctgactgcatatcagacacagttcttattaatttctacctattatctcccttaatccttgtgacaacctagtgattaccatcaccagtttacagatgataaaacggaggcatacaaaagtgaaatgatttacccagggtcacatagtcactgagtggcagaactgggatttgaactcagtttacatctagaacctgtaacctgaaccactctgctatgctgccacagattagagaagtatttaatgaaaggcaaaaactgtgatccaaatcccagctccaaacaacttcaagtttctttttatggggtttcaaaaaatcagtaaattttgcttgaaagtctggatttccagcttctctggagaaattaaaagtgttaacactgggtgcccagtcctgcccggcaaccacaggccaaccagagtgacaggtcccctcttaaacatactgtgtgccctcctatctgcagggggcctgctccatgagtcctgcaagcttctagggagtcccattgatatgtggccacctcttaccccagaaagatcccattctccaatagaataggtgagattttctctttctgttttgctagctggtgatcttgggcacactgcttctcctccctaagccttcatttccttttcaataaaataaggatgattaatccttaaccaaaccataatttttgcctttctttttctttttctttttctttttttttttttttttttgaggcagattcccacactgccacccgggctggtgtgcagtggcgtgatctcagctcgctgtaacctctgcctcctgggttcaaaagattctcctgcctcagtctcccgagtagctaggattacaggtgcccgccaccacggccagctaattttttgtattttagtagagacagggtttcaccatgttggccaggctgttctcaaactcttgacctcgtgatccgccccctttgtcctcccaaagtgctgaaattacaggcgtgagccgctgcgcccggccaagccataatttttaacgtgaaagttaaatgaacctatagttccagctgctagggagactaaagtgggagaattgcttgaacccaggagttcaaagttgcagtgagccgtgatggcaccagtgcactccagcctgggcaacacagtgagacctgactcaaaaaataaataagtcaaatgagatgacacatggaaaggacttattcagtagagcctggcacaaagtaggtgctcaataaatacaatgttagtattctgcaccctcatcctcatgcatccttcatccttcattgatgcacacagagtttatcttacagttgggctattggcttgcggggttagaggagaaggagttttggggtttggtttggtagtcttgggattttctctgatttagaaacaagaaatttaaaattttatttgaaattacttgattttgagatgttggcacctaatgcaaaatcttcttaagcactaagtgtccataccatgttgggcaaatccagtcatctgtgggtcccattcaactactggcctctgatatagatcatgcctcccagtcactggggtgagcctgctgcaggccaaggatgtgaatggaagattctggtttttcctgcagctgcaggtgtcaataatcttgctaatatgttagcaagtcttgatgccataatcccttgaatcagtttaaatccaactgcctgccaaggccttgaaaaagcgactctaatcgtggcaatcaagaaggctcgggggaggcaaatatgggagcagatcttcccaaaaccaactcacatggaccattgctaattgtacaaagcagagcactgttcctggacttgaacatccctttctactacatcttgtagtgttttgaggctgagcactctgcctacatcagggtatggccctggcatgttccagaagtgagtgactttgccctacttcttcaaagtcacacaccactggtcattttcactgaagcatcccaaagactccaaataccgagggaccaacacattctttagcttgactcatcattgtttatttagacagattgtttcctcaatacatgcacatctatgtgcctctctgtcaccagcaccatctcgactcttgtcattgattgcctgttctttgagaacaaagtagagtcaacgactcataagtcctacagttcccttccccggcctactctagaatttttctctaattgttttttaaagtcataatggtaaagtaataattgcatggtttcattgtagccacgtgcaatgtttccaagcatagtttgaaaaccacctgctccagaatctcccagaccttatttagaatgcaggttcctgagccctgttagcaactaactgaatcctgatttctggtcaaggcccaggaatctgcatgtttaaaccactccacagctgattctataacttttgagaacgactggcatgcagaatacagacttggcattgaaatgagaagagatctgggttcgagtcttagtctccccactagtcctgagccaattgctagcttctctactaagcttggtttcttcatagagactaaaggtagtacctaatgcagagaatgtttgtaaaagagttagcactaacacacagtaagcacttcaaatgttaattattattcttatatcatttaattgctgtaacaacccagtggggttggtgggattatccttctttaaaagatgaagaaactcggactcagcaaggttaggtagtttgtccaaggtcacatagcagagtcaaaatatgaatctacattaatctgactcactgttaacagtgtttaaaacaattgggggaaatcaatccaaaattaaaatgagagtgaagaggcctgagaataaaaagtgggggaacttccacacatgtaaggcaagtgtctgttgtctgtgttggattttcctgtgtgctgttcggcatctggccaggagtggagatgagataggtgatggttgtggctcacattgagtcctttgtgcctaatatccaagccttcattgctcttaatttgtcaatcccttagaatgttgtcaggcaaggaggtcccacattatgacagtggattggagaatgtgggagggcctcatgtggaacaaaggcaaagaacaaagcctccctctcagttactttgagactttttctccaaacagtggagggtaaaggacctctggttctctttggagcctttttgagtttctccctgtgagtggcctacaagctgaggatggagtctggcccggctttcagcaaatgctgactccgcctgcactttggaaacatgaccccggctaggctgcgagctggctgccatctgtcccgggccagtttaatccacacatcttgtagagagaaggaaaaagtgaaaaagctgtcttgaaaaagagatgcaaagagtcacagagcttcctcaaattgggttactctaccatagttgggtagatgggaaggtcaagctgcttaggaatgagaatacagtttgagataaggaattaaaccattaaaaaatctaaccaatatattattagtattttgtttaacaaagcagattatcaaatcatatattccaatttaattaaataaaatggaaggtacatttaaaagtttgaatatgattttatatatgtatatatttgcatggggaaaaaagcctgaaggacataaaccaaatgatagcaattgtcaactataagtgataggaatttggatgattttattttttaagtcaactttattgagatttaatctacctaaaaaatgcatccatttcatctgtatgattctatttatcttgaccagtgaatagccatgtaaccaccaccaaaatgtccttctgtcttcagccagtcctctctcccatgcatggatcctggcgaacaccaatctgctttctgtcactgtagttttgcctgtagaactatttcatataaatggaatcacacagtatgttaccttatgtagctaacatctttcacttagcgtagtattttgaaattcaccctgtgttgtattgtcagtaatgtgttctttgttactactgagtagtattccagagtatgggtatacttcagtgtgtcaatccattcccctgttgatgggcatttggattgtttccaaatttgggttattacgaataaagctgctatgaacattgaattatatgagtcctcgtgtgaatgcaagttttcatttccctcacgtaaatacttaagagtgattttattttttttccttatccatgttcttttttttttttttttttttttgagacggagtttcactcctgttgcccaggctggagtacaatggcacaatcttggctcactgcaacctccgcctcgcctcccaggttcaattgattctcctgcctcagcctcccaagtagctgggattacaggtgtccaccaccacgcctggctaatttttgtatttttagtagagatggggtttcaccacattggccaggctggtcttgaactcctgacctcaggtgatccacccgcctcggtctcccaaagtgctgggattagaggcgtgagccaccgtccttatccattttctaatattgctacaatgaccaaacattacttaacaacaatgatggcaaataccagagtagggaaaatctgtcctctatcccattgtcttagaaaactaatgtaaattgcgaagaaagccttcatcagtatatatggcccatggttatcttgacttcagacggcatattcaactccttcccatgaaatttagatgtgattagagagagttcttgagttcttggtaagaattcagaggatgctgaattggcaagggtgctgggccatctttcacactgacggtgggaatgccaattggtataaccccctcaacaggcaatctggcaacagctaccaaaattgaaaatacacatactcttcaatctatcaatttaactttgataaatttacttaaacataatctcatttaagtccccagagatgtttaggtaagtgttatttgcaaagaaaatgtcttgggagctacctaaattccaataggacccaaagcaaatgaatcatggtatgttcattcactgaactattgtagagtagttataaagaatgaggttgatctttatatataatatgaaacatatccagagctcataaatgagaaaactaggtgcagatggtctgtacagtcttttaccacttgtgtttttaagcattatgcttgtatttgttcacatgtgccttttatttgagacaaggtctcactttgtcggccgggctggagtgcagtggctcactgcagcctcgacctcctgggctcaagcgatccttctgcctcagcccctgcagtagctgggactacaggcacatgccaccacacccagctaattttttttttttttttttgtatttttttatagagatggggtttcaccatgttgcctaggctggtctcaaactctttggtcttccaaagtgctgaaattacaggcatgagctaccgcacctggcccacacatgcttttatatatgtgaaatatttgtggacaaattcataggaaatgctgacagtaattgcttctggaaaggcaaacttctcaacttggggaacggggcagaagggtgttgcttttcattctatactctttgatctctctggattttcttttgtcatgtgcatatatttgtgtaacataaaacaattttatgagttaaatccacctgatctcagcccaaagaatgggggtgctcccatttcacttgattccctggcatctgatgccagagcgcactttcccagcaagaactcacaggactctgagttggccatgccctgcactgcctctgtctctgccacggttgaccctccataactggaaaccatgatcattaccatttgcataagtacaaccacattgacccatggctgtggctgtcagttttgaatgaggggaattatttgtattcaacgggcatttctgattgtggccttgaccagccctgagatatctttcaacaacgaatcaccagcagccaaccccatgacctttggaaaatgaatttgcctgccattgggccggcctcagttcttttgcccaagtaaaatgtcaattagatcactggctgaatatcgcttttgtctacttaagcatgttcagctcacaaagccataaatgtttgcttgcttctttcttgaaaaaagactccacacccaagttcaaagtatgctcctggctccatatggtcactgaaaaaaaattgattcattggaaaaatgcaactattgagtcattattcaatcatcaggcaagtcagactttgggtcattgtcaacaggctgcatgtgttttgggtccgtggatgctttcaggctcatagaataggtgttgtatgcatggcattcgtctccgtctgcacccccagcccacattgttatctacaccagacaatgaagaagataaaacccaatgttcagtctgggcgcagcggctcatgcctgtaatcccaacactttgggagactgaggcagacagatcacctgaggtcaggggttcgagaccagcctagccaacatggtgaaatcccgtctctactaaaaatacaaaaattagccaggcatggtggtgggtgcctgtagtcccagctactcgggaagctgaagcaggagaatcacttgatcctgggaggcagagcttgcagtgagccaagattgtgccattgcactccagcctgggcgacaagagcaaaactccatctcacaaaaaaaaaaacaacaaacaaacaaacaaaaaaaccaatgttctattgagtgatctctaggatttacatagattagagaaaaatgaatagggagagggtcgtggctgagtgatggtgattcaacccaaagcaataagagtaaggaggtcaccatcatgtagtaacacttcaattaactgtaattagtttctggagttttctgtacttgacttttaatacatttcacaggaattgaaacacaaggagttttccaaaatttttctttagcaggatgtccctggccccattccctttaatctgccttttgctgcccataccttattttttatttccataggtttttggggaacaggtggcatttggttacatgaacaagttctttagcggtgatttctgaaattttggtgcgctcatcacctgagcagtgtaccctgtacccagtgtgtagtcttttatcccttgccacctgccgccctttcccccgagtccccaaagtccaacgtatcattcttatgcttttgtgtcatgccttaaatatctcgagagattcctttgacccagtgttagccttaaacatggtttccagctacatgaaaaataaatagaccacaaagccaagattctcagctttagctctgcttcagaaatggtcttgttttgttctctaaggacagtgttggtgtcttgtagttacatctcctacggccccattaaatgatgctctcacggctgctaagcagctgctaatgttaaaaggggtacatcattgccctgcacaccaatacaccaaggttcccaagctaagcccttccttattgtgtgcctcagaagttgaacagtttaactcttcctgggctctctttacatgttctggccatcttaaagtgagggctggcactgaacttccatttgggtccattgtgaaattgcttcacagcatttacacctttccagccattagaatggtccacatgcagcttggggaacctgctgtcaacccgtacagttgggttgtggatgtgcaaattttctctggtgaattgttcgttgtcatggaagatgagtcttcttggtagacagtcaagccaagtcccttttctggaatcagctccttaatgcaattagatttcctgaaatgatttcctttctttgcccattttactaccaaggcaggtatgagatgtgcttttataataagtggtttggctagcatgcaattcctctactgcagccagccttgctgcctattgaaatggggcaaattgggcgggctggtgggggcggggggcaggggttggggacggacacgcatggaattcaggttgctctaccaagagtcatagacttaccaagctagagagggctttaagaaatacgtcatattcacaggaaggggaacatcacacactggggcctgtcgtgggatggggggatgggggagggaaagcattaggagatacacctaatgtaaatgacgagttaatgggtgcagcacaccaacatggcacatgtatacatatgtaacaaacctgcacgttgtgcacatgtaccctagaacttaaagtataataataaaaaataagaaatatgtcatacggtctaaatttctccttttaaaaatgtggccaattggccagaccagaccctgggttcccttggtctgtgtctgggtcttaatttgtaaaggtgactgttggatgatacagagaggtcaatgccatttacagaaaatttactgttactcacaggtccctagaaatgagaggcacagcatgtcatgcagggccgcaggggaagcaccagagtcgggcagaaacaggagcaaggggaaagctggggccaaagcccttattggggtttcataggaaaggcaaggcagggcaggggaaacagcttaagaatggctagtttgaataattcatatgggccttggggcataagggctattcctagtcatcctgtacccagccttgggttgatttagggcagagtaaaggctggcttggtgtgtgagctagatacagctggtggttaggatatggacttgggattggttggtctgtatctgaaagataggctcattggcaatttgtttactatctctaggaatgagctagctctgggaggggcagtctctctcccctgccaagaacccttccctcccccaccaagatgtcaaactattttaaagtagagaaaatttaaaaacataattaatatacccctaaatccctgggactcctcaatccctccccattaggccaccattcctcaccacatttgaagccccagatggaatgaaagagtcaagcatccctgagttgcagtagcatttcagacttaaagatacaatttaatcaccttttattgttttagttttttcactggtatatcaggtgtcacttgtctctaaacagtgtgacccaaggggttagcaatcaagtccttacttctctgccaaatgctatcttaggattttaagtaattcttctctctaatccttactttcttcttctgttgaaaattatgggcttgcatctgatgatctctgagatcactttcaacggtggcattttacaactctatagctgcaaccacccagagggctggaatctccttcagcagagttgaagttcatagtaactctgattttgttaataacctaaaggcaaacggtgatgttctgaatttcagtgtgtggataggtagggaaagaggaaggtaggatcatagataagtaagtaggtgaatgtttcccaagaaatctcagtgttacagttggtaatcagggctcagaaaattagtccaaggaagataactccttaggactggaagacgtggacagcccatccccttcctctccctccccatcctactcccactcccaaataaaacaaaaaggtcatctcctacatgcacacccctgaattctgttctgaaatatgtgggatacataaaatagcaaatgccgtcagatctcaagttgggcaaatacagagacagcatttttagtctcattgaaaagtagttgtcagaaatatgccattcactcagagtctctaagtgctctgtcaagctttaacttgattaaaattgaaaaccacattgcttgaaaaccaaacgtgaaatcgaaatctctttactcagtgctcttacattctgaagcctgggcttatggattatcctcagttaatttatgccatctttgtgccatacattaattttgaatatatttgttgaaaatttcctgtagcttgcatttatggttgtcaaaggggcttttatcttgaaaaaaatggtgctggttttaattacaattctaaatagcttcataaccatcgtgaaccctggatttacatcatctttatgacagccacgcaattcccactttatcgattttgtcatttgcttcattacagttaatgcaaaccttttgtacagagacaattctggggcctctctcttcttggaggggttaatatagaacatcatgaccaagatagaccccgtccctccaccccctgcttctgccgcagtgctgacccaaggaaaagtcaggatggaaaatatttccaaagtggctatccatcacaggcaaaggaaacgttagtgctgattatccaacctttctgatcaggtgggttcagacttctctgctttgaagtcctagagatagcatcactcatgttgcaggactatgtgtccaccccaccgcaagcctcactctctgtttagagaagggttgcagcagcagccacccacttttgcatttcacatgtagatcttgcaccccctgcacccagcccgcccaggggccttaggaaccaaagcatagtatggttgatggggatgtgctgagtccccgggatgtaaatgccaagaatgcctgtgagtaacctaggatggaaaatcgaaacctttggtgattaacttgaaatggaacattttaaagaaaagaacagaatgagggagcttaaggaagtataggaagacacagctcatccatttgtatccatcagggacaggcttccaagggccaggagggccaggagcagctgagggagctcagaaagctgctgggagcccaacgcgtaagcccaacgctgctgcaggggagtttgtggatagagtccagggcactatgtaagtggcatttggatggctgagaaaatagcacatttgatctggaaacaaggaatttttccccctaagtctcacttgaaaggaccttactttccccaaaccaaggcttataagacaactagcctttaacggggatataaaagtagaatgaacttgccagaaagggcagtacaagtccaaagatcatttctgaaggagacaaaggagtggggtggcccatttctaatgtaatttactggagaatgttggggaaagtcctagaaggcccattctctgcccttgcatgtcccagaacttctcagtgagtcgctccatttgggactatccccggggatggctttctcctcttcctccttcagagactgtgttccgcacttctagactctcatttttccagtagatgtgggagtctagccttcgctttctaaaagctatgaaattattgaatgctggaaacactgttgaatgctccttaaaagctgtttctgtgacaaatgggatgggaaaatatgctgtttctaagacacagaagagctgagcaggaagaggagacatctccagaagatggggtagaaggatccccggtggcccgacaccttgtgtctaaccccgtatgcatccagaagctggagagccagtcttgtcccgcctaagaactcctacgtgaatctctacctgataggcacaccgttgagggcttttaagctcggtggttttccgtggagcgctttggtagaagttaataccacattcattcatacttgtgtttttttccaccctgctgttcagccctccgaccccctggagagtcctcgtcttaactgttcaaaaccggagtaaattcacacttacattctcaatgtactgcattaaaaataaaatctgactcctcagacagtacctataacaacaaaatgagaaaaacttcatgtgaggactcagggactgaattaaaactcagcagccctgagtgccagctcttgaggggcccatagaaatcatctatttcatgcctctgttttaccgatagggaaattttagcccagagaagttaggccatagtccgacaaggtcaaatatccttgtcatctgattcctgagcaaactgtttttatttttccactaaatcacatcatcttaaaacaaaacaaaacaaaacaaaacaaaacaaaaacaaaaactctactgctggcaaatgagaaaaagaaaatcactctttcttatcccctacccagaacagtggctgtcatcctcagttcttaagtgtgaacaatgcacttatttccccttttggaatcagggaaggaattagaaatttcttcagaaatttcttcagccaattaagtagaagtagctgcaatggagagctctggacctggaagcttgtgggtagagctggcctttgcccaggtggtccccaagtaggaaccatctctgtgggccccccagatgttttcggatttacttagctcggtgagactgacttggctgctcccgagagtcctgggagaatttagagacagcatgaaggaaaactactcaccattttcaccaggcccccccaccatcccttccccaggagccgtcgcacgtccgtagcccacccagaccagaggcctctgcaggaaggggtttctggtcaaaggcacttccctcactgccctgagtgagggtaacagcctggcctccttccttgccttctctgagaaccagtctgaacaaaggcgtgcgcgcgcgcgcacacacacacacacacacacacacacacacacacacacacgaggaactcagcttctgaaatgcaaatgcaaatgcaatctactgagatatctgcgctggctactgatgcaaaaggaggagcagtggtgtggaaaatacaaaacagtggctaatcccacactattttatgctggacttgggagcctagcggtgatttttctccttccatcaagtttaccgtcctcattctctttgcctaaactgacattttcccccctgaatcttgagtgattgggagtacccccaaagcaagctgggagagagagttttaaaatttgttataaataattcccaaaaataggtgaattaaattccctcatgtttctctccttcattcgcattgctcttcaatgtcaaggtagttcttctcacacccagatagaatcaggtttgctatctcatcgtgtaagatctggtcctaggcttccctacctttcactgtgatgtcgtcagagggaaaccaccctcaaaatggggtggtctcataaagttcctgcctgtcatggaaagagcaagcttcactttttctcctttcctacggtaacattcacataacatagaactaaccgtttaaaagtacaattcagtggcatttagtacactcgcaatgtagtgcacccatcacttttatctatttctttttgttttttttcttttgtaagatggagtctcactctgtcacccaggctggagtgcagtggcacgatcttggctaactgcaacctctgcctccgaggttcaagcgattctcctgcctcatcctcctgagtagctaggactacaggtgcccgctaccacacttgggtaatttttttatatttttagtagagatggggtttcaccatattggccaggctggtcttgaattcctgacctcatgatccgcccgccttggcctcccaaaaatcactcaagactcagggggaaaaaatgtcagtttaggcaaagagagtggggacggtaaacttttgtctatttctaaaacattttcatcacccccaaaggaaactctgtacccattcggcagtcactccccattccctccctgcccccagcctctggcaattgctgatctgctttctgtttctatgaatttacctgttctggatattttctattcatggaatcacacaatagttgaccttttatgtctggcttctttcacttagcgtaatgttttcaagagtcatccatgttgccgcatacatcagtacttcattcctgttttgtagctgaatgatattcctttatgtgtacataccacaattcgtgtatccactcatccgctgacagacatttgggttgtttccaccttttggctattgtgaatggtgccactatgaacatttgtgtgcaagtttttgtttgaacacctgtttttaattcttttggctatatccctagggatggaattgctgggtcatatggtaagtctatgtttaactttttgaggaaccaccaaactgttttccacagcagctgtaccattttacattccctccagctatgtaggagtgttccagtttctccacatcctcaccgagcacttattgtttctcattattttaattacagcctttctagtgtgtgtgaagtggaatctcatgtgatcctagggctttttactgagcacctcctgtgtgccaggcactgtgggccaggtacagtagtgtgtaaaacagagactgtacccgctctcctgttgctgataagttcaggcattcattattccttgaaagtaatagtaaagaaaaggaagctggcctcttctagagtatttccatgctgtgtattagctagatcgaaagcagctatcagcacagcacgtgctgctgagttttgatgctccttttttcagcagttaattacaaggaccttgatatcccccgaacactgagcttgcaagacatgttttaattggcttctgctgccacagacatacctttgagtgatgcctcgctaatggccactcaccccgaacaccctacgacacaatctggttactgctgtcctgttcctttggttcccgtggcttgtatacctatggaagacaagccttgtcacctctggggaaggccatgcccaggaatgatggcttcgaatctgcgtaatttaccacttttgcctggagcaaagagaaccatttctccggagaggccatgcctctgcccaagagagcactatgctgtcccagcctggtcagaaggccacccattggatcctactaggtgatctggaattgaagcatcctctcaaggtgcagacacccatccatgatcctcagtgactggagctaaaatcagttaccattcccagtgatcctaaaagtcaaatggactgggactcccaaggaatctgagagacaaggaggcaatggtggggacactgttgagtgtgctgctccccccaccccccaccctcaacaccatcttctgggtaagaatactttgcaggccaatgaaagcaactagttcccagtgacaaatactgagactaaagcttggcttcctccccatcctcttcccaggctacaataacttgagttacacccacacagtcatattaggctccctgtctttgtattttgaaagtcagagaaaggtggaatagcctgatgggtaagccccgagactcctggattgggaaggcaggtttgaacttgactctcccatgtactagccgagctccttttttgatgctacataacaacctctctgaacctcggttttctcctgtattcagaattcgtcctactctctgaagtaagtgcttgaatgaagggatgaccgaagggccctgagagcttggaaagagcagttcattttgcctgagtttgtacaggaaggtctcctagaagatgtggcctttgaggaaggccttgatgaatgaggagggatttcacaaacagggtagggggcaaggacaagcataagtgaacgtggaaacatgaaagtacttggtgtattcacatattgcacagagggaggtgtagcaatgtcatgctaaggagtctgggctgtttccagaggagcagcatctcttacagtcatcgtgagcatggacagaactgggttcaatgccaagtttagagacgtagctctcaatgcctcactttcttcttctgtaggaattattgtgagatcagactggcataagacacttaaaaggtgctcagttcaatactggatgcttagtaagtgttaaataaatgttgtgtgcaatcattatcatggttgtgatggttttgtgattgctacaatttatcatgtgagccacagggagccactgaaggtttgtgtacagcttacggaatgttaagattaagaacttatatgccatagatggtgcggcatttgactattttaggtggtacattacttgattggttattagttggaagtagccaccaagaaatgagattaaattttgcaatttctctccttagttgtgtcaactatgggaattgtgaatatgtgcacacattggtatccttctttcagtaagggagcaatttgtattttctttggtgtaggtttttggtggcttcttgtatttcaatcttgtaatagcaggagaaatacaaaaagcatgtgagtctgaactgctgcccttagtccagaaagaatatattgaatatctcaaataatagattctttggtctgggatggaagaagaagggacaaagagataggttcaaatcacagaagggtctaagttagatgaacaagaatgtttttagaatttcataagaaaccaatttcaggtcatataacttcagagctgaaggagagcttggagattatgtaaaaaagaattcctaaatttaatattacttgttttaaagcaaataaaattaagtaatgccacaaatacattttcagagtgcacacacttcattaatacacaaaaattccttttggactaaatgttatctgccttttacaactgagactgaggggcatggatgtgaatcacttagtttgcatagttacaaattatacaagccctagtcttccacttttataagaaaaaaacaggtagccaataatgagagccttcaaagggttagttagtatgggctagaaatgtgaaaaaattcaaggaagtcttaattttcttgatgagtgatctatgtgatgtttttaaagggaaacaaagatctctcgaggctgaaggagatgatgtggtttcagtgcactgtcagggagcactccccaggatgtgccgatttgtgtcctcgaccctgagtggggatgtttgccatcttgtatttgaatgaaaactaacatctcacctgggcactgacctcctatccaggaagaaatgtctcagctctggctcttgcttagtggtcatattcacgcagctggaatcatttaatctttagagcccagtgggaaaattttctgaaacccccatggggataaaaagaaaaaaactacctcactacagtttgtgctgggtgatttagaaaaacagagtaaaaaaacagagatgtgggagataacttttcatgcccgttaacaaaagcacatttcatcttcccagtttctcgcttcttcctccctcctgcgcctctgccggggaggaaccacagatggttatcgctcaagagtgtaactagggaaaccataaacctgcccccatcactatggagacagccatttatttgtccagcctctgagtattcatgacatcagcaaggccggcaagtaaaacactgatacttcttacaaagaaattctaattcccaacgaggaaggcagagaatgcaaggcccaatgtttcagtgactttcaaggctccccctggccttgtcatgggcttgtttgcaaagagacagcccattttacagaagctgcagtgaggagccttttagagccaacagaactgaaagctgggtttgcgagtcaacagacattttaaggtttagggatatggttgagggaatgaaatgccaagaataaatctattttcaactgagtcagccccatggggtataacagggtaagcagccatcgcagttggcctggaattgatttgtttcccaggatcgaacacaggagtttcaatgctaaaacagggaagtcccatgtaaaccttggggagttgggccaccgaggtataaaaccctttggtccaaacatggggatgaccacaggatgcaggtagatttgaggcaagcctcaaagtgtgacagcacattttgcaaacagtaaccaaacttccttggtcccctcgtctaaaagttgctggaaaacaaatgatactgtctcgctgtgaatatgaggtgttttcgtttgatttgctttggatttgtttgttttgttattgttgttcttttatttatctagaaatgccagaaatttgtttcaaatttaaactcgccaaaattaagtgggatctctgcttgtcccccgtaactatctttttttttttttttttgagacggagtctcactctgtcgcccaggctcgagtgcagttgtgcgatctctgctcacagcaagctccgcctcccgggttcacgccattctcctgcctcagcctcccgagtagctgggactacaggcgcccgccaccacgcccggctaattttttgtattttcagtagagatcgggtttcaccgtgtgagccaggatggtctcgatcttctgacctcatgatccccctgcctcggcctcccaaagtgctgggatcacaggcgtgaaccgctgcacctggccctatctttaatgataaagtggtttgcagggatcttccccctgcatttttcaacacaaattcatttgccaaaagcccaatatacaggaaagtatgtaaacacagaagtggagttattgatatttcccagcgatgtgtaaaacacctctttattctccaaggtctggtgtgcctctttgtggctaatccatcatcgctgtttgcattattgcagagcttgctttcaggagcatctactggagtggatgcagttattctcctgctgagaagttgcatatgttgaacggcattatgatctatatgaaatagaaggtgttatgctagctatgtggcaaagtatgcataatgacatttgttgaaatagacttgttcaatttccaactaagttctaagcaggctattccgatcagagagcttaattaacctaggactttgtcctttacaaagtagatttggttggttgaagtctttggaatgctaacaatcaattatctaaatatctctgtaaatgtaactggctataccacattaaacgtcagaggtcaacaattgctttaccagttatatatatttgtatttacatggacacaatattacatgtaactacatatgtaggaaaaataggcataagagttgtcagttttatagacaggggtctttgtggatacttaaataattcatgaatcagtaaacatatctatatgtattctagggtctggtgggcaagtgtacaaaatgagcaaaatgatagattcacctccttttgctcatttgagatgttgttttaatgtagaattacagtagccctcaaatgatgagaagcagtgacaattcattagcagattgtggcttagatcaagtgtttgatttctctgaggaagtgtaaccagtactcagttatatgaagtatatgcgtttcttttgaagataatttttttccttttgtcagttaaaataaccttgagctttatttttttcaaagaccccagctagcagcagacaaatgcttctataatttgttcttcaataatgattttttagaatgttaaactgtcataaaaaaaaacaaccttcaaaagcgcttctagatttcctattctctgcttaaaggacaattggataatagggaggaaagaaatagcatgtcaaggctgcttcacattttgtcttctgccttggttcatgaaagcagggattcccctggttttctttttacagttacaatattctatttctcctccgtctagaaaaagaatacttcaaatatgtacattgatgaacatatatatatttcatcaaaaactaattcaaattattatagtttaggtgtttaaattcccttaaacctttcagtataattcagctgtgaaaaccagaggtggcaactttcttccaaatattttcaaagcgtgtcttatactttattcttcatcctgagtacctaagacagtgtgaacatctaatagtactatgttactcttatgggttaattccttgttggatttcatgactgttgacttgctttgggtttctagtaaggcttcccttgtgaatttcatgcagaagtccccacacttatttggcacatttggtagggatagatttattcagaaattagcaaattgttaaactctaaagggtgctgagccttagctacttctcccatttagcatgaggaggaacatgaacagaagctcagagcagaacgctgctgctggatttggggcctctggagggacagtgccctcaggctaagtttaaccatccacctgatgagatgctgggcccccagaacatctggatgaggaatgaacaactggatgggtatcccctgatgtgcagaccttgcatgtagatacctagtttggaattcgacttttcttccagatacccaaagcctatttctgaagatatctattttcaaggtattcttcatggggacttaaatgcatcattgaaatcctgaatttaaaaaaaattctttttcttttccttctttctttatctctttcttctttttttggttactgttgggagatagttagaagctttttaaattgtagtcagttttttaaccctttgtaaaggatttagataggctgctttaatttctgaagcacaaaaacatttctaatcctgcttcaattacgaaatttcacattgtaattgaaagagatgaactgtgataataggagtatattatgcttactaatgggaattctttcaaaagtgctatctcccagtctgccgtttgcggagattattttaagtcctcactcacgctggctttcctttctgccttgtttatattctcagagtataaaaatacagtagtcagaaagctgctctcggggagtctgcatttagtgcttgtcggaggattcctctctaaatggactctggtatcattttagcactcatattgtttgccgaaattcgagcttcctggggaaattagagcagttaatttaatatcatgaaacattttggggcttcttggcttattcagagacaggggagtgtaaatcaaactgagtatcctgtataaagtagaagacaataaaagtggcctccaaaaaaatagccagccttcccaaaatttcttgccttcccgttccccatcttcatcctggacccatagaaatcttgttttatttcaagtctccttcccaagggctccctgatagaggtctgtgtctcagaaagacaagaagcagggaaggtgcttagccctgtacagtcacagcaggagggctcagtctttattgtcgtcactagaagggccacagggccacagtcatgacgatatggcttagagctttattccatacggcttgggctcagccctgacaccttttcctagaaggactcattctgcaaccattggtgaccatctgtgaagtggctggcactgcgctaggcactggggtaagttatgttgcatgataagaagcaaagattcagcagctgtgggaaatacacttcttatggcccaggaaaaattgaaagagagctctcaggcatcctccaactgctgggttctctctgctcacatttccaaagccctttttgcagatgcctcccgagtgatagcgtgcatgttgcagggtaggcaatgggctttgttgatttgtttttgagagggtctttgaaggaggcctttcaaaggcacgatatggacctttgacctgagagctcagaatacacatcagtggccccccggtcacatcaaaccccagaagcaaactgctaaatcgaatgttttggcctcagcttcggaaggttctctgtgtgtttagtaacgctccactccaccatcctcaaagaaatgctgggcttgtgtttattttgcctcccttctcctgtgcatcaggactaacttttatgtcgctgaggtgtcattttgcaaagaaaaagaaacctgtctgaaccaagtgtgtatttactttgttttagagacctagtgtatttgcaggaagtatcaggaatgctcatggacaattaattgggctttttacgaatacgctgatgctcggtgccatggagatgtaagagctgggaagtggagtaaccgctgtggtttttgtttaccttatggggcccccataggtgttaaacccttgaagaccctggtaatgaatgtggcatcttgtcttgagaatggctccttgaccatcatggttggaatatcctgtctgttttcatttatctgtggttagaacaaaaggagacaatctcagttataataaatgtcttctagaaaagcacacttatgcataaatattttaaattttgatgtttcgtgttttaaaatagtctataaaatacacccacagagatgcttatagtaaagctcagttttccccattgcaaataaacttgatgtcaacttgtgccacccactgaaaatatttaaacgtcacgtaattagtaacatattagatgtctctgcttttagcctgaaaatgatcagagccctctcaaagactcttgtccccaccacttcagtttgctgagtagcaggactgtgatgggatatttactagtgtgtgtttagtcttttaaaaaaatcttttggctatctcccctcaccacatactttttttattctctttctcccactttggtttattctcttctttctatggcattttcttcttccctgcagattccattctttccacataaaattctgtacatgtagagtctcctgtttgatttctggtgttctcaaaaagaaaaggaatagaaaatgcttcacaaatccagtaaataaataatatactaatagcaaggacctttatgaaatgtctgcacgaaaaccaatgcaccacaaactgccatctctacacaccccagacttcccaatgtgatgatttagatccttttctacttaggcggatggtgccatttttgccgaattcagcatgttcattgaacagtttctcgaagccaaaagccaactccactgcatttctgcttggtaaggtttggtggccttggcgtggggtagaggttgttgattcaccggcctctaagctgatgataaatctagaagctgggcagcaggactagactgccttcatagaacctctgcagggagtcggcggccccaacactgcaagaaatctatgaaaaagaggcttagcaaacccgtgtgaataaaggctccagaagaattaggggtcgagaagatgtggtgagactccgtgtgagtgggcatcagtgagaactttgaacactagatacagaactcgccaactgaaaatgtgcttctgcttctcgagatgcctgtggactgtttattttcttagtctaaatatctaaatcttctatcatgagcatctattgagatgatgtattaataattgtccataatatcgtgacagagtctgtctgttgtaatgcacggtatcactctattgcgttttatttgtgtgcatttatgcaattctacatctggatacttatccaaagataatagtattttaattttaatcttgccttcagtagaaaataaagccctggaagagggttcccaaaggtagctttgacatgtcttttgtggagagttgtcctgggatagtttagctcaatttacacatgaaaattccaacaccaggaaatccctccacctgagaggtggagaagattaaaagagtctaggagttttttagtacagccatagctcttttcacctgtcctgcagccccaaagaccatagtgtgctctgcagaccgagtacaacaatctggtgtcaataaccaattcctgtataacaccttttttgttgttttttatggttttttaaggaataaagtgggttatgtatgtaatatatgctattatagttggggtgtgatcatggttgatatcctgacttacacattatatatattttgatttaggaaaaaaaaaaccctggtatctgtgtatgatccctcaactaaaatagctcagtctccaactagaatgtatattagtcaaggcatctttttaagagacattattttcatgctcacaggatcacaggatggaaagggaaattacaaaggagtctggaaataggtgcatttaattcttcccaatttaaatcaaagtggtgcatctttaaggcaataacgatattccttcttcccctcttcatgaacgcttccatcaatgaatttctttaatgttgatgatggctggtgcagtttgagggaatctgtatttagtcagaaaatgcttcaatagaatgacctaccagatgggccccgtaacaatgcacagaggcatcaaaccaccacagacatttggtgcttagaataataaaaagactataaaattagattagttgagtctaatttggaattggtatattccccatgcacccttgccgctcttgggtagataaagccttgagatttagcactgtgtcagagcagaagactgcaacttccagtaaaagggagacgggggaacgggagagaggaaaaaagcattctgggaggtcgcggagggcagagcagtgacctccaatgatttacaggcctttagcttaatgaaattgtttcagtgacatgacggtaagagctcgtaatggattggatgccctaatgtaatgaaattactcccttctgcctaaaaaaaaaaaaaaaaaaaaaatgcgcaattaatatttactgagacctgacagccttttggtgcgctcgtctgtgtagttctctcagacagtcagagaggagagacggagcagcgtggcagacaggctggctctgcacgagctcctggcggggaccagcagcgcctgcaagggggtggagggacaggcgctcgggtggcctgggccgccggcccctcacgctgcccccgctcagccttcatgctctcccctgcttttccacaggcaactggacaacaaccacatcagctgcattgaagatggagccttccgagcgctgcgcgatttggagatcctgtgagttgattttgcgatcgctgccttgtgtgtgcgtgcatgtgtgtgtatgtgtgtgtgtctgtgtggggaggagagagggggagagtgtgtgcaggagggtctgtgtgaatgcatttctggtctctgctgcagtgctattaaaattgggaaccaggggatccctccggctcaccttggtcaaagtgtttgcaggcagccaagtgtgatttcttacctcccacaaactgaggttcctgctaattaagtctcaattgagtctttctccttttcccccagtgctcctgcagcattcgttgctgggagaaacagatgggctggagcagaaccccccagagcctgccacagcatcagggacagtgtgtttgagtgcgggcacactgggagacaggggccggggttggggccagagagaggggttagtgccaggaggtcagctggaattacctgaatcagaaagggaccttggcacagggcaggggaatgccacacagcctgggaaagcccagtcattgctattgctcctgggatctcatctcaggcttcaattcaaactttaaacagtgaccgtgaccttaaaggggccaggggtaggggggcggggggcaggaaatagggggagatgagaggagacagccccttccccaaaatcctaccctatacaccttgtctagaaagaatgtgtagctgcctttctgagctctggattttcaaatgagtctaactaagaaaacctaactcccaggaggaaagtcagctaggagtcatcttggggtcattccaactaaagttgaattgtgtaagaaaacattttggttattctcaccaaagctacacttctagctgtccctgatttagagaagcccagagaggaaggcagtacagcacaggagaacctgtgccacttctgtcaggagacgtgtggttgagtccggattctgccactgattagtcgtgtgaccttgggcaagtctcttcggctctgggagcctcagtttcctcatttgtaaaatgaaagggttggttgctctgtcttgggagtgacttcccctttccaaattatgtagctgcttggttctaaaaataattcccatggtacgattctagccagtgactgatagcagagtggggtttctcaagcctcctcctaaaaataaaaaattacacagtcacaggttacctatctctgattccagaagaatcaatgaatgccaaataaacaggtgaatgaatattttgaagcattcctttgtatgtgagagaatgagtgaaaggtcctccctccaccttcctcttcacctggccccgcagatactagcaacgggttggagagagcctctccacattatttgagaggaaggtgattccaagaggaatcacgggaaataaaaggggatgctgatgctgcaagctgcttgaaatcggatgaaagccgagaattcccggtccagaaaagacaggacccacagccagggaggtcagattgtcatttctgagatagattgtctctcctcactcaaactctgaccctggaactggcaacaaatgcccgtctgccagagagaggatgccagcccaaatttagtaacctaggactcctcttatcaggaggctggggctgagaagggtaggcaggattttccctgcctgcaaaatagcatttgtagaaagggctgctcacagcacatcacctttttcctcccttgacagagagaatgagaaagatgagaaaattccttgggaagagaccaggaaacggaagtcaccagctgccacgaaacagctgtgacaacctgacagccctcacggtcattctctgtgctaggaacggtgttgtcttacctcaccaggaaggcagtctgagggagaagagagggctttacagccagacacacctgggtggggcttgggtcaagtgtcttcatctctctgagtctatctccccaacttttaaaaacagacagtgtatgtactacataggaggggctctcataactgccatcccttccactttcctaactttgcccccatacaccctcacccccatcaagcccttgcccaggacagatttggacagctctcctctactcagatacaaaaaaaaaaaaaaaaaacgaaaaaacggtatccagatgcaccaggtgtctccaagttgaagctttaaaaacctgtgactgaaagaaaaaaaaaaaagttctcattccttatcattgcaaagagcccataggatctgattagtttatcttctcaattccaaacaaagccagatcaatagctttgttttaaagacactctcatttggcttcacatggctaagtacttaaaattaatcataatcagttattccatgggtttttaatttccagcagaggcacacagctttgaaaccatccatcttaatggtgagccattctgaacttggctggagctgacatctccatttaaagaacctcccctccccacccctagaccttccaaatctcatccacacattgacattttataatgcttctctgtaatcacaatttaggctccataaagaatcctgacaatgaaataataaataggaactcagtgacagtattacacattagcttgataaatttctgagtgaaagaggagagttcaaaacatcctatccccagaaagagcattttaaaatatctaaagcttaaaagtctgcaaattaagaagacaaaatgtaatgtttcgggtatgttttctctgacattaggcagcatgaagtagaaatcaagcaaagacacattggttgtcccagaaagctctcaaattaacttaaggaaagtgtatggatgtcaactgcaagtagaagtatttcgcatgcaataaccctgttattccatccctcctgtggatggaaataccataaaacttctttccatcgaggctgacaatggttttaccagttacattgaatgagaacattggaggtgagcctgagagggaaccactgactatgtatgagaagaaatgaactggtacaaggttgggaaagactgaaatctgcccacttcaacctcatttttgactcattcccgatgggggatgtccagtgcagagtatggtggacagggaaaggagccatcccctcccctttccaggaagtaagaagaaaagcatagtatcgggggcgaaacttctcattccttccatgccactacggaggaggaataatgaggaaaatgaaaatcgctagcagttactcaagcccagtgataccaccagtgcttttacatgcactagctcttgccatcctcacaatctctcaatagaactactgttaccctcaccctgcttttacaaaaaaagtagcccatctcagagaaggcaagtaactgcttagctaattagcagcagagtctgtgtgattaaccattctaccaagctgccttttggatgcatgttgccaaggctgccatggtgtttggctgccctgaagcatggcggctgtgggctgcagggtggtgtgaactggcctcaagaactgatggaggcaaactagcaatgactcacaatcccgctggggagaatgtcggagcctttcacaggcttgtgaaattggccctgccattccctttacccagttaacgggtgcccacaaagttgaaggtaaatcaaacttgcaggagtaaggaactcgtcctgctttttcactgatacacttgtcgccccagagatgatttattcccactcgtggccattgccatagactttggcactccacagtttgggggctctactttctagaactgtctccccctcctaaaaaaatacagcctcaactttgtggcatttaaggttcttaattgagggaccgaggctctgtgagtcagaccctctgctgttactcaaatcattgccctttaatttccacctgttctatgcttttggtaattcgcatacaacactaggttttctccaagtaagtcgtgcttatactgcagttgaatatgccaagactgcattcctggctctgtgtggtcaggatgcactgtgctggtgctctgagccctgggtttctagcccataccagccaggctgaggatggccaggcatttcaccagttatagtggcacctccctgactaacgtaccatcatgggtcagaaaaaaaaaaaaatgcttaactctaatgaaaaaaaaaagtagggacaagttaaacaaaaatgagaaaacctgattaataacatatgtcatgaattgtttttcggtagtattatgggagaataaaaaatacttttggacattgtcccttgactaaaggtagcaagtcagaagttcaataaatacgttgtcaaaaatgccggaccacagataacagaaacacatcctgaaaatgctctcatctcctggtgattggtctgcccttgagaaatcactggtgccaggtaaatggcatggagatcccaacaggtccatagataaccggcgtgtgctgtttggaagctctcactcccatttatgtcacttgccaattttggaaattcactgacattattataggttggcgctggtaggaccttaggtgtctccaggatgacctctcactgtccagattaagacccagagagcaggcactggagagaggcccatgccacctagcattctgcaccctgagcacctcgcctggttcaccctaggcctggccctggctaggagacttgcctgaagtcagcagcaagttggcggtaacaggggaacttagaatttgggactcctcacccgtgtttctgtccgcattgggcacctatatgcaattgttcagaagggagcccctggtaagattgggaatcccaagcatagttcatcctttcaaaacccaccattaagttttgggtattatttaggagactgggggagggcaaatgtttgtctgtgacagaaacaagggatgatccggctcttagctctctttaaaccggaggctacaaactagaccacacaccatattgctcccataggtgagatttttcttttgtcctgtggaatgttttttaaaaattgaaattagcatttcacatttaaaaattgagatatcttacataaaaagcccagatttccagcttctctggaaaaactagaagcactggcaactgtgggccggcatttctgcattgcagtcagctgtggctggggaacacctgtcctccttggacggggcatgtagaccccactctgccactgacccctaccaatttacattaactgccagcccacgtggcccctgtgctgacccatccaagaagaaaagacacgctgtgtggccagcacagtgctgggcgctgggtacagtaaagcttgaagtgagcaggtgcttggcaggctgagctccataggccagagctcaccagcatgatggagtggacacacagagagagcttagtgatgtggagtccaggacgcccgaacctaagcaaggacaccccagaggcaatcacgaatccctcatgtctcaccttctgaggagctcttctcaagggttaaactagtctccaaattgcctttgatgttacagcagttgtaattggttttatgcctatgagggtgaaaaacaagaggtgaccctagctccacgtcttcatcacaagagccgccccacctgccctggttcttgttccccaggcccctggatcaactggtgtactgaggccaccaagcccacgtttagagaggagagattgaagagttaaagcaatagcagaactaaccagatttttagggtagttctaattcagtcatatcctggtgggttcaacgtggcctgatgcggaaccccacaggtagacgcagaagagtgaatggggaaaaggtcattttctggtacaagaggaaggcagtggaaaaaaatcgacagcagtcctgaaacctaggtcagggtgtgctcactctcctagagcggggttggtgtcctggtacagggtgttaggatattcaagcacgatgttgcccacttcagagaacccagagtttaatgcaagtcgcagtgtgttggccacttcagctgagcttcctctggatgcagagccagaggattaacgaataataataatgacgtaacgataatatatagtaccatggtacaataattattagtatgattatattatcttgttagagtcccatgtttgagcatctactatttttgagagtctacttctatttttgagcatctttaggtactgtgataagtcagtagaatgaggcatctcaattaaatcttcaccacaactttatgaggcacatcctaggaactgcatttcaccagtcaggaaactgatgcttagaaaagttgactgacttgcccagagtcacagtggcaagtacgaggggactactctttccgaactcagatccagttctgcctgatatctgagcacctgcccttaacaaaaataaaaattaaaattaaaagcacctaccggaacacacatacatagaaacaattatatgcactagtgagatcattatctgtagtgaatgcccagaaaacttcagaaaccatagttattgaaacactgacccttagggtgcttagatctaaatttatgacctcagcttaatcagcaacagatccagttccacaaaactgccccagacataaaggtacagagccatggttgagctttggaggggttagagtcctctcatagaaccagcttccagctcatctttaccagactaggtggtttggagttcatttccttattgaaaaatggaaactgtaattcccaaccctgagaatagctgtgttggttaaaagagatatcgttggtgtgtgcctagcaaatagcaggctcccaatcgggacgctcataataagtaaagctggtaaatacttctgtactgtttctctgctttatgtccacatctcactcactcctggcacgtactaagtggccggttaaagtatgtggaaccaaatcgagttgaaattaattaactgaattgaagcccacaacaccagtctctagagtccctgttatggcttgtctctgaagagaacaagatatggttgtcctggaatcattttaaatgttgaacaacgtagtattttactgaaccagtccacttttcacattacctttgattttgcatttctctggctaaatggtgatctttctttctcattttaataaggaacaaaatcggagctacagtgaaaattggtgtgttacagcagagactagactcatttttatttatttataaaatgtttcacctgggtttctctgggagctacaaacattttatcagggtgtttagtcatgacatagttttgaatatagaactgtcatggcttaatgaaagtcttaaaatatctccagatatttttcttttggtactgtgctgtaaattgtgatatgttcatgcaatcaggattaaaattgcactctatagaaagcatctgtaacttccattcagcccctagaatactaggaaagaaactgggttttctataaatgctctcgtgccactcaacacacacctccttcttagtcatccagactccaggttccatgacagtcatgctcttcaaatgactagcttggttttgagaaccccagcttaaggaaaaagtaaaaattactttgaaatctaaattttttttttccatttaagtaagtagcactttcacctttaaaatacctggaatctgcgggaaacttgtggttttctagttgatttcactttcctgttaaccaaaagctagtttcatctctgaagttgaaaatgtattggtgtacattcctgggttaagaggatgtggagaagataattgaattgtttttgatcagcaaaggatcttgaatcaacgaacctcctgttaacttctcccgtgagtagcgcttagggggagtcggcaagtcgtggtggtcttgctgtccccaggggccacacattccagctgccagatctctgcactggaattcagacttgacaaacttggtttgggagcagtcttttgaaatgctttgtcccacctagaacaaatgggaaaaatagttctccatgtttggagaaagattccagagagttttctttcaagggcaagatgtggagggcaggggaaataccgtagagcagccacatgcctacagcggtcagttcactcctaagaccgggcttctgtgctgatttgcaaaggtgcccctgcctgatggtcagcctctgccctttcaccatcccctcagctcccagcaggggctttggtgaccagtatttgagaatgtttagtgaataacttgcctctagatcagcgctcatcccatgacactcatggacctccaagccagggagccttgttcctcttgaacagccaaacctgcctgccacagctgctgccattcccaccagggatgcccaagattggacagctcagcttacctgtggctgagagtctgcttttctatagacctgagtcttgaaagtcaagatcctaggagctttcacaggaatttggccctctcctacccactggcttaatggaaggaaggatgatgtggagaaggtgatggagacacaaggctgggaagaacaggatcaacattgctacttttccctgagctttcattttctatctttgaaggtattaaaaagtaagggatggaccaggtgaagtagatcatgcctgtaatcccaatgccaaggcaggggcattgcttgagcccaggagtttgagaccagtctagacaacatagcaagacctctacacaaactaaaacaaaaacaaaaacaaatttttttttttttttgagatggagtcttgctctgtcacccaggctggagtgcagtggtggaatctgggctcactgcaacctccgcctccccagttcaagcaactctcttgtctcagcctcctgagtagctgggattacaggtgccagccaccacgtctggctaatttttttgtatttttagtagagacggggtttcaccacgttggccagtctggtctcgaactcctgacctcaagtgatctgcccacctcggcctcccaaagcgctgggattacaggcatgagtcaccgcacccagtacaaaaaacaaaacaaacaaacaaaaaaacaacactttttttttttttttgaagtaagggatggtggatgaaggagggatgaaggaaataatgactccatttctccaaggtcatatttggattcttcaaactcattgtcaaaaagctctagagagtccattttcttttaacttgtaactaaatcggaggactccaactgctggcccatgggttgaatgaaaacagcagatgtgggattttatatttttctttaatttttttgtttacaaataattagaatttgttgccaacatttaaaactcaagtaattttatgtaaaatttataattcaacttccaatgaatatctagaaggtttgccaaccctgggcccgcctgtggctaggatctctccagcagcaccgtccaatagaactttctgtgatgagggaaatattgcatctctgtgttatccaggatggaagcccctggccacacgtgactcttgagcacttgaagtgcatcttacacaactgagaaactgaatttttaaatttttaattttaattgattccagtgtgaattgccacgtgtagctcatggctaccttattggacggtgcaagctgggagcgaagtgtgggtgggtaccctgtctggacagggcatgttctgcaaatcaccatagctcccaccaggtctgcttccctgtcctgctccaaatctctccagccatttcacatccattaagaatgtttaaacagtgtcttttctagcagtaaatctttgaaatatctgccactcccctcaccttccacctccatctttttttttttttttttttttttttttttttttttttttgagacagagtctcgctgtgtgtcccaggctggagtgcagtggcatgatctcagctcactgcaacctccacctcccaggctcacctcctgccctcagcctcctgagtagctggaattacaggcatgcaccaccatacctggctgatttttgtatttttagtagagacggggtttcaccatgttggaccccccggtctcaaactcctgacctcgagtgatccgcccgcctctgcctcccaaagtgctgggattacaggcatgagccactgtgcccggccctttctccatctaaatttaagcatctgggtcttatacccacaaaacacccatttttatccaaacctgggagtgtgatccttacaacaatggcccaccaaaaggaagccctttcagtgtaaattcgttccctgatccccattatttgcttctcacagccttgcaaatgacttccacaaagtcaactgggtaagaaaatcactcccctgcctgagcccttcctgtctccacaggtatactagagatgcggcagccggttagggaaccaagcccattaaccccacagaagctgagccaggtatttgcataaacagagaaagaaaaagagccggccctgcctcactgttttcacatgctgcacactgggggctagttgtgacttccagactttggccagatgtcctgtctgtgcagagctgggcagatctgggcatccatgaccacttcttctaacatctggaaaatgattcccaatccagaaatgctattttagagccagcacaacccaattggaattagagagtgaaatttaggctagaaagaccctggaggtcagctggttccaccacttcatttaaaaaaaaagaaactccctcacaaaggttaaatgacttgcccacagccataggaaaaattcgtggaagaaccaggccagaaagcaggtcttttggctctttatccagttctctttattgctgtctgcttgcccctatattagcagacaggaaacaatagtaagtgaagccagctttcatgtcctgttcatgccatcaccttttaatctctagcattttgctagagggaacgttttgcattcagcatgaggacaacaccctccctttctagggccttccaggcctttggccactgcttgggaaatggccactctagtgcccaatagattgtccagtcagatggcagtctggaagagaccagattccacatcattgatccctggctgccagggatgaccagaaacccgttgagtaagcactggagtcccctgcccattgctgagcccagttagcccaagctgtaaattgcactcagcttcctgggagactccctcccttgcaaatatcagaggataaaaagcaggacctctctggcatctcagcccaggaacagagcctcatgcaccctgtgcagctttttctaacagctctgaagtggctcagtttcgactgtccacaaaaagtggcctatatgtttggccacagaactaatgagtagcatgcaaaaaccagacaagagctcacctgcctggtggaaaacagtcttacctttagaaacagaaacttattcagggctctttgtccccaagtaatgatggttgtggggggagaaacaatgaataatttacaatcatttaaagataattcatcactggtggctgccctttgggagttgcagtgtagaaggaaggtttcaactacatttcaccataatgccattgaagcactttgattttcttactatatttttttctgatttaaattattgaatgaatttgtttggttcggagaccaaaaactggcacctgcaagccagatccagcccccaggtgtttcatttgtgggttttgatactcaaggtgttttagctgccaatattaaaaaaccaggagacctcatatgaaaattctagacgtctggctttctctttaaaaataacaaaagggaagaactggcaatgctgcacccccattccagcataacacagtctcttgaaacaagaagtgacgatcccatttagtaaggctgggtttacgacagtccccacgcagctcactcacttatatgacaagcctcactcccgtaggcaattgtgtttgtactcctggattagcccagaaggctgttcagagtgggaatttatttgtatcaaaagatgccaaaaacctgactgttcatgctttgatattcgccagcccattcagtaaacagtgaggcttcctatgtgccaaacactgggccaggctctggctacgtaactacatgaaacagacttgctctctgcccatgcctagtatacacattcatggatattttcaaaatgtccctcttcttcctctcttactggctaggcaccaaatgcagctgaggtggaaattgcctgtttcttcccttttcaactgcaaactcacctgtccagtaatgtaagttggaggtcactcttgcatctgtggacacgttggcaattgcctgatttctaagtcaagactgtccatggtctcagtctgtagatgatgaaacagaattgggagaccaaggccatctcattcacatggtcatttaaagtacattttaaaataaactccatcattggaaggcagttgagccattctgaatcactgctaggcagtatctgtgatcatctcagtaaatgaataaggagttcttcggagtcaagggacccccaaacacaggatctgattgagtagtgacaggatttgaggatttatctttctcttttgatcttccacttttaacatttttcggaggtattgtttttctttgaacaccgaggctctgccgagtggatggagacgaatttctgcctgtcataatatgaatatataataaaagaaccaaagacaagcccttttgttaaggaatctgtattatcaaaggcccaaattggcagctgattgtttttatttatttctgtaggttttacatgacacctggagaccatttaaaatgttacttggcggtgagagctgtgtgtttaaaaataacgctcacccggtgccaaatcactttagagtcgggtacaaatattgagacaaaaaccccagctgttattgctttggctgctaatttgaggtgtcaaatgagagctcgactgctatacgtcagtgaataaggccccttgtgagatcattatgttttctaacagttgagagtaatggactaatcagtgcagcatcagttgttttcattatatgcccacacaatggttatgagctttaatttaaacggtccacagggagatcaaggaactcagtaatatgcagcacccaggatagtccaggaaagcaggtaatgcgaaagagatggcttcccacccttgtctcacctctccctccactctcccccacccccaccaatctctctcactcctcccgcctcatatgcccttggagacccatcgcccactccaaacaagcaaaagagaagctttgcttaaggagcaggcagatctgtactttctattctacagggtattcttaaaatttccagtcaacctatccaacagtaagggccactaggcttttggcaacactgatacgtgttagccaaactttgaccttagacgcctttgggacctagttgtcctctgtcctgcgttgcctctcctgcttccctcactgtctgtgctgagctgtccctgctccttggacaggaggagggctgtctagtgctgttgccttggagcagcctcagcagtgaggccaacaccatgttccctgccacttctgggaccagtaaaggatgggtccctcacaaactcatgtgattcacctccaccttggaaaaatgtggaagctggaaaggtgacatctgtctgtctgaagacaatcctgtaagaggcagttttgtgtaatgatgaaaaatataggtcctggtgtcacacctctgggctttgaatattggctccgcacctctggctgtgagatctgagcagagtttatgtcatttcctgggcttccaagtggaagtaataatatctcaggagtgttgggagaattaaatgagataatgtatgaaaagtgctcaggctagtgctgggacttagtaaacacttcataaatagtatcagcattatttctgctattatgaacatcatagatacctttactggaagattttggcaagcttcaaagcgatatccttgactagtctagctcattagaggaaagtagtgtgttcacaggagaacctatactattctgcttaggttttctctaaggatgctttattgcatcgttcttattcctggtttctggagcttcctagagcccccaggcacattagagcagtgtacagctggatgagaagggcaagttcaacctggagatgagggaaacagtaaagggagtttcacttaaaaatgatagcgtacttaggaggaggtgctgaggatggaggccctgggctgagcgggaggcttggggatgcccctctcaacctgaggttgagagagtggggttgagcattcagtgtatgctctcctgggaccaagtccacaaagagaagccatccatgcagattctaatagagctgagtcagccaataacgatcactcttaggacctgagtgtcgtagggcctggtcatcagcagtaggccctgattcctggtcccatgttggctgcccatcagcagctgcccagcaagactgagaagagtggcttgctttgacctgtgagccagagaggagagcaggcacataaaggacagccccaagaatctgtagtgtccccagtttcattcctcttgccctgcctgagccaagcaagagggatggccagcagtgagttccccttgaggtccgcacactgccagaacccctctgtgcacatcgtcccctgcctgtggtttaggtgtttctcacagggtccggccacaggacttatactctcagctgctcttcaggaaaggagtctggtactttggctgcatccacctctgttaattcactgtaggcactggcagagattgcactttcttctaggcttgctgtgctggccattggatgcccacatttgtaagtacaactcagggcatgtctcagcccactttattaaatagatatcctgtcgtcatggtggctgatgacttaccaagagtctccttcttgggggccattaaggaggaaaccagcttgcttatgtagacttagggagaagtctatctgccttgagacaggacatgagtgggccagcccaccaagaggatctcttggacccaaggagtctggatccccacctatgtggatggcaagaggagagattccaagaatacccacaggaaggttggcacacagagaggctgcagtggcacttactgcagatgcctggttttgcaattatgtgatacatgctcacagataatattgttgcattagagccaattacatggtgttatggacacacaacacgcagattacaaccagagccaggaaagcacagagtgaaaaagcgatggcctaatcggaggagacagagggaaacatcagccttattaaggttgccagggtggggtggctgcagctggacgtgtctcctccagatcaaagatggctatcttgagggatgcagtggagagccccacgttgacactcagaagggaacagtggaagccaggggcagaagccaagttggagctctccaaaggtggttacagccacctccgttgatttcagagtttaggcttcttcctaagtggggaaacaccacgcctgccccagaagaggccttcagtcctagttgctgcaaaagagcatcctgtatactaccctctacacttaagtaaaggctctattcttagctttttccgtagttcaatggttttccaacacgaacttgcatgagactcctctggaaagctcattaaacacacaaggctgagacccaccccagggttcctgattcagtaggggcttgagcatatgcatttctaacatgttaccaggtgataggcctagtctagagaccacatttttttttcttttttcttttttttttttgagtcaggatctcactctgtcacccaggctgagtgcaatggcatgatcctggctcactgcaaccttgacttaccaggctcaagtgatcctcccacctcagcccctcaagtagctgggactgccgttgctcaccaccatacccagctaatttttatttttttaatgtatttattttatttttcatttttttggtagagacaggttctccctatgttgcccaggctggtctcaaactcctaggctcaagcagtcctcccgctgtggcctcacaatgtactgggattataggcatgagccactgcacccagtctggggaccacattttgagaaccactgcccaagttccttccatgcacaacccaaggtggattcacctgtcgtctctcttgagcagggccttcccctaggttccgattccatcacggcattgcaggttccagaaagagcgggactgatcttccaaggtaggagtgagactacctgcttttgaatcccaatgctactacttgccagttgggatttctgaaaatgttttttgtggtttttaagttttgaatgcctctgacctaaacccctcttctttccgagcagttatgtgccttgcctagcatatcacatttaatcactgacaaaggcagagacaggatggttcagttctacagcagccaagggccaacaaaatttctataaaaatccagatagaaaatattttagctttgcaagccatatggcctgtgtgtcaactacccagctattgtaatgcaaaagcagatcgacaatacaaaagtgaatgcgtaaaaccagttttacaaaaacaggctgcattggatgggattaggcttgtgggcagttgtttgccaacccctggagctgtccattatgtgaatcttcatgtattcatcccgcctggggagcccttgtcctgcctcagtaccctggcattgagctaataggcccccaaagatgtccatgacctcatcccagaaacctatgaatgttgtcttacatggcaaaagggacctggcacatgggacaacattaaggatcctgagatggaggagttatcctggattgttcagataagctctaagggtaatcacgaggggccttgtaagaggaaggtcccaggaagtggagatcacagtgagtgtcaggagatgtgacaacagaagcaagaggcttcaatggctgtttggagctgtgttcaaatatattttttaaaaaatcgttgagtaacaaaaagaagaggttgaagtgacgcaatgaagcagccatgagccgaggggcatgggtggtctctacaagctgcaaaaggcaaggcagcaaattctcccctgaaagaaacgcaccccagaaacccattttagacttctgactgcaaaactgtaagagaataaatgtgtggtgccttgagccaccaaatccatggtaatctgttacagcagccataggaaactaacatgggcctcattcctggactcagtcttgcttggactcaaatcttggcactaccacatgcttcaatcatgaaatggaggtgatattaaaagtccctgcctcgtgggataattggaggaattaaatgaaacgatacaggctgggcatggtggctcacacctgtaatcccagcactttgggaggcctaggcaggcggatcacctgaggtcaggagttgaagaccagcctggccaacatggcaaaaccctgtctctactaaaaaacacaaaaattagccagacgtggtggtgggcacctgtaatcccagctactcagaaggctaaggcagggagaattgctggaacccaggaggcagaagttgcagtgagccgagatcacaccactacccttcagcctgggcgacacagcgagactctgtctcagaaaaagaaaagaaacggtacaatgcagtacccttagctcagagcccgtctggcatataataagctctcagttaatgttagcagttatcagtaacatctcatctaattgccactaaagctctatgagcccagtgctattattatctccatgttacaaaggaggaaacgtaatgagattaagaaatttacccatggttgcataggctgtaagtggcagagccagtctaaactagtctctgccttcgaggtccatgctcaccacctctccttggcattggggttgtaacaacaattccttcattgaatgccagctacttaggcagcggcacaagaagcaaatagaatgcagtactctgtgtgtgggcaaaagctgccaagactggaaatcaaataaatctgtgtttattagggaaacgaaaactgtagctgtcgtagcaatcagcgtctgagaggttaccaaccctctgacatccccgggctggccagccccaagcagcaaatcatgaaagtctgaatactgtgtttagtcattttggttctggaataattgctattatcgtaaatgttttatagcactcattacgactcacatttaaatatcagtgtagtaatacattaataagtcatcgctgctggactactgccggatgcagttatagttgaggccctgcttataattgtactgtatattcagctaaattagagccaggctgtgaactccacctgatgttgaatgactgggtgtgcttggaaagaagccccttctctgcaaagggttcttgctctttgaaagatagggaggatgctcagatttttttgtctggtggtcagtcaacaaccttaacttggtttcccctaagtgtggagcccagaactctgaaatggacagaaggtgaaatggagggatcatttctgccctggaggcatttctaatccaatgaagaaggggagagaagcatagccctcacccccaggaagctccctgccaaggcagagtgcctggtctgatagcagtgacaaattcttcagtgttgtttgatgagatcttctggaagctttctggatggacagaggcaggatagattatcccccactgagcatctccccacatacacacacacagaaaagaagccatatgaaacaaaaccgctaagtgggctcaacttcataaaatgccaaatacctgcattggcgagttagtgaagtcataaagtaggcaggagcaggcaatgtaaattttgtctgttcgttcttctttaccatcccatatgcctaacagtgtcagacacatggtaggtgcacagtaaatatgggagggagggagggagaaagaagaattaggttctgtgcctttcaccacgcagatgataagtagatgtgggggattacacggatagtctgggccaagggaggtgaggccactggaatcctgctttggactgggctcacaaggggctggagaaggaattgttacaggtccccttgggtaggatggagaatatggggggcactgtatgctgagtaaacctctatttccatgggggttggagtagaggggaatataataggccaggccaggactagattctctccatgaatgtcagtaacatagtggcctccacttactgagcacataccccatgctaagccttttaccagcctgtgaggtaggtaccattacctgtttcctcccacaaataaagaacctgcagataagagatattgataacttgcccaaggccacacaattcggaagtagtaggatttgatttcaaccatgtacagagcaggacatgaggctatggtaatgcacaggacagaaaatggtcctgcctttgcagacgtatgatgtagagggcatttgaagcggaagataatgtgtttacgaaaagccaagggcaaaagacatctggcttaacccatgaaggcttccaaagaaagggtccttcctgggccagtagggacccatggaggctcaggagagggtaagaggaattggattgttgagtaagggatgtctgatgtggttctgggaggagcggagaatagaagggcacaggaacaagtggccaccatgaggaattgtaccaagggctgtatccaactcttcctctttgggaggtatagtgaggcaggtgtggggtcagggagctgagagctatgcctgacttccccacatattatgtctctccacctgggtagtcactgaagtaactgatgcaaaaggccctcctgctacgtgatgtttctgcctctgcagatggccttccttaggtgccatgctttccctaggcttccataataggtttctccagaagggtaagcccgggtacttgcctatagcctggcttcattcttcaacagcctcatttcagtctggttcatttatggagctcacacctttctctttgcttttccctgcacaaaagtacctgtcagagctaacaggcaccgtaggagctccgttcatggtcgtagagatgcaccggaaagaagagatgcgcagagctcacagacttgtttgagattagatgtgctgaaggctgacacagtggctcacacctgtaatcccagcactttgggaggccaaggcggggtggatcatgtgaggtcaaggagtttgagcccagcctggcccacatggtgaaatcctgtctctactaaaaatacaaaaattagtcaggcgcctgtaattccagctacttgagaggtggaggcaggagaatcgcttgaactcgggaggcggaggttgcagtgagctgagatcgtgccactgcactccagcctgggtgacaagagcgaaaccccgtctcaaaataaaaagattagatgtgctgaaagagtcagaagatgcctagaaaatacagaatcacctatccccacagcatcctgtgcgaggcaacacatgcaatgggagtatcaaggagaatgcagcaaggtagtgctggactcagatcccacctccagagctttgcagtgattgttcttggaaaacttattttgcctccctgtggctcagcctcctcatccataatatgaggataacacatttgtagatttgtgtgttattaagcatatctgtttccttctccataaaccgaggacaggaataggtaactggcattgtagatgtaagaattagagatgttataatgaagcactcagtgcataggagggtttcaggaagcgatactcttactcaaggtgggtaggcaagtcctgagaggacagtagagggaaggagggctccacctgaataaaaaagtcagggcatgctcttctcgtctggagacctgtccacttgtcttcagctgctccactggctgggccatgactgttgactcatggtcttgcggtcacaaccatccctcccccgacctactacaagcatcttggtgcctcccctgctgctgcctggctgaccatctcccttgtctatctccacagtaccctcaacaacaacaacatcagtcgcatcctggtcaccagcttcaaccacatgccgaagatccgaactctgtgagtaagaagtctgtgcatctctcccattttctccctacctcacgcccaaagtgcagcactctacgctgcttgtcaaacctaccatgctatgactaggcagatggttccgacattcaaattcctccttctgctattaaccaaggggtgccttggcgagtgagggtagatgtagagtcaggtcatggtgccaccaaccatggttctgaaccaccgttctgcgtcagacagactcatttctcttaccctagaactgtgggaattcttcctgtgttgtgtgcatgttttccgtcctgatagaagagattagttttacattgtcacaaagcatatagaactctgactgaatgattcaccatttgcttagctaatgtcacgtaacatcagcagttctgtcagattgccagtggttgcaatggttttcccctgaggaatgacagtacaggagagtcactccttctctccacccagccagcccccacccagcacatttccctgctcacctgctccctggatgatattctgacattagaatgccgtctttctcatacttggttctttacctttgatgtcttaggtgggcttaagttttccagggtgcatactcaggaaacaaatctcctcatcgtgaccaataccgagagcagttctagtgctcttattacctggggagttcccctctgctcccagtcaggaacctctttgtaagtttctctgtaagtggactctatcagcctttccagagaggttcagacttgatacttggcttgtgttggtggagcttcggtggtatttgcctcacactggtcagggagagccagctcccaagggtgtcagccaaaaacatttagggccaaggccaagggctagaattcctgcagtcccctttattagctctgtttcctctgttccctcctctataaataggaatggtggtgaggatcagatgaaattagatatttaaagtgcctggcaagcagtagacaataaatgatattgattgttacattattatcacacgatcagaaatctggactgaaagttccaagcagccatctgatctgtgctgcctgtacaatccatgagatttggaaatccttagagcagagcttccacagtggggtccctagaccagcagcatcaatatcacccagaacttgttagaaaagcaagatttcaggccccataccagacataccagatcagaatctcttggggtggcacccagcaatctgtttttcataagccctccaggagattttaatgctcataaagtttgagaaccactgcattcatgagaaagcaactttatcttcaggcaaagataaaacaaagaccaaagaagcaatttatataaagaggtaatacagagaaccctaagaaggacacagagtttgcagttaggcctgagtttaaatgggagctctgccacttaatttgagcaagtttcttcatttctctgtgcttcaaggaaagtgagttcatgaatgcttgcctcaaagttgctgtgagaatgaagtgcagtttaacacataaagtgcctggtacatggtgtgcacacaacaaatactcgttattataaagaataataatctgagccctgcttccatctttgcttcccaaattctttcctggatccctcattgaaaagcataactcagccaagaaaatctgttcctttccctccctcttaaaatagggtagtgcagtaatggaattttaagaagccatttggtcttcaaagacctcttcaaagttcccagcaaaccacagatgagctggggaaaagtgggacccagggcttctgggcaagaagccaagagtgcacctcagggtgctgggcctgcattaccccagacatgtgggttgcatcgaagaaaaatgactctcacctgcaggaatcagccgtccagctcctgtgagctgttcctgtgatttatccttcccttctttgttattttcagtttagaagcagcaataacagaagctgggctcattccctgggagttgtagggacagggttaggcctggatctggggtactttgtttgggctgcagtagggcgggggaagagaacaggagggtttttttctactggtttctgttgtcattcttctctgccatcccgaacattcatctgatgagttcagatcaatcaatcaatctcgtctgttctctttgctccctgcctgctgccattttctctttagtttaatttcagagatggctctgtacagaactccctggagacttgagctgactaatcccccttcactgtaattaaagtgtgtatggggttgggggggacggctggtggtggtggagaagcggggaagaggagagaggaaggaagccataaatgggatttctaaaggaaagcttttatattgaatttagaaagccacattttatagaaaatgaacactgaccctctctaaaaggatttgctggaaatttaatttagcgtctgtggctaaaaggcaccttttataaattggcatttgtattcattcaccttatgttctgtagaggtggtttcatcaacatggaatatgatgtgtccatcagcaaaagattgcagaacaacatgcaggacccacctagccacctcggtgctacagtatctaaatgagaaactgcagccttgtccaggcagggccatgggctgggaagagagtgaagtctggagctagtctcctgtcagtcgtaattaacagtgaacatttcttcagtggtttgctgcgtgccaggccttgtactaagcacttcccatgaatcatttcaattctcacagcagccctaggaaggaggcatcactaatatccccatttgacagatgataacactgaggcccagagttaaattgccacccgaagtcaaagtcagaaagcacggagccagtgtcagactcaggcagtttgccatcacagcctgagctcaggccattcatcaggaacaaaagcagaagagcaggtgccaggtgaacagaagaagggggataagagcctctgcacagcccaggagcctatggaggccaccctcccttgtgtcgttgctgtcacacctcaccaaaactattgaaagtaattaaaataatgtcccttctcactcaagaggattagcgctacccctgacagtgcctaagctctaatttcatgccattatgattatttttcttttactatttgacatggtattgcttagcttgatctcccaaacatgttgtgaaaggcaagaatctacccagcttgactcttttagcatttctggtggatacaattccaagaagagggagtggagtctgttcaccaccctggactccactgccctgggcttttgacgagagccctctgatggctccaaatcagtctgggtcacctctttcctctggtgctcttgggaggagaaaaatttctattaagacggacaaagggataggaactatctgtatcaagattaagaagagagatagcttggggccagccagccaggattgagacaggatcaacctaatagaatcttccaaaagggaaacctctgacatttttattatcccagaaattaatcagctcagtaaggatctgacttacctaaacgtcatttttgttgttccattgatctcttacccttgatcggaaccgacgggaatttgtttgcattgatctgtgatccgccacatgcacacatgctccttggctcatagagaatccctgttgcctcagcttccgcgcctcactgcacaagagggcaaccacctttccaaataaaagccaaacgctcattaaaaggttctgcttctcccggcacacaaaagaacggcacctcagcctgcgcatgccacggcaggctgccctgtggtctgctttgtcccagacagacctactgttgccgtgttccttgggcaacatttatacccggcgaaaagtcagctgaaagtccactgccaagcctcctctctgtttttggcataaagtggttaatgcttaatgaataaacagaggttttgctttccctcctagaactgaggtccttcccaccagcttaggattctggttcgccaaccccttcctgcctgtctcacttctttccagagtccaggcgaagagcaagcagtgcttgcttcagctcaagaactctaagctttcaaactcaaaggggagaactgcgtgggacccattgtactcactgtatcttgggcccaggagcctgtgaaagtgtgtgcaacccactgggaaatgcaaaaaggaaattacatccagattaattatttttgaaacaaaatcataaaagtctttttcaaaattgttagcagaaaaaattacattttatatgggatataggttcatttaatctatctgatatgatgggatctggagccccctgcggcggccaaggccccagtggcccaggcctatgggaggcttttgcccacacagtggcaggaaggccctgctggcatccagcaggaggtagctgcacttggccagtgtttggcaatgttgaccttacactaagtggagcttggtcaagagcccttcagctctctctattccaggcgtggagggggcttgagcctctccacagggctgacactcagtaataactggcttgacacagactacttgaaagtctttatatactgctagctgattagcatgtccaggatttaggcatttaaaatgtgcatccgaaatgcaagtacatgacaagctgacgtgatgaaaacttacccactaccaacttctagtgacctagggttgtagggaacgtggaaatgggaaacccctgatagagagaccttgggggaagaacctggaatatccgtagtttgccttagaagcccctggatatccttagtttgcctccctggtagtggaaaggaagttcaagtcacttaacttgatgggattcccctcagaagtgaaacacacagatccctccagggattcttatctactcaggggcaagaaattcatccggaaccacaactaccagagggggaaagccaaagcgtcctagaactggttagaaaatattttcagccatacctgaatcagtcagaatagcaaatacaccagacagaattgaacacaggaaggaaagcaagggcactgtggagagatggctatggattgcaagagtctggtacagacaacaccttatttaagtgggagggtggaaagaaggtacatcctctaaaaatttcccttctgtctgcagcctgctcactccagctagtgcacacaaagtggtattggttttaagcccacaagcattacatgcagtgggtttattaaaggacacttagcgggggaacgaagaacaactcagggaaaggcaacagcgtctctcagctgcatgtcgctggagatgggggcattgagattgagaagcatgtttcaagcaacctgtaactcatgctggctaaagtgctgaaatttacaaataaatagcccttttgtaagtttgactccaatcaggatgtcactgtaataatgtcactccccttttctcatgtgctgaggcttgcttgagtgaaaagaaaagagggtggacttgctattaaaaaatgagctttgctcagaaccccggaggcatcctttggatgtgacctggcaatgaaagggttggggctcccatgtttttggtagtgcagagggaattgcttccctgggctcctagggattttcacactggagaaaggggcaacaggggttttggtcactctgtctggccagtgacagcctccacacttcacctgtgaccatgccttctctctgtcccgccctctcccaggcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccaggtgaggatgctttacctgctctcccctcctgtgctatgacccacccacccatgagctcccacaacatcaccctgaccttgaacacataccctagcccagagcttggtgtggaaggaaccccataggtcgtcctcagtactcagtagtcacttaaagaactgtgacgtgcctcaaagggttttaaaacagaaactcttgtcatctggtaaagggaaatgctaaaagaattcatgaactactttttcagcccctagtccattgatactagaaaccgaacatttgttgagccacacataaaatggaaacaggtataacggaggtgttctagcatctgctaaacatgttcctgtcgtcccattgctcatagaaattggaagacaagataatgtaggctctggagtcagctgcttggctggaaatctcagctctgtcccttagtggtgtgtgactttggcaagttactgctcatccgcaatatggaaataataatagttcataactcaaagaacaggtgggaggattaagtgaaataatgcatataaagcacttagcataatacacagcccttggtaaaagctaaatcagtggagcttaattattatagtttagtgggctcacaaaatgtgctgagcaaacataagagtttgatctgtgggtaatcgaaatgtaacagaagcacagattgcctatgtggcacagaaaacagaatgatgcagacacataactgaaggcagctcagatctctggggatgggaggtggctgagtaacccaggaaaatctttccaggggatgtagctttaaaacagagtcctggctgggcacagtggctcatacctgtaatcccagcattttgggaggccaaagcaggtggatcacctgaggtcaggagttcaagaccagcttgaccaacatggtgaaaccccgtctctactaaaaatacaaaaattagctggacgtggtggcgggcacctgtaatccctgctactcaggaggctgaggcaggagaatcgcttgaacctgggaggtggagactgtagtgagccaagatcgcaccactgtactccatcctgggccacgacagtgaaatgtctcaaaaattaaaaaaataaataaaagaaccagggtcccaaattttagttgtttgcttttactttgcattggcaccttccattctcaccaactcttcctttttctgtggtaaataagtagagctaattccttgacttcctaaaaaaacaaacaaacaaaaaaaacagaaagcattcagttgagaaatttcccaaagaggtattttgatttccaggaagccagtcccagaattggggcccagtggcctctaaaggctgagtctggggagttggcatgcaagaggaaacaaggaccccagggagcttaagcactgtgagctctgcatttctctcacctttctaactggtgcccacctttagtactaaagggtttaccgggcccagcatgggctgctggactccagtatggccagaagcgcaaactctctggcctcttctgctcttagatcacacttgcgatatacaagaattttccttgaattcaacttcatctcattctctgccgcttcctcctgtcatgttgttattttaccatgttatttattatctgaaaatattttaacatgtctcaagcagtacctcaataacttcctatagacacccacttagaaatcacttcccatcaaacacatataataaaaccatttatcacgcaggcaccaacttcaaatatagtgactataattacagtaattattcggcaaagggtacaatatcggcataagtgaaagaaataattatagagtacgagagtcatccaagaggtagtgagaaaaactaattagaatgataaaacacatcattacaggtgagtgccaggtttaatgtagtgtatgacctcacacaccacttcatcagagagcaccttcctgtcaaaggtgcagcaagacattgctcacccagcagcagtcaggatccaaaaccaggggagaaaggctgaccctccaaagtccattaaatctgaatgcctcactctttctcctttggaaaggctaggtccagcggacaggttcgtagttacgtgggagcacctttatcaacttctgtttatagcagttaatcccattgcttgtgatggtccctggagcttcttagtatgaagccaggtgtcttttgagaacatgagaatttagtccaaaggctccagacatgactatgctgttaacctccaccctctcgcctgtagtatgaattaagggcagggacatattgagacccctatgcatgagggattctttaagtgccttagcagactcccatgggttaccacctagaatgctgtgagccgttactctctgaaaaggtcaaggtcagatataaagatctgggggccctggtgcagtgaacatccatgaagattgaactcctaccatcatgagtcaggtgcatgtggaacatgccctccaaagacttctgctattacgtgggtgcaaaaataattgtggtttctgccattactttcaattgcaaaaactgcgaatacttttgtaccttttgcaccaacctaatgcgttttcaaaaattgttaaatacactttgtgagacaatgacaaaaccttgagaggaagcaatgtggaggaaggttcagtctgtgagtgtgcagttgaaacatgagtggtcagtctttgaggccctagagaaggaggttaaggagaagagctattttcaaggactgaccacactccacacgccaccaccaacaaccagtcctgccccaatgcctgagccccacaaggcatctgaaggatactgttttgtatggacctgtctatggtggggtgtttgtttgtttgtttgtttgtttgtttgtttgcttgagacagtttcattcttgttacccaggctggagtgcaatggcagtattttggctcactgcaacttctgcctcacgggttcaagcaattctcctgcctcagcctcctgagtagctggattacaggcacctaccaccctgcctagctaattttttgtatttttagtagcgatggggtttcaccatgttggccaggctggtctcaaacccctgacctcaggtgatccacccgcctcggcctcccaaagccctgggattctaggcatgagccaccgcacccggccctgtggtggtttttaactgcaaaaaccccaaatgcccctcattcaagctattcacctgttaaaccacaagaggagaaattcagtcaagaactgaagacaagaacttctcttacaaaatagaggtcatccactcaggaggaaaagaggcattggggtagcaattaagccatccctgggcatagcttcatcaccagcagtccccatccaggcagcataagaaaagctccctgagcctttaaatggtatcaaaaatttcaccaaacacatggctccagagacaggaaagagctttatctcgctcagcctgtgagggctctgcctgcccaagtgcctgatatctccctttgaattaaatccagctgtctggagcccagcttcttctccccagaagccctggatatgggctccttatcactccagctaacccagaaatttgctagcagtgcactttggcaaaattcatctcctctgtcaactgtacctttccagttgaaggcatttattttcttcccctgggtattgggaatttttcacaagggtggggaaatagagctttatctttttattaacttttttccctatgttatacaacttgactacttggcccccttcagcttctgctgaaaggatttctgtgaacttttcttgtttcaagaggaaggttaaggccctacggctggaagtgtctggttgcttgtggcctgaacccgaccagaactttatcaaagttcatgatcatagaccagagaagaagttcatgttacatgagttgcaagttgttggtttttttttttttttttcatccttatctaaagggtttatttgggggtttaaattttaggatttaccttccacttgttaattttctggtaccttaatctggaagggtttctaccagtcgcaatttgtaattcaaggttattagttgacctcctaaatcagttatctctttgctttgaatgtctttgaacccattggtttgtccatctgtttcacacttacctgcccttggccttaaatgtgagatatcctttcctacagacattagtcttgtcttctagtaatgaggggccacgtcgtacactttttcaggtgccccaaatgcctagaacaaagcttgaacctaatagcctctcaataagcacttcatttattattaaaaatgaaatatgcttatctctctagaaacaagaaactttcccttttcatcgtcttttttttttttaatttgggactagttactaagtacaaagataattaaggtaagccatgaccagccacccatctccttaggaggttttaattaaaacaccataattggacattgcaggaatgagattattagctttatttagccattcccaaaattatcatgcctctggtatttaaatcacattcatttatattctcatcataattgctcgagtcccattgtcatcgcagtctgttgttggcttttgaaaggccagaggccagtaaggatgcttaatttgaatactggaattaatttatttccacatgctcacaaggccattggagcttttgactctgcacttttaccaagtgaggtttttttgttgttgttcagactttcaaaatattctgtaaatttttttattttgttttgaattgacacacaataattgaacatactgatagtgtacagtgtgatgtttcaatatatgtatatattatgtaaaaatcaaatcagaggatttagcatgtctgtcacctcatacatttgtgttgggaacattcaaaatgctctcttctagttattttgaaatatgcaacacaatattgttaactgtagtcaccctactgggcactagaacaccacaactcactcctctctaaccataacttcatacatgcggatcagtctctccctatgtcctcctcccgaataccctccccaggccctggtaagcaccattctcctttctacttctatgagatcaactttcttagattccacatataacttagatcatgtggtattttgtcttctgtgtctggattatttcacctaacataacgtcctccggttccatccatgttgctacaaatgacaggatattttatggctgaatagtattccactgtgtatatacagcacattgtctgtatccattcattcactgatgaacacaggttgatcccatatcttggttactgtgactaatgctgcaatgaacatgggagtgcagatacctcaccaacacaatgattttatttcccttggatatgtacccagtagtagaattgttgaatatggtacttctgttttgaattttatgaggaacctccatactgttttccgttgtagctgtactaattgacattctcaccaacagtgtataagagttcccctttctccacattggtgccagcatttgttgttttttgtctttttggtaataaccattcaaactgggatggggtgatagctcgttgtggatgaggttttttaaagatggaaagaaagaaacactgctctaacacaacagtgtttgatcatctctagtgtagcttacacaacctgtgtctcagtccctgagcctgctcttcctacctcttgagattccaaggctctgatggttttcagtttcatggcaataaatggaggaatttggggttccttttggcagagcagacagaaagaagagcacagggctaaacattaaaacattgttgttcactagctttatgatcttggacagtttgcttaaccccctattcagtttcctcatctcatgctaagggggaaaaaaagaatggaacctaaatcatgggttttatgaggatcaagtgagataatatatacagagcactcaatgcagtgtctggcacatagtacacattgaatacatgttagttgctattacgagactgatggctactcttagtttggaccccactgtgtccttgggcaagtcccctcctctctcagggcttctctttccttgccatctccatgggcccatctaagtgtgaaatttggtggtctttttcccactcatctcagcaggcaagttaggacctttcgctttcaccttgataatcatccccattttaccatttaggagaagaacaatgtggctgggcaggaggcaggtccctggttatggctcagtctttcttccctctgataacttcagggggagttatacaagcagcagagatgggatactgggcacaatacccatgcaagcagccgcagggactttccctgtgagagtttgggctggagacgcatccctcccctctcactcacttgagtgttccctggaccggaggcagcaccactgatgatcagtgaggagctgggaggggcctccattctcccaggctctgctctgtcccccttgaagtcatcaggccatggtccagggggccttaaagacatctgaaggttaggaattgtagtttctgccccgtttggcacaaagacagctttggcttcagatagagagcccagagccgaagtggtgaccaagtcccccccagaggggagacgcgtattgagccacatcctcagcccccttttctggagaagaaatccaccccagcagagcagcattttagtgccactgaaagagctccaagagcagatagtgtggacacttatttaaaaatgaagacatgcagagcaagtccacatgctcctaatcaaaacatcttataacaggggttctatagcctggtgcatcactgtgctctgagttaaggccaccttccttgccagtacataggctcactcaaggacagtgtgggtcatgagaccgccataagagcatgctgtacaagaggaacacacatgtgcatgcagacagatgctttcatcggagatatagaaagtgattccttctatcccaatataaaattgctattcccattcctctctgtttcccaacttacagtcatataatttgctgggtaaaaaggtaggtgtttccttactttgtcctccttggaaatccactgcctctaccttccccaacatgtgtggacagtaagggctggaaggggtggatttgctgacagagctcagtagactgcttaggacaccctggcttgtgcaagtgagataggctcagaggggccccaggtgacttggacaagtgattttgccagcatggaaagctgtggtggaaagaagagagctgcagacagagtcccatctcccacggccactccacctccccattctacagctcatcctacctaccagaggccaggcactcaaaactcaggaagcttccctcagggcccttccagaaggaacactcacctctgtagctttgtgacatttagcccctccacatgtgccaggcttctgggcgagtgtccttatgtacttatcttctcatttagccaaggtatgcttatgggtccgtgctttgtatggagccctgttttaggcactgagagtacaccagtgattaagaccaaaaacaccactgccattatggaatttacattccaatctcagtccagacagggagcaaagtggagggacttctgccatctagctctccgtggcccacagggaatgggcttggtccattggcatcgatcacaggagaatgtttctagggaaaacgaacccatctttcaacctcattgtaagccagaagtgtttcgtttaaacaggaaggtaacgtcctcaccatgtgcgaatgcctggctggtgagctgccagcccagggtgctatcagaggctataattaccattgtttctctctgcctaattaaaggtggtgttagtgacctggttaaggaatctttttcaaagacttcttttgccttgacagcatcccttgaaatgtagcacacactgccaaacagaatgggagtcaccctgcggaagacccagccacttcccagagggactcaaggctgtgccctgggtctggtttagaacagaattaatttcagcctggaagtcagaaaggggtacttttggaagaattccatgttagaacttccaccgccattataagcccttgaatatggtatctttctttccccttttccaacacaccccattcaagtaatatttcacagatcaaaagagggagggccatccagtccctccacctgaacagatggaaaatgcaagagttcagactcccattcctgacatttccaaacaggaaggtgtcccaagtgtgggacttctccctggctttgtcaggtgtgctctccttttgatgtggaaggccaggctccgcagttttctttagggaacgccatctgtacttcaaacaccctgacatctgaggccaactgctcccaacctcccttcgatgtgggtgatgggatgggagcctttcacaccgtagaattccctttgctgtctgcaaagagaggtggagcaggggaggtaaagatgttaggtattttcactccttctcagaaagaacttcagtaatcatgcaatccaaactccttattcactgacatggcaccaaaaaaagctcagagagaggtactgtgacttgccaaaagtcttacaaacaatttgtagcagagcaggcccaataataacaatgaacattaccaaactcttaccctgtgccgtgtattctaataaagacgtctcaggcattacctacctttgccttcacaacaaaaccatgctatgaaataagtattgttattttccccattttacagatgggaaaactgaggcacagggaaataatgatgaaatgatagaaccaggaatcagatagaggcagtaggacccagagcccacattctcagccccaacactctcccattcctgagctgagtctcttacaggttggctctctgtggttgccactttctcagaagtataaaggctttcccagtttggaacaaggccagcatcaccactctctctaggagaatgttccagctgggaattcagtgtaagtcatcatctttcgggcattttccatggtctccattagatccacttgtgtagcactggcaactttgaggtccatgtaccctggacaagaatattttctcaaacatccccactatgaggccattttttcagtttttgttttgtgtatatgtaagtgaggtcgagggaaataagaatctttggtcattgggctggcactttctggggaggtaaacgttccaaattaagctgtagatgtcaactggagcccctgcaggaggatccacccttggggccacgaggactattgaacgcggagagcgcaccaccttctgtttgaagcgtccgcgtccaaacgggacaccaggctctgctggtcgtctggctcaatccctgtagctagacccactctggcttcctagactcagtttctccagtgaacaggggccaaaccaaaaatcactttttccctgcagacttttttcatgttctgtgtttaatctacaattaagagcccccagccagaggccccatgtccaagcagtgaggcaatctgcagacctcatctaagtttggtctcagtcatggctcttttccctgagaggacaatctggaaagacattgaaataacccctgttagctggatccagcagcagtaggatgaggtcctgggagggatgtggggttgggcttctgttttggaccaaaaaatccacatttggaaagctaaccatatgattaagagtcttacctcactttgagggaatagtcatagcatgcaaatgtttacaatgtccttaaaacatttgcatttacttcttgtattcaggatttaatgtgaccaccacagaaagtgatttagattcctggtgactctttgaatcttgagttgggttagtaatggatatgtctatctacatttggctttctaaatgagctccttaggtactatttgcttggctttctgtcactttgcttgaaattcacactgattctcacctcaaacaaaattaacagctggcttcaaaatctgtagtaacttactcacctttttttcaggcgagatagcttttatttgcatgttccctggacaaagaagccatttggaaatgccttgggtgtagctgctggtgggggtattaacactttgacaacatcaatgccgcaaatggggacattctgccacttggttttgatagccccgtggcttgcagccactagagaaaggtctaaaagctatgtttacactcagcgtccaataccagctaaaaccccaggatgcatcctgggaaagtggtcccatcatatgctctttggattctggcagcatattttcatgtgtgactgactctgagggcccctctttctccaaaagatggagatgacaggataacagagcaggcggagcaactcaaacagtgaggtcaagtcagactctctcctctttgctgaatatttagcctgtggcacctgtgtctcccaggtgaagggagatgtcagctggtgatcatttctcagatggctgtcaggtcatgctttgcccttaggatgctggttaaggacacagaagcccaggcagctcctgacactgacataagttgaccgttgtgtcttggctccacagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatgtaagtgcacctgtctgacacccccaacaactgtcgccggagaattcagctccctgtcccagcccatcacccactaggccatcagcgtgtggggctgctggagctgaccattaaaaacactcaggaatctctttgctgtccttccacactttcccagctatgatagcttggtggtcaagagcatagactcgagatcagaatcagcaagctatagcctagggccaggggttcccactgcctatttttgtaaatgtttttgaatacctccacatccatttatatgtgtcctgcctgtggctggtctcatatggcagtattgagcagctgtcacagaagactgcatggcccacaaggcctaaaaagtatgttctctctggcctgtcccaatgagtttgcaaactccccttagagtcacgctgtatttgtatcctggccataccgtttactagctgtgtgacttcaggtaaaataatgtctccttcatcctttgttttctcacctatattaatgtgacaattatagtatgacacctcagtgggtcattgtgaaaactaaatgtaatactacacgtggagcccttcatacagtcctcagcacatgggcaggtactctgtaaaatagtggtggaagtggtgggacgtaaacaaatgattcactcatttcttagctaccattatctgagagggggactgagctcttaattatctcagatctgatttttgtcctctagattagatcatttttaggtaatgacacaagatggtgtttgtctctgtgtatacatgaatgtcaaaaattccagtaaaatgtgtttgtccacatagttcggtctagtccactctcccctcatacattagaaaatggccagtatctcattctaaaatgagtagagggccagtcaacactgacctcaagattattctttaaatagcgacagttgttttcatttttttgccttcacctttagttggcttgattaaaaagatcattatatggagcccttctactgagaacatcattaggtaaaatccctccaaataaaagatacatattccccttgcctttctgctttgtcgtaatctcccccctttcttctttcctcctcttcctcctcctcctcttccccctcctccccttccctgtgtgtgcccttctgttcccaatgcattccaattgatgaccattgactccttcattcattcttgtattcattcagtaaacatctgttgtgagcccactattttcctgtcattgttctgtgcttggaaagacagaaacaaacaaaacagacacatttctgcctgtatgacacttgccttctagtgatggaggggataaacaagcaacaaagtaaagtaagttagataacatgtcagaaggtagattctgtggagaaaaataaaataagaaaaggacatgaaataagcgagagaaccaaatggctatctggaggaagagtattataggttgagggaatcgcatgtgcaaaggccctgacgctggagtgggcctgatgctccagaaggccagtgtggctggagtagagtagacaaaagggatggtaacaggggatgagatcagagaggtaaggaggggccgcatcctgggacgttttaaagactttggctttaccttgattgaaacgggaagaagcatacgacttaccacagtggagtggagacttcgcttcttctttcttcacctactttgccagcttttctttaattcctttacagtcccattttccagccatagtagacacaacccatgcctccgcaccctctggcaggcaggagctggttagtaaagagtcctttctgcctgccctctccgccttctgcggccctccaccttcctttccacaaatactgacaattcattcccttagggttttaatgcacctctccttcagtccctgtggtccagtgctctagctttagagagcgctccctctacggaatctacttagtcctcacctacttctcctgctcctcctacggccttccaacatactatctaatttactttaaatatctccctccttccatcattcctcctatttcctatccttgctctctttcctttttgcactgtttccctttcatctttttttttttttttttttttttttttttgagaaagagtttcactcttctcacccaggctggagtacaatgacacaatcttggctcactgcaacctctgcctcctgggttcaagcgattctcctgcctcagcctcccaaagtagctgggattataggtgcctgccaccacacccagcaaatttttttgtacttttagtagagacggggttttatcatgttggccaggctggtcttgaactcctgacctcaggtgatccacccgcctcggcctcctaaagttctgggattacaggtatgagccaccgtgcccgccctccccttcatcattttctccctcccttgatgcatttctccccttctctcccttgccctacccatggtcttcccacttctcttccccactctgcccacctctttctccacccagttaaccttcacttcccttccctcaacatccagccacagtgagcctctggccctcccacagtggatgttcaagacagaattcctgccagccctcatctcatttcagattcctatggatcgttcctttccttccctgccctaccttattcttttctccttccatctgccaggtttttttctctttggcagccatagaccgtccctcggctaggttcccaaactgcagtctgatgaaagagtccagtccaggtagccaggctgtagccagtgagcccaccccagccctgattgaggggctctgggcctgccaccccccttccacttcacatctctatactctcagtttggacctcgtggatacacagctcagctctccaggagacagaaattgcagataacaacatcagaggtgggctctgtgcaggccagaccatacctgaaaggttggactcacacctggatgtgttgaattttaaaagcaacattgacaagctagaacagtaattgccaaaagcctgtctattacgactgagtttttctctgatatcaggtaaagtgagaaaaacaagaacaatgtgatatttttctattgagcaaaaatattcagtttaaaggagcatcctttcagtttttggacttccttattttgttatcatcgtttttaaaaatgtcttttattttataaaatgatagccactgaagacagagtagtctctgtgtgttatctatgtgtaattattgtataattatactttatgtgtattgtatagtagatacacacagattgccataattggcaaaataaaaggtcttgtcaccaccttgtctttgaaatccaaaagtctgagaatgatcatcctagctagagtgtttccagaaataaggagatacaaacaaccaagaggttaagagtatagactgtggatcccagcagacatacattccagctttggctctgccttgtagccatgggcagataacttttctgagccttggtttcctcagttgcaaaacgcagaggctaatggcacctccttactggttcttatgaaagttaggtgaacgaatatagtaaaatgcttagcattgtgtctggtccgtaggatatactatattaacaatgcttgttgttagttcatactggcaactactacaactatcaccacgacctttattaggatgatgacaatggttagaaaccacatcctaggagctggagctacctacacaaaagatccctccgtaaacataggtcagttctttgaagggttatggttgagagaataggttctggaactaggctagccacttgcattatgacttgaacctgggagtagctcatcttcatgcaaatgtattcatatatgtaaataagactgcccctgcgtattgggcacccacggtctaccagatggattgccgaggacttttcttgctgtgcttgcctcctcctcctctgtgataaaatgaaactgaaaaattaaagcagaggcggcaagtttctatggctggatagggcagttcgagaggtgacatgtaagagagaacttgagagcaggttggaggggggatcctgcttcttccatgtacctggggacctgtgtgatggcctaaaagtcttctaccatgtgagaggtcagcagatgggtgggaagatgagaaaaaagggagcagagagttgaaacagcaggatgcaccccaggatgaataggagttatctgatttatcattccaaagacatccaaatgtcttttttttttttttttcttattgagaattccactccttgtccatggccacccatataatccagatttgtactttctccttaggaatgcttggtactgtgttaagctctccactccctattctcaatccttagctactagtgattctcttaaattgccttaaccttgggtggggctctgcactccccaactttaggggaaggggagggggttgcctatctctcatgcaaaacagtctcgcagactctcttcagtgttttccaaagccaaagcagctcagaggagtgtgtgctggtgtccccgaataccagagcccattcctctaaaaatagttttcttccagagaacccacagtgagatgatgattcactgcagattttcttcgaagctgagctcccaccgatggcaccgttctcactgcaccctgtcggttctctgaaccagctctggcttccagcaggttttgattatgggaagccccagagacccacatgttcatctgctctgtggtcttcagacgccctcatgagtcttcaaaagctctggagggaccatctgtctttagagtcccatcttcttccacttttgctctgtatctccccatggtggtatcccgtgtctcgtatcttctgctatggaagctaaatgtcttccatgaagaagggctatggacaggcttccgtgtccagtcacaagtgagagcatctggcaggggaaatagccccagttttcaccctgcctccccttaaccacagtgtctctctgagatagggaggcagccacttaacaatagcaaatattccattcttaccagccaccagggggtttaaaagacacacagaattaaaaacacaacaaaacaaaccagcaaacagaaccagagagctggaatgttctagaaatcatggacatcagtgactcttggattttctgagagcaccaggtttccatgtaagggactgtcacatggaaggaggggtgatagggtgggatgggagcaggtggtacgaaggagaagctgatcagacagagtgactgggaacagagcattgggatccacacttgggggttcgaatccttgttctgcctcttactttaagcacattccttaacatcttcatgcctcattcagttccccactttgcctaaagggggtcatcatacctacctagaaatctcccgtgaagattaaataacataacatggagaactgtttggaagctactaaaaagaatgtaaaaagcaaaaacatctgcacatgtatatgtgtgtgtcatcacagaacgatttagtctcaagttcccatgcaattcttcatccattttgttctaagacaaaaaaataatttcctctgtggcatctgagcacatgcacagaataagcaaagcaaatctggctctgtgctgtgtctgtacctctgctttctgtaggcaataccaggtgtctacacacagcacaggttgggaatggcttttctcagatatgcctacattcctcatcttctctatggatcaaacatgtaaactggatgggagagtctaatacactttacctttctttctttctttcttttttttgagacagaattttgctctcattgcccaggctagagtgcaatggtgtgatcttggctcactgcaacctccgcctcccaggttcaagtgattctcctatctcagcctcccaagtagctgggattacagacacccaccaccatgcccagctaatttttttgtatttttagtagagatgggtttcaccgtgttggccaggctggtctcaaactcctgacctcaggtgatccaaccgcctcagcctcccaaagtgctgggattacaggcgtgagccactgcgcccagccaacagtctacctttctgaagaaccatgaggaccaatggtaaagaaagagagaggccagaaagggactgccccagaaggtgggcccagagcataaccttgaaaggaaccttcctttttagccttcttccagcatagggaagcatcaggaactgaacctttggggtctaagttgtctggtccaaccaactagcccaggatgacttaaaggaagaataaacatggggcttccttccttcagcgtgatctggacatcctaacaagagttcccaagtcaaggaaggctgagagagatgggaaagagttaagaaaccacaaaagtggcttctgggtgggaggcaggatagcctaagggttaagaacacagggacttcaaccagaccaacctggattcaaattcaggctccaccattcactagctacctgaccttaggaaaattgacctcttcgtaccattatttcctcatctgtaaaatgagtacattaataatactacttggttcatagtactgttgaaaaaaataatttgagccagtgtgcaaggaagacagtgtctgacatatcaaaagccctcaataaatggtaaatgttcatattatcaccaccaccaccaccaccaatgtttccacacactccaggaccttttaaccaggtgacttgcagacatgcccctgtgccggccgtgcccctgccaggctccctggcatcatgttgacttctgtattgctagaaatatattgtgtttagtcacatgtttgcaaatgacagatcattaaggaagcatctgaggaactagggcaaatcaatacagagcacaaatggctgaaatccccatcagatgttcccattgtttttgctggtgcgggaagacactcagatgtttgatttgtatgtttgtttttatgctagttctattaaatcagtttgcagcctgaagagtgtttgccagacaaagaaagacacatgtgccagttaagagagacctaaatcagctgttggcttcagacacatccctaaatgtgacagtttttgctgatgcaaatgcttctttttgtcctttccattgagcttttcacactaggagtctggacctttgcatccttgttctaggttgcaggactaggctaagtgcaaagacttccaggagtacctgctgcacagagactgcatgtgaacctgcacacatgtgtgcacactttccaaccttgcttgcatgacaaaggggccattttccctgtggatgagctggaaaggactaagaaaatgaaggcccttcagctccaaatggcattcagcaaagcctggtgattgagagtctgggctttgaagtcagatgaacttggctttgagacccagctcaacctctccctgactttgtgaatttgggcaagtgacttaatctctctgagcctcaattttctcatgtttaatgtggaggtggtaataactaataagatctgactcatagaatgtgactattaagtcagacagaccatgtgaaactctcagcctggtgcctaacaactaagcacctgatccatcatagctcttggtggtagtggtggttatggttatccctcccctttcctttactttacattgaaggtacacaaactgttcgcaaccacgctcccactgcagacaaattcctgctgcctcctggggcagggttgaccctcatcatgcaatggccttggcactccaggaggggctgggtgttcagccagtgcccaaaacagcctgagaagctgagtaactgcagacaagaatgaaacccaggccaggcgtggtggctcacacctgtcatctcagcactttgggatgctgaggcaggaggattgcttgaagccaggagtttgagataagcctggccaacatagtgagacccctctctctacaaaaatagaagttaaaaattagccaggcatggtaatatgggcctgtggtcctagctactcaggaagctgaggtgggaggatcacttgagcccaggcgttcaaggttgcagtgagtcatgatcacaccactgcactctagcctgggtgacagagcaagactctgtctcttaaaaaaaaaaaaaaaagaagaagaagaagaaaagaaaaccaaaagccagagtgagcaagtgtgaggggtgcaggatgcagagcaagatctctgccaggcttaacaggctaagcctggaattcttttttcttcgtttggaagccacacctttgtactccatttatatgtcttatgtgtattcacatctatatttcatcttctctgggctcctgcagcttttccctgaatacctacttccacagagactgcatgacgtctctgtgtgtgagccctggggtcctaatcccttaaactgttctgtgactttgagaaagtccccttcagttcctccattttcacaaatatatagaggcagcatatccaatggatagaaacagagatatcagttctgcccgttcctggccctgtcactttggacaagctatttgattcctctaggttttcttttcctcatctgcaaaatggggccaatatggtttacctcacaagtggaaggattaaaagagataatagacatagtcaattagaccccataaatgatggctcttgatgtttattatggtagcaataaaatttggttctgtgatgctcttgggctggtctctctcatcagattctcagactccttggggccagcgtcacatcatgttccttgattagtctctccctcaattcttgcacccatcattaagatggagggtaattgattaggaactgcatagagagcccacagacctcacacccagtgctagcctgacttgcataggctcattggcctgcagttgggagcagtggatcctcttgcaaaaactgaggggattgccgttgttacagacagtggctttccctggaggcatcatccagctgaaatctcttgccacagtggcaggtgaatgacgggattcctggagagcacgcaccacctgactggcagccccagagatccatggagctgctgccttggctaagaaatctctgctgaactctatgctcagctggaaaatgagcatgtccttggaacttctcaggcaaggcaggctgcctcaagtctgctgtctctgtgggtggctgtatccagtagcccacagtctctgagaccctatggtaagcttttgtggctctctgtgagcaggctagccaggcctgtgactgtgctcccggtaaagtgcactccccgcccccctccagcagggtacaaaggcattgttaatagatcgtggcagtctcatttgtagactctattcatccggcagccaagaatgatatgtcctgatactccctctctcctctcacccgcctttcccctttctccctgctttcccccttccttttgcctggagagtgatttgtctgtgttatgggttggcctgacaaaccattccacattagcagctgagatgttgtttgaaatgggaaaattgctggcaaactgctccattagcagttccagtaacaaatattctgttcccccaatgaagatgagatcacagaggcacaaattaatacgactgtctcccccactctacagcggggattactcttcaagatgaatgggttcatcccagccagaaatgtgcatccactagctgtaggcttcaaggaagcccgttcctcccatctaccccttttgctcccactacgtcccctgccacacacacttttttgtgtgtcttcccagctgagggtttggggagcatcaaggccaaatgaggggtgatgaaaagacctgcacctcggagagaagggagatggatgaggatgagatcctgagcctgggccagggtgccattcatcaccccgaatagagcgccccacctcccccacatgcctgtttcccaccacacctgttcttggtgacaggaagtcatttgagagatgaaagaataaagaatggaaatgctcactcattccccacggccccttctcttccaaggaagttctgggccctgggcctgcagcgtctcttgttgctttcaaagtaataggagaggaagcatttcaggaaactccataagaggttaaaggcacagattccagcagcagacccggggagtggtccagtctgggcccctgggccttgcaggatgtcagggagccagtttgatgaatgtcaggctgggagcctaaagacgttaaggctgttcctgcactgtattaaaacagcccatggaaaagctcagaaatgaagtcaaccattgacatttctgccccattagcagtgtggctgactgtttaactgagtagtgacatggttccatgacagataagcattgctggcccatggtccatctctttttactcttccttctctttatccctttgacttattccgcattctgcttggttacttctacagctttctctgaagaagacagctgctgccaaaagcagtttataataatcaagaatcaaaaatcttcaaggaaagatcatcctttccctctttctccaaggagagttagacccttggacaggtgctccatgtactaggacctgagttctctgactgctgcagtgttttgtctggtctgccacaaccagaccgtgcacctgtgacaaaaaagacctccctgtccttaaggccagagaacacagtagccctcagtgaccacttgttgacaggtggatggttaattcactcttctctgctctgtttcccagacgcctagaacagaactccatcaaagccatccctgcaggagccttcacccagtacaagaaactgaagcgaatgtgagtttcccctgtggagaaatgggcccaaatgttttcaatttccagggttgtttgcaatgtgtagtgggcaacctgtccaggtgacggaccatgtccattcctcctgggcagttctgtttcagacctggaacgctgtcctaagcttgggaggtaagatgtggaagtgttgcctgaagattgtgaggtgtgtgggcttggacatgtagcgctaagagcctctccaactaaagcaaagtaaaactatctgtgtgggaggtagagacgaattagcctggaaaatccatttcaccatttatactgtcccttggctccagtgatgtggacctaaaataggagtttcagcagagatgtgatggtggccccgcagctgtctacaccactgtcaccaacatccctccaaccaggcatacattcatataacaaataccaagtgaatgtctgctgcaagcaaggatctatggatagagcagtgaacagaaaccaagtctgctctcacggagcttgcattcgagtgggagaacgcagaaaataaagaaacaaatatcagaaatcagagtatcagtgatggtgggagggtgtcttttaggtaggtgtgcctatgaaggtctctatgtgcaggtggcctaaagaaaggaaggaagggagccctgagctctcaggaaagactgtcccaggcagcaggaaaagcaagtgaaaggccttagggagcatgtgtcgatggtttgtggaatagcaaagagtggaacaagtgaggggagaggatggggcttgtgttggaaaagttggtactagatcacatgcatcctttaccgtggtacagactttctgttcttcctgcatgaaatgagaagcctcggagggtatggtcaacatgtgagcaccccctacatccccattagctctgtaagtcacaccactccaccactgcattacatcagtgccgggtgataccaaccctgctgttcctccctcaccacagcagcctggacggcaccattgcatcaccgccctcatccccaccatgtgacaatgtcatcattcttccccatcccatgacgaccttgagcactgctctgtgagtcactcagagctgggggctctgcagggaggacagtaggattcagaaacagcccaaccattgccatcagttctgcacagatactccttccctttttgaggctaagaaatcatttagtagagcccagtaaccgagttgctgttttcattccacttactcttttcacatccccccacacctcaccctcccacagaggaaagagagagtcaggtagaaatatgcatggactcggtcctgcttcttccttccacacgaggctgattcattgctttccctcgagtgggagggcccacagtaaagaggttaagtgtctgctgattccttttatgttaaaaataaatatccctgcgaaacagtggcattggtaggctttaccctcagatcttgggaagccaacttcccatctccctggaaatccaaaccaaacaagcttttcttctggtgcaattccagaagtggaaaccaacataatgaggcagctcgaagcacgtacttcttccctcctcttggcagcattcctgctggaggagctgtataaatataggccttaatatttaaaacctcgggccattaatctcctggtgtccctgcttccccagcccgctctccatgcatccccccccccaattcatttttaaagctcagcttgattatgcagccagatagtaatttcagtgaaaaatgacaagttcagtcactgccccaacctatatctcctacatgatttaagttattgctctaattttttgtgaagtccaggtaatttaaagcttgactatgttttactgttccttctccaacctattggacttgccatgatctgtgcattcaaaattcataagaccttctcagtcacgacctggaaagtgaatttaatttttgatcacttatgatgctactgatatttattatgatgccctttttttcccccaagaggatggcaatagagaagagagcacacttaaaaatgttcgactaatggaacttcagaaacctagactgaagtgcaatcaatggtttgggagaggtagggtccctggtgagaatggatttcaaaaccctaatttttcctaaatatacgtgaccagtttatccctaatatctaacaggaggaagtttccccctcaactgtgactgaaccacatcctgctcttgtctcttaccaaaaaagaaaagaaaaaaggggaggggggagagaaaaaaaagaattctctctgaatgaatggctttgtctctgcctattcctagtggttaccttcgtataaaaaacattccaagtacaaactaaaaggttgagtattccttatccaaaatgcttggggccaaaaacatttcagcgttctgaatttttcaaagtttggaatattttcacatacataatgagatatcttgagaatggaatccaagtctaaatatgaaactcatttatgtttcatatatacctcacacacataggctgaaggtaatttatacaaagtttttaataattttgtgcatgatatgaagttttgactgcaatccatcagtcacatgaggtcaggtgtggaattttccacttgtgacgtcatgtcagtgctcagaaagtttcagattttggagcatttcagattttggatttttggattagggatactcaacctgtatcaaagcagagaagcagtagaaagcactggagacagcccctcggtcttgcaaatttggttaactgactggtaggcctgacacctgggctatctattattgtgccagaatggggtgttgggaattcttttctctttcatgctcttaggcagagcaactcattccacaagctccaggacttcctaatatctcacacttatattccctgcatgacctttgtaggcacttgaatttgccacctctattctgaacagtctggaaaagctaccccttcttggtcatccagtttataagccccagaggaccaacgtgggtctgagaccattttctaaaacattgcggcctgaagtatatgacctagggaccacctacatggaatcacctggagatgtgttacatatacagattcgtagccccaacccccagcctacaaatcagacactctggagtgcatttttaatctacaccctcgtgaggtttgagaagcactggtcaagagtcatcccagtgcccagaatcagttctaggagcagctgctgtggctagggacagggtcatgcatggaggtcagtgggcagctggagccatctcccatctgccttccagctcaatgccctgcattgtgcctccatcacaacaaaatagcagagggggccttgagctgataggagacttgagatgcttgctctgtgcccaaatggctgtgtccagtcacttatggctccaggtacttcacctctcagggctgctgtttccttcttgcagaattaagaattaagacgcagtttgccaaatgttctcacttatacatggaatctaaacaaagccaaactcttagaagcagaaagtagaatggtgatgttcagaggccggtggggtgagggtggggtagagatgaagatgacacagatgttcgtcaaagggtgcaaaatttcaggtagacaggagaagtaagttcaagagatccattgtgttatacaacacggtgaatgtagttaacaacaatgtatcgtatacttgaaaatagctcagagagtagattttaagtgttcttaccacaaataaatgataagcatgtgaggtaatgcataggttaagtagcttgacttagctattccacaatgaaagcatatatcaaaacattgtgttgcacaccaaatatgtatacatttttaaaagactagttgagtacagtagtgaaaaaggaggaaagagtagaacaaggagtttgatctgtaactgactgtgaacaatccattgagagaactcactacctttgaaccagcctaaatatgcagtttttataataataaagaaaaagacaaagtgaccaaggtcaattcccagctaaactgtctatcacttctccaattcccactctccagcacctccaaaccgtggggcatctcacctcatactgtagggagagatgggtccagaagtctagttgtggactgaaaaccagtttgccctcccagagctaaagcagagggtttccgtgctggccacatagcttcctcttgcaactagaggtctcagcaccttgaagggacaattcataatcaggggaaaaaaagacaacacaggccttcccgctagtccagtctaaacagatccttcgtgtttgtctggaatgctttgcataggcagccatgctgagggcaagtgagattaggataatccagagtatttgcttgttaagacccttaaacaaaaccggagcgcggaagaaaagcccggtgtaagctgacgagtttgtgagtgcaatctgcggatttgtcggaggtgatttcgccagctaaagggataaactagacagctgtgccgaagagccttaacctgtgaaatatcgttcaaagtacaggctttggaggcagggaggggaggaagtagaggcctcagcaaaggttgtggcatggttcttttgaaatctattagaagaaggaaggaaacaggctcagagagattcccactgcatgtgcttaagaggctggagtgtctggcttcgctggagtcaattgcttaagaatctgctctgttgtgcttttttttctccacattctctcttcacctccttgttgaccttccaagatcccagctctcccacttctgcacaaaagcaaagacccatttatttattttgttaaagaaaaggaactggagaggtttgatgtcgcaggaaattggagcatctctccttccagtgacaggatcccagaggccatccctgagctaatgactctaagagaaagaatttcccctcagtgaagggccattagcaagagctggtgtccaggttctcagaagtcactgggatgcccgtaattgagcagcctcagggcctctgggaaggagccagggtcgaggagattcctttgcacctgcaaagcctggttagctgccccagaccccgggcccagcattaatagaatcctcctggcccacagcatccctcttgctctcattatccaaagcctgggacattcttatgccctggacttgctcccagatgaggaacacactgccagccagtgacaagcccacatctccaaggcgtcccctgagaatcccaggatgtgcttacatcacacagcctagagtttgcaccagaccagacagagacttaagtcactgctcaaaagctcctttcaggtcagggaggaaaagtcactggggaggtgaaatgactctggactttctgggagaaaaatgagcagctgctgaggcatgaggcaagaagatgatgcctacaggaaccctggcttgtggttggttgggtgaagccggttcctgtttcatctgtgtcgttaattgcttggtaatgaaacgtaaggccctaatttgactgggctcaattttccacctacaaagtgatggttcacgtgttcacagcctcgtgtcccgatgaagatgccacgggtgagtattctttgaaaaccaagaagagtgatgtaaatgtggtgcactttatcatgaggtagttgaactgaaggctctttaagctccttctcttgcactatgagtaaatgaattgcttgattgattgattaatccttaccattttgaatgtctgaaatgcttgattcacacttaggagtgaccgttatcgcacctttgagccatgttctcagactttaccgttaacgttttcagagacatcagcaagaatcagatatcggatattgctccagatgccttccagggcctgaaatcactcacatcgctgtaagtggggcccgagttggggcctgaggtgaggggagggggggcgctggagggaagagagacgcaaccatatttctcaggaggtgtttatcaagactttatgttcccttacacacttgtggcaacctggtaaaagaaacaaatatttcttcaggggaaattgatcttggggaatatttctacaacccaaatgcattatttttattgattaagcgcctggcagctttcccagttattggcttctaattcgaatgcatcttctactccaacctcacgtccccctcccaccccacgtccccctcccaccccacatgccaccgcagcgctatctttctggtgtaaggagagatggtgatgcgtgtttattaccgcttggccttgccaagggaagagctcgttttcttctgctgattttcaggctttctctccagaccaccctcatggccattgtcctaagaaaacatccaccccatcctatagcccttcctgtctttgattttgaaacccataggcagcccactggttggaaccaaagcttcacccaccaggggttccaagacccctgccggcaggaaggtatagaatgtcctcattctgtcagtcactcatgtgtggcatagggaagtcacttgagccttttatggatgcttcttagtaggcaggatggggacagtgatcccattccctcctaacacatccaatgatgatcacgtgtacagtaaaacagtaattagtagtgtttactgagcattgactgggtaccaggtactgttctaggagtctgtcaagtttagtcctcaccacaacctaaaatataaaatatattgtcatctcatttttacagctgaagaactcagacaatctaagctccaccgagacagggattattatctgttttgttcacggatgtatccctagtaccacaaactgtgtttggcacagagttagtatgtcaaaaaaaaatcttgttttgttcaaccatttacttactctaaaatgtaacttatccaaagtccacagtaacaggtagaaaaggcaagatttgaacccatgctgtctggctccagaacccacactcttgatcagtctgtctatattttgcctctccgtgcagctatgcaacctgtttacctaatttgagtgggcaggtaaccagatgcacatattccccccacctggccccatcccaccgggaaggggatgaggactgggaagtctcagattcagctgttgcctgctgcttgcagagtaaattagtttcatttatcgaatagaacatctggctgggatatcaaagatgggaccatgtgtgagattagtgtctgcttgtgctgaagatcacagaggagaagggagaggagccgtctgccaccaggaacctttctctgcccccaccctctctcttcccttgtctggtttccctcagccaggatttggagacagtctgagggcagtgaggtgcttcctgtctcgtaggaaaaggaattcaaaatctagttgccaaacatgaaattggcatgctgctgcccgattctgaaatatatgtgagcattgtttaagtgaagcacctctcactcccgatttattcattcattcatgcagtagatgcctactgtgtactggcagtattataggcactgcgagtgtggcagtgaactgtacacacaggatccttggcctgacagagcttacagttgaacacaagcacacacaatcccagctcaggagaagccaaggtaaagggctggagagcctttaccccttacctgtgcgtgcattcattcattcaacaaatatttatcgtgctagactcttctattttggggtctagagacccagtcatgaacagccatgtaacgttactacactcatggggcctacatgcaagggagctgggaggtgcgggggagggaggcagaaaaaattaaaattaaatacatatttaagcaacataatgtgacataaagataagcgatatgaagaaactaaaatagggtaacaggtgatataaaacattaactaaaatattaaagagacacctcccaaggaagagatgtttgagctcagacctgaaaggcaagaagaaggtagtcaagccaagacctggggtgggaagccagacaggggtacacccagatgcctgaggagaccacacaggcaggagagcctcagcccgcctccacctgccagggagtggttttgacgcactgggctcagaagcctgctatcccaaggcatggcgggtggtgtgaggacccctcttgccccaagccccgtggcttctgctacactagaagtcctgacatcagctgacacgggcagacagtgacattactgcatttggcacagtgagcggtggggcattaatatgaattacaaatgtgtgcctgagctatcatgctgacttttatttagtcattaatttgttgaaacattaatgaaacacacccgtaggctgatggagacattcactcttcactcccagtggcgtctggaaaaggggggtttggtttatcatgcccatttaccatttccgcatcctaatattttgtctcctcaaagaaggattacagcctggattgcgatccgagtgaaaattgaatattgcatgcattcagtgcacttcagggctctggagaggacttaagaaaaacaaccaaactctcctacgatcagttccctgggtcacagaggaggctggacccaagagacagcaaagcccgtgctgtggttgggagcagagagaggccagccgagcttctctagtgcctttgaagagcaccagcaagggccaggcataaagacgcccctgagcactgtgctggagtgggagacccagtagccttcctccccaggcctcaccaagacaccaaagatgaggcccatgaatcagagacaccagtatgagggtcactggaggcccgtaagagaaaggggtaaaagggttctgagttcctgcgttcctggaactcaaagaataggaaaagcggatagaaagtaaaagctgccattactgtgagacagcaaagctccctggtttttcccgagagccagtccttgactcagcagtccctgcaccatctggagatgaccccagatgcacaaagccctgtctagatggatgattaaatgactcagcttaggaattcctaagatgcaaagggatattaaaaggaaacgtcctgtaggctgggctcaagctgatcaatacccattgaagacacagggccagtctcccacacagtgtatttattgctggggtgtgagtcatattagcagcttagggagataccacaaagagaccgcttcttcctgttggggattatgtattgggctaggttgcccaggaatggagcaggatagagcccatttctactcacctcccagacaacctgcccttccagcccctggctgctcttggctgcctctgtctcgctgatgagaagggattaggcaggccgtggaaggggttgtcctgagatctcatacccagaactggccgaggtgatggcttcctgcaggactgggttctggtggcctcacatccacagtgattgctgtcttctccttctctctttcagggtcctgtatgggaacaagatcaccgagattgtcaagggactgtttgatgggctggtgtccctacagctgctgtgagtaggaactttgtcactgttggtgtctttggtactgtcggaaggctcccacctgaaaacgttgagccatgctctggagagttcttttgactttctgcagacaaaagagaaaaaaatgtttgagctgtccacgcttcacctccgtttcctatttttatgaaaggagagtcagcgagcgggcagaggaagaccgaggtcagtgtgcataaacccaaatgatacagccgagggccctggcccaggcatgaagatactaagcacagggtctggggatagagattaggaaagagtcaaatccaacaaaaagaaaaacatttttcagtagtgtgctaagaatgtaaggaactaaaacatccacacaccaaattccagtactaaagctgagacacagctgctgatggacatgtgaccttgaagaggggtcggggcagagggaataattcgagaggagcataatcagtcaccagtgtgaatccatctgggaaagacagggtggagaggagtgtttacttaatttaaaggaagggttgttgcttcgaattttaagctcagggattatttgtttgcatttatttcattctggtcatttgagcttaaatgtttgaagaagataattgaactctgatgtggagaaggaaggaaaagaatttagctcatagtatagtttaatttttgtgctggtaaaatcatctctgatttgtgacaaggcagctatagcatctacacacatgtactatgggtgtgggagtgtgtgtgtgtgtgtgtgcatgcatgtgcacatttgctctgtcaccattacagttcttctggatgttaggaactgatcttgagtatcctttaagcagtggagaagaccaagtctcggagagatacatgactctcccccagtcacacagcagaataggtatggaaactggaaaagaatctacatggccatgcccttcattcagaaacctcccagccctctgaatagcacatgatgtatgtttgcagaggtgtgcaggtgtgtgtgtgcgtgtgtgtgtgtgtgtgtgtctttttaaaatcacctccaagtcacaggcagtgaggaagaggcctggcacctccccacctcctacgtaaagttcagaggacccacagcatgggtttgtgggccaggactcaagctggggctctaaaggggtggcaggcacaagagcaaagaaggagagaggaacaagggacacatcttatgtggttgatgcccaggaactcttcaagaaagaggaagtgagacttttcctccagccctttcttacatctttcctctacccttcccatgtcctttaagactcagctctggacagattctcccagaacacgcactaatgtgaattatgtaggcgtgcgatgcccagcaagtttccagggagcagatctatcataccagcaaccaggtttgtttcagtgaagctgaaagcaagagagagaaaagtctctctttctctgcatctcccccatctctgtcttcctgtctgccccactctgtgtgtgtctgtgtgggcaaattcctgttcaacggtcccagcctttggtgggcttttaaggctatgtgttagaatgacaggccagggctctgcagggagctgggtgtttcacagatggtattctttgcttgtagcaaagaaactgtgcattataactgccaccataaggctagttaactgtagctattaatcccttgaaagaagagtatcaatagtatccaccttgaggtggatttggcagtgttgtgttccaccaagctggtgtgattttccttttataatctgtgtgtgtgtgtgtgcaggaaggaaaatggctttgcacacattaaggatacacagaatgtgtatcacagtgcctagcacagtgcatgtatacttaaaaagatgtgtatctcagctccaagctaatagcagccatgaggttaatagaaccaacaggactttgcatgggtcgcgaaggcaactccagtttactgtcaccattttgagcagatggaatcgagtagcttggggtaaagaggaagcaactctcctctcttgagaccaagagttgacacaactcaggcaggccttaccagaaagaaccagtaactgggactcaagtagctgtcattgggttttgacctgccattgagtggttggaaagcaggccctgattcgatctaatttagtgttcagcctgctgtagattggacttctccctgttagactggagacactgataagaaggctctgattagaatactctggtagtctgagttattttctctcctttgactcagagtctctttgtgagaggattgcattttttcttctcattccatctctcaaattatgggtactcgcaaagctgaactgcctctgccacacgaagtggccctggacatttcctttctagcacttgctgtgatgctggcggtaataaagtgggtacattgtagttggttctcctgcctgcctcccatcttcccccactcctctggactttttggccatcctatcaaacttgcccagtccagtatgtacacagccagcctcctgggagcttttctcggtgtgttcctttgggcaaatgcccaaaattcttggccattctggagagaatgtctccgtttttttagaggctgcggcaagtgcatccacaaggaacaagccccagctgtcctaagcatgatattctgtccttggtcccctggagcctcacaagttacccccttcagtttaagttccaaaatcttagcgttcaaaggaacatcagggctccaagcacagcctcctacctggctaggacaagaatccctctcatgcacgctctcacaaatccttctgtcactcgtttgctgatggttcctctgataagtcctcactgcctagttggaaggttagaaagctctttcttatactaaacatcgtaatggtttctagaaaactcagaaaagtctgttatcattgtcttcagatgtttgaaaatagctagtatgtctccctataattaatcctaaacacgttcagttcctgcggccattcattgtataaacacgcatttattgtttattactagcaacccttattgtctttgggggatgcaaggtaatctgtcagcttccctccttaaaactggctgctaggaagtgagttggtgcccatttggatactaggaagtatgtttagaattgaaatatcccacatggaggcatctcagaacccaaggtgagaaaaggacatatcactgggcacatgatcccaactccaggggtgggagcagctcaattattagagaaatgacctgtcttcctcctcactggaagctcagggtgaatggtcttgctcctctaccttcccctgcccacccaggctcataggctcctgggacatctgtggagatggtgatcctctatgggcagccagccctcgtgccctgagatccctcaccttgtagctcagaggtccctcctcccaaagcaggaaaaggctgtcatttcctccgctgatggacagctgcaagctgcgttgttacacctcccctccagggagtcaggagcattcatttagtgctcatcgatcacatgacatgcataggaaagccacttaagtcgggagggcagtcatttgaggtggaagcttttaaacccgctccaggtggtcttaaaccaaaccagactgtcttcgggctggaataagttaagacaactctagcacctgttgtttaattttcttggaaggcagacaagaccatttgaggctctcggagtttgccaagcaacatgccaattacagagcagtgagcaaaacttcactccctatagttcacttttccccaccagctgtttcacaagaactacttactactgctaataatagcagctaacatttattgaatacttaatattcttcaggacccgaaactgctaagcaatttcatgtgcatcatctcatttaatctaccacaacgctaagaggaaggtgttgtggaaaggcccattttacagagggggaaactgagggttaagtgacttgaccattgtcacttagcatgatggagccaggattggaacctgggtagtccatgcccttaaccacagcacatccatccagagacatctgcttcacccagtcacaggcagatctgcagagccggttttttgatctgcagagcaagaaattctcaatggatcaagccacagagagggtgctgttgaactgcagatcaactccttttgttatggctcagcataattcacggctctgtgtccatggaactttctctggttcattgtcttcagcccactaatgtttgctctatgagaggatagtcaaggagctgcttgtgtttagagacccaatcgaggtgggacaatgagaattgtctccagcagaagaagcagactgacttggcgatgcgttcttgagggaagggttcttccctctcttgtgtacctggaaagccattgggtagacttaaattctggaatcattccatgctagtcattgaatgaatggttcaccccacttaaaggactgattggtaaccatgtggcaatcagataggaaagttaccaccctaatagtcctgagggaaggaatgggcaagccaccacaggtgaggtcacttgatctggtaaccaaataatagttctccctctctggtctctaggaatctcagctttcatctgtttcccttaggaaaacccagtggcttacagcccattcctagcaccctcctatgtctctggggtagaaagaggtcttgtttttcagacaggccgcccaatggtgttgctgcatgcctggttactcttgcatcgggaatcaccatgacaacccacagccattgacaagcagtgcagtcaccaacaggagagaagggaagagccactgttgcccctagttgggacttggagggctcctcctgtttccccttgagtgtttagcaagacgtggcctacagcacccattttcaagcacagagaagattctgggcagggtcagaattcatggcatcagctgtcattgggttcttccccacatccagcctcagtaggttgctgaaggtctaaattaatccccatattttatagggaaaggatgataacataatgttctaaggtgggagagtggtccctattacaattaatggataaagaaattcaggatgacagagggttaatactagagaaataaaaagaaggaaggcatattaatgcggaaggtttggctctatatcctgtagcttaattaggggtacagaatagctcccctagttggtgtcttcactaagcgttcgtgccaatgtgtagaggtgataactacttccagggacacacagagcacttttttaaataacaaagagccttcataacccactttttgtaaattctcctactaaaggagctagagaaagggttatgccagacgcctattggcgccatctttctcctgttgtatatctgcatctgagtgttcatgaaacagaaacagactccccatccctgttttaggaaaagaaggcccacagagtatctttcttggcaggagcctgggcccatcttcctatcccacagtcttttctggaagagcttcatccattctcctggaagggccactgcattctttcttggcaccagttttctgaggaggccttgctctctggagtttggaatatgctttcagcatttccagacaaataccatagaagtgggaggggcaacataacccatgtcctccacagacccttggtcaagtgtggacgccaccagaatgattgcactgggccactgagtcaacatgtgaattgctggagttgccaaagtgatttttgatgcaattgatcattaagcctgactccagatgtctgtgttttccaaactttgcaaaaaaggcctgtgggctccaagggcaaccttcattgaagagcggatcagagcaaaggcagtagctaacagtggggctcagcgatcttctccccatggggcttttcaaaagcctgggtgtagtgggtccttttagtggatcataatggacctggttttccccctgtgggccatctccccatgttacctggaccccaaatgaaagaagctggaagctgctactagtgataagaacacctgggacttttctgcacaggccagccccggtcccctagcagaaagacttgagtcacgagggttctccctcatcccgacacaggcatttcatttccctcctccagctctagcttttttgactcccagtggcttctgttttctgctttggttttcctgaaggccacagctcccagaaagcaagagctctcagcagcacagctatgctgggtagtcaatgggctgagtgctaatacctcttgacatggaacatatgtggcagccaaaagtgctccaaggaagggggtggcagagggcctcctagagctcacacttggaaataaatttagaaggtgctgtacatgccctcccactctccaatgtgccactctccttaatttcctctgatgggagcatggctctttttgttgttgttctgccttattgtaaaatcacccgctgcgttgatggagtggctacaaacagggtacctccaccgcctcccatcagcctcaggtggctcccttaggctcttagtgagaggggactggctctcacagcagcatgacgattggaaacaaaatctttgggctatgatgtcgtgagtccaaatactatcctacctcttacgggttgtggaactttggtcaaagttatttaagctctatgagccccagaagggtcacctgtcaaagggagattaaatgggagtacctggccttgtgaagtgtgtaatatgcattacctgttaggccatgtggcccctgctgttcacctggtggctgtggttcacctggtcggatcatctcagccttccctctcttttcatttatatgatctccgagggtcctttgagagatagatctggagcaggtggccccaaaagatcactggatctgcatctggggaaataccgatgaatacagtattcaccaggcagtccagcctgactcactggatccaacagcagattgggctgaagtgagatctttggctgggatgtcacagttgtcagtttgagcgccaggcagcctcttgaatgaggccagctgggacatcccaccttgtgtgctattgctgttatctctgtcctacggttgtccctggcctgctcagagtaaggggatcacagagccaggcatatcagctcccacgtcggcattcggtcagtgatcctgaagggggaagccttgcctcgtacagatgcaagccactcagtaaagaacctgccacctcgtgccaacgaaggcttgatcagcatcacacgctgaagctccttcctgggagtcaggaggacttctgatgcctctgcactcccaggaggcaagcagggtcttccaaacccaaccagacctttgtccatctgaagcatacccaggtacagtgaaggctagcaaaaatagccactcctcacacatagggaaaatggaaaagagaatatagactttaaatagtagataagagatggctttggagtgaaacaggctggagcttcgcttattgctgggggaccttggttgagtccgtcaccactctgaacctgttttcttatcagaaaaatgaagataatcatagtgctgttgtgggggttacataagatagtgcctggaaagtgcgtgggaaaagcacacagagatgtagtctgtagagaggatgctgcattattatcatttcacacagcagttacaccaatgctcctcaaacagggatgaaccaggacggagcaagcatcctggaatctctgctgcaaaaagggggaatccatccctccggtgaaagagggaggcctgtgttcaggattccttatagaactgctaaacctcatttcaaatgtttgtttactctctatttgctccataatatggtgcttttaaaattcccctccaactcttgtccatgtaccagatagctaagagctcctttcatggaagccaggctgagttgactagctgccagccttcctcccaaaggaaagagggcacagggacaggctgttagatcttgctgatgctggggaccagtgaggctgtcctcagcatctaattctggataagcagcttaattttatctctccctgcacctacacacctcgcctgagggagccaagcatcctgggagagaatgagtgaccaggagactctgcccttttgtgttttcttttgctccatgcttcatgagctctgcaccttgggctatctttgcctagtaattctgccagcctgggttgttttgatgccttacatatttgaagtaacatcccatgctgagagatctaggagcaataggaaacaaaggagcatctggatgagaaaaaaagagcctcaatagacctgatgagtgagaaggattgccagcgtggcatttagtttttatgaaggcaagtcaagttgccatttctttctccccatggccatcgtccttgtctagtgcctaatatgcgctagaaccaattgctacaattgggcttatgaatctgcactggggtttcaaacctaaatgaccactaaggcaaggaaggtcaagtaaactagtgaaggggacacaatagggaatagtgaggactgtggcaaatagagagcatatgtcctatctaaagggggcagctactccatggctgcctccagggaacctagggttgcctgagctcctgaattttgtttttcaagagaaaatagaaatttgatgtggtgtggtgtggtatggggggtgtgtgtgtgtgtgtgtgtgtgtgtgtgtgtgtgtgtgtgttgtatgaaattttccaatttttaaaacagaggaggattgaaaaaacacatatatgtggcatgacgcaaaatgctgcaataaggattccatcctcaggctatcaaatgggcacctctgacctgttgtgtactgaatagttcagtgtttcttgacaagatgatgtactcagaaggccctgaatgtcaaggtttagaacaaaacactcaccatgtgtgtactttaaaaaaaatcaaaacactgtgtgtgtgaagggtccattcctgagccctggttgctggaccccgttgagtcctccagcttttctccctgtttctctgctctatcacatttccttcaaatgcccccaaaatgcagtgacactgactaaaatttaatacacaaagcatcggaatttgcaggggggagggatgttgcaaagagtatagaccgataggatgggtagacaagacattcgtaaagaagaaactgagccctctagagacctcaattatcataaccgcttccagcatgctccctagaaacatgtgtgaccttgaaaacacctgccaaactctcagcctcagtttcctcccctatcacttgtgagtcaggttctgtccatctgcccaggttcctgtgagaataatgggacgttgggaaagcactttggaaaacacagtattctagcagtatgagcattttttttccactgccaggcaggaggacatctgtgtgaacccttgggaccttgcccattattagacagattaaacaggccgttcttcttccacttgtcactgccacagctgcttgcctgcacgcggggtgcaccgggaccgtggggagtatgaggcccgcagctaagggagaggtggcatggatgatttagcaccatgggcagccccaccgttgccaactgcagaccccctggatcctggtatggagagactcctgaggcaggccagcccggcatccatctcatgtgtcattccccaccagggaggggctgaaccagcctcgaaagtaaaattcttgaaatgcaacatttctgctggttagtttattttccccttcccccagtttcattcgagaggggataagaaatgattttacattgactacaaggcatgtctagtcagtctaggatcagtaaaggtaattcttaggatctcaatgtgcttgacttgccagccctgctctggaaaactgcctgtcaccctcgtggcatcctctgctttcccagacttccacccaaagggtagcttcctatgatgattttttagggagtctgaagagctaaaaacagcttcctcatggataggaaggctgaccctggaaggggtgagggatgggtgccgccttagagaagtgagacccttgaagctgcatatggagttattatacatcttaataaagaataagcactgagaagaaagggaggaataaaatggctgtcattggtgccattatagagctcctaatcctgtgtggaaggccaatggtagatatcctataatcacaaattgcgatgagtgccaggagggaaataaacgggggtgtgagagacgataatggagtgagggtcccattgtagatgagggggtcagggccggcctctctgaggagcggacatttgagctacagtggaaagcaggaaaagaaggcagccctgctgaaagaaggtaaagagggtgttcaaaggtcctagggaaaaatctggtgtgtctgaggaatgaaaatgcagtggtaggccgggcgtggtggctcacacctgtaatcccagcactttggaggccaaggcaggcaggtcacctggggtcaggagttcgagaccagcctggccaacatggtgaaaccccgtctctactaaaaatacaaaaattagctgggcgtggtggtgcacacctgtaatcccagctcctcaggagcctgagccaggagaattgcttgaacccaagaggcggaggttgcagtgagccgagatcacgccattgaactccagcctgggcgacaagagcaagactccatctcaaaaaaaaaaaaaaaatgcagtggtgggactcaagggtagtgagtttggggtgagtggggttaggatgaggttggcgaaagggccaaggtcaaaccacatggggctctgtgctctctgtgggtgtgcacatgtgtgtatgacagagaatccatatgtatgcacatgtgcctgcctacacatagatgcagtttttccaggaggatgacatataactttcatcagatttccagtaggatcagtgatccaaaagaactgtaaggaattttctgaatcaaattgcccgtagtcagtcaactaaagctctaaaacaattatgccaaatgattttttttcctttccaattcctggaagctctgaatcctaaaacagaaagtgaagcacttagggtgccttttcaggtcttccttcaaggccatgggtgcaagagaaggtgccaagtgagagcagtgtatggcatagtgtctgtagtgacagtgtgtgcaggtgcccagaagtgtttggggtttcggtagacacaggaaggcaggtctctctctttttctgttctgcagcaggagctcaaggctgcaaggatgagtgatgggagctttgcagcccatcccctgcaggtgcaacccttgccccgcaggtaattaccaggattagtgaatcaaccaggctctcttctgtttgcagcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactgtgagtacactgcctcgggtgccagtgggtgcccaagcagcaggagaccccaaatgcccatcatgaaaaacacccaaatgagggcagcacgagcacatccaggaggagttctagagcctgcagggaagctagaataataaaaatcggaatagcttatcagtaccaagcacttacactgtgcttgacaccacatggagtacttaccctgtcttaaaacccttaagcctcacagtgaccctacttggtgctgttactatctcttctttctacataaggaaaccaaggcatagaatggttaggtaacttcctcagggtcacacagctagtaaggagcaggttttgaatccaggcagaggaggtcctgagctaccctcataacccctgtggtcactgtattctgagcagactccatttctgcagatagcccactcctgcccccgcttaaccccctccaccctgcaaaaccaagcatctgaggtgggcactcttcctctatgggaagtatatcctcacttccatgcactacaggtattcataaatatttcacttaaatagatgacctccaagtacagatttcagcccattttttgatggctccagtctcaggcatagacctcagccccatgcccaggtctgcaattagcctcggggcttctggagaccctgtaagtcatctggtgcttgttgcctctgtagccagagacaggaaccaagacacagtaggagcagctgctatatattgacgccgaccacgtgccaaacactgtgttcggtgcttcacagtttttcttactgaggcaggggaagcaagacccatggtgctcttatgatgataaggataattacaacaatacccgctactatatatggaacacccaccatatgccaggcgccgtgccagctgctttatgtgcctagtgtcactgagcttagagaaataaaatgcattctaccccaagtgcaaaccatgactgggtttgtctgtcagaattggcgtgggtgagagtagaagcaatcggtggtgggtcttgccccaagtgggaagagctgggagaccgattccccagaccagatgctagctgcatctgtgactgtcttttgcagacagcaggcctcagaccccctctttgagccctgtctgaaagtagcaccccctaaggcttcctggggcgatgaggcaggaggccagtccttgcagtggattgccagggcccagcgcgaggcagggtggtggtggtggagcaagacgccgtgggtcactcctgattaacggccccatccctctcgcagccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggtaatcaggttacggggctgggccccgctttctgactcagaatgcagcagccccagagaggccaataatccaatctggaggacagcgagcactgtaatggctcctggggagcatctttgcaaattaaattggggaaattcagttagccctgcagaaaaccagttaccttatggatttaaaataaaacacacacacacacacacacacacaataaaagcatggggaggaggagacggttgcaggggagacaggacccaggcagcagcgtgtctccaagagctaaggagaaggtggggctggggcggcctttgcacatgtgcctgttacaggctaagatttatatttttcgtttccaaagtgtgctccccaaagggcaagtagagaaatacatatagctcaggcgaggctacagacggtgtgtaatcttggggacctcccactcccttcggagacagaccatggtacagccctttgaccacagtatgttataggttccacatgttcacgaaaaacactttcactagcttagctcctccatccctgattactgtgttctgagtacggagagaacagtaaagagtcgtgcttgggaagaaacaaagcctcgttcttctgtgcccaggatctctctagaaagcttccttctcactgcacccaggaaggacatgggggaaaacagcaggggaattctcagcctatcttggaaagagaagtagctctccttgacccgacagctacatgaacaggcagttaaaaattactatcatttgtgttcttttctactggaaaaaaaatcaccaaactgcattgtgcccccaatggtgaaagactgatagcatgaagtgcccaggcgggttgcagccaaccctcacggtgtgtgcagcagcaagagcagtgcttctccccttgcccaggagcttctgatgcaggcgagtcttcccggggagaatgccagcgtggggagaggttactcccaggcagacttgtgcttcttacaacatcttcttgtcctttaagtcaaattctttagtccatgtctccagaatgataagctttagctctttaaatttttttaacagaaactaataccttgggagggcttggagataatacagagactttgtggcactgtgaaaagttggtaccgacttcccttccctagaataatgatgtcagttacaacagccatctttcacctgcgatgagcgtggtactggaggcttctagtctgatttgcttcttccaatggtcctgggaagtcagtaggagagccctttgctctataggagagggaactgaggacttagaggtgaaggggcactccaagttcacaagccagcaaacagcggaggcaggactaaacctcaggttcattttggtcctcacaccacacagcatctgggagagaaggaatatttggggatgacaatcagctgcttggatgacctccttccctggtctcatgctcccacccctacccgctccctgaacactgtcctcaggttccttcctgggcctggcaacatctctggaaagaaaatctcacccaaagcacaatcgtcctatccccagcacctttcctcatgactcacgccaaccttggcctctattcctacccctgtctggccagggctgagttaattagctctgccaaacagtggtacccaaaaagaaggacagtgagagccagaggagggcagggtattatctgccaaccttgaccctttggtctcataagtatcctgttagtactttggaccccaaatggatgtggcggccctgcgtggcacagcagggaaagagtgcaggatccaaggactggtatctccccaggaacacagtcttggcaattttctgggcatgactgtggttgggggtggcaaggtgggggtggggctatagaaagaactaagtaggagaaaaggaaaatggaaagtggacctaggaagcagtagagcttagttctaactctagctctgccactatcgtcctacctgtagatctgcaggatcctggctgcttttcctatgtgggggaggggaagctgaacattttaaaaaagaaacagggagaaggagccaggttcttggattgactctaagataccttttttaaaaaaaaaaacaatgctaagcgaaagattattcctaaaaagtagagatgtttggagctagcatgagactgacacgtagcactctatttgcttttattttatgtcattgcaaagaaagcatgactgctgagctccaaaggccttggctttgagaaacatggggttccagacctgccttggccttggagggaaagaaaaaccatagatgtaaagctctgtgtttccaggaagctccagaagaaagaaggggggcaggtgacacagactggatgtgacagataataactctgcgttttactttttcctaaaagcacccccattgaaaagacagctgatgtaattaggaggcaatttgagggctgctccgtaacacatcctgcccctccttaggcagggcgtctggtttcccagctgcctgtgtctgcctctctctatcagctgcatccgccgccttgggcagcaagatcagtttagggttggatgctgccggctggggtaatctgaccatcagattaagtcctcctgaaaaggctccgtctggctgcctgggaccccaagcccatccctgggagcacttggcagttgcagggtgctgtctgtcttccttcatgcctccccgctttgtgtgagaagaaactctcttgctgaaaagtacagagggtggtgacgcaaagtgtccaaagacggcgaacagcaagatagctctcaaggaattacagaacttttagaaaccttagaggtcatccagtttattctagagatggataaattgaggtccacacagcagaaaaatcttatctaaggtattgagtattatttttagggcaagatctgaaacccaggacttctgacatactgtgaagactcttgataatttacctacaaatccctccatttctttttgtaggaagaaaccaaagagaaagaaaattagattttaaggcttggtgagggtggcggtttgcacgaacaggatggatttcccctgctcttgtaccagggtcctaatcaaactcacatttgaagtcccagaaccacagtgttcacagagccctgcataggtgtcaaagcagagtggagtccagattctagtggctgactctagtgcgtgtgatgagagaccttaggaaggaggagaggccagacagacccagagctgtgggctggctcttcctaactggtccaacatggcagacaacctatgcaccgttgagatgctgagaccatctagaggatatgcccagtcccaaaaacacatagtggaagaatgttgatactggttctcatgtcagaggtcaggcagggagggtctcagtcacttagccttagctccagtttcttcaagatgcacatctccagcctaatgccaagtgggaggaagtcccaagtcagcaggttcatggaaactgaccctgatctatcacagagaggaatataaaaactgggtaccctcacctgggcctttggcatcctgacagtggttattggttcatcctgttcgctcccataatttccagctaaggaagagaacaagaaatcaagaaggaccccagaattcagtgtcttcccctcagactcatcacttggcttccctttccttccttctcttagtctcaaagaggcccttcatcaggaggcgcactggccaccatctctgtgaaagtcagtgttctcaaacaacaactatgattgcaggttcctcagtccaaaccctacggccccatttgttttcctgtctttctctctggctagagagatatattttcttttgacaccccactgctcctctattaaacctcaaatgatctgggatgagtgtctatcagccagagcattcctgctgacctcaaaggatataaaggagactcctgaattgtggaatgtcaaagggggctttttcctaaagaacagcattgaaggtttgctagaccactgggaactgtggattgtctcttgacttaaggggctagaggaatgactgtgatggaaccactcagctgttggggggattgggcctatgttgcaaagcatgcagaagatgcttttctaagtttaatgtcttgtcagaccaactggtgtgactgaatggagtttagaggctcaattcaggcatgtgataggatcacagatgtctgagtgttctttctttccttgggaaggaaccatgctgtcctgaagctcccgagtatgggcatccagtgatttccctcccgttcttctcccttcctactgtgtctccctggggtggggcacaagggcagcagggctgcaatcttcggaagtgttccagtggaaccccactcctgatactaatcacgctcagtgggggcctgctccggcttccgcttctccacgctgcttcctctgagcgctcctgtcctctctctgacgctgcttcctgaccttgactctgaccagtcgctgcggggctttcctttgtgcttgatctaaccatgtggtggaacgatggaaacggaacatggttctgtcaagcaccgcggaaagcaccgtgctctcctgcagcatggcccgccaccgccgccaccaccgctggacacctctcctctgctctggagcaccgcagcccaccacctgccagacccacctctcccagtctcaactcaccaaaggcaggagggtaggagtctcaaaggatgcagatacagagggaaatgggtctggagaagcaccctggggaaagagatctgtatccacatctctttcccaaaatggagtcaccctcccccaaatctagtctggatgtcagacaaggagtaataactaggttcaagctcagaaactactgtgtctcttcttccactggaagggaacaagtatacccaaggcatacgccccatggtttcatgggagagtcccaacccaaggtcatttttccaagtggcagctaacccaaaggggaattcctactgcttgtgacccccgacccctcccaccaccacctttattggtattcactttatttgaaatgaacgtcagcatgagaatgggtgaaactcatgtgagtctgagactttgggtttaacccaaggttccttctgaacctcattcccatactttatgaaaacacagtccctgaaccccatgaaacctaaagtccagtctgtttccttgacctgcaaagcacagttaacgtggaggtgctgggctcctcacctggtgctaattctgtttcaggggaggggagtgtgtgtggacgtggaaacctgctatctctgataataaagagagggatcttggtacctcttattttgcttgttccttgataaatcctagacccagtgtaaccagaagactgtgttgttcattcctgtcctggagtctttgtcctattctgcaagagagagctaaggtgggaactttagcctagctcagaactagaagctgagccctgggcccccatcatgaggtgtgactcttattacctcgtctatctgaggttacccctcagaaccaggagcccaaccattgcttagtagttttttaacatacattgagtgcttgctataggccaggcagtgaactgttttcacatcattaccttgtttaatgttcacaaaatctaaagtcccactttacagatgaggatattgaggctcagagaggttagctaacttacccagggtcatctgattccagaatggctgcactgtactgctgtaatacccaccttcccagctgtggacaaccccattgccttgaattagaacatttaaaaactgtgatttgatagggacttgaaatttgcttaaactctccctttcagactttcatctgttagtagaaagaacttgagtaagagagaaagcattattcaaatggctgttcctctccagcatggacatacaaagatcccatttaacacagagcaaatcctcgagcctggagaagttccctttcccaccttacagagaggggcattctgaggccctcggcactgcccctaacatggcagggaccaggcctctgggagtgggtccataatggtgcccttccatcagtgctttactggccccgcagccacaggctgtgatgaggcagtgccagcctcagaccatgggtatttccctctgttttcaggcagatggctgcactcataatagactccaaaggggatagcttactaggacggctccctgcccaactggtgaccaaactcctagtaaaacagttggcatcttccagccactggcagctggtcccccagccttgcccatgagtggatgtctgtgtgcctggcagtgttctccttagtcattcatcacttatgaccctttgcttattcacatcactgtcttttcaagctgatgaggcctgacaggacttacgctccccccaattcctctttctgcttctttcctcctttcttttattccactcatcttagggatattgggaataggggaggagagctctggaaacatgagttagcaagtccatgatgatcagataacaatgaatttatgactcccagtcagcaaactggctgcccaaaggatgatacaaaatgcataccgttgatggcagcagccatcctggacctggtgctggcctctgatcccaacccagccaagtccattcaaacatgggagcttggctccctacctgtcccacacccctggtcatccaaatgtgacaagtgttcctcctgggaagtggctgtaggacagggatgtataataaaattgtgttgctgtaatttccacctcctacccccacccccccgtctattaaagcttgtctgtgatcacgtaccaagtgtcgttgttctgagctgcccgcgaaaggggaggagggctccaggggcaggagcaggcaagatgccagatgacatcagctcttccaaggctggtttcagccgaggttgagttttatggcccttcttcaaatcctctgggatctcttctgtctgaactcaccccaaagagaagaagcaacagcctattgcagtcggtcctctattactaagtatttctggcagtgacaaatatgcactgagattgaaattgacttttaaagctctggaaaagttaaaaatactttggggtagttatgagcattaggcataacaaatggctctgagaaaccctgagtagtttcggtaatgaaatatgaagtgatggagatggcatttcgggctggctctgactggggaacgaactttttcggttatgtacatacgccgttattaacatttctggctcccactcgtataaaatatcacattccgacccccttgttattacaaaccagggcaataacaaaaacagcagggggaaaaatgctggaaagaacacattagtccatcgaatctaattgcaaaatcatttcattaaaatgggtcagcggctccattgcagaggtccaccagttataatctaactatactactgagagcgattcctgctaactacaggctgctctcaccttgattaaaatgaaaatgcatttaataggcggctgtccccagccacagcccagccggtgcacgccttcaggctcatcgccttgaagagcaaactgttcttcctcctgtctttctgcctttgatcagcagtcagggttccttcgctttgcaaggatcccattatagacacattgtgaaggaaaaatctctgtatgtgtgtgcaatgccccttcgtgccatcactctgtggatccactggtgcggagaacaagagaaggtagtcatctgacagggtttgcaaaatgaaattcgcccaggactcggcacgctgatgggtctggaagaaaatggtgcaggtcagagttaccaaaagggacgaagctggcaagccaagggcaggagatttgcataatacaatgaaccaggaagccactcgaataactgtggggatacgtgcacggagtttgctcacacaagcctagcggtagaaggggagatggaggagcggaaatggagagagagcagagaaggaaaggaggacaggaccaggcttctgactccctgtcttaggtaggtagtgtcacatcagaattagagacccaccaagttcattctcgatcaggaattaccacaaggaaatcacagaaggcatgcaaaactaagagggtgggagagatctgcgtccttcaccaccatagcccactatggaaaaataccccattcaatccacctgcaccaaatctggctagatgatcattcctacagggacctgggaaaacctttggggagaagcaagtctgcagcaaaacatgttaaccacatggaaccagacagcagcctgcgcagactgagtgacctgtgggcctcagtttcctcgtctataaaatagagttatcctaacctcagagtgttgcaaggattaaatgagatcattcatttgaaatggaaagaatagtgcccggctcagtatatgttcagtaaatggccactgttactgctagctacattcatattttcacagcctctgagctgccaaatgttctgccaggttgtagaaaaaaagcagttgctagagtcacaagcatgcataccactcctgaggctctccacctccttaatgttactttcatctgcacaacagcccctggaagataagggcagttatttgattcccattttacatggagagagactgagactagtaagttgccaaggcctgaacgagcctgtgctcccttctgctaaaacccatgaaaagctaatgctcctaaatgcaaataagatcaccaagttgcctcacctagtggagcaaacaaataatgttcacattctctgaaacacttcccaatactcatgtacaggacactcaggtgctcatgacaccccactcgtgcattggacaaatgtggacccatctcttgttttgtgtctcgcattgtgctagtgaaatgttgagtgtgaaaggatgaagaaaacctggccccatcaataagcttatgtctgatgggagaaccagagctccttcagttccaaccagcatgattcaaggtctcacagaggtttgccccagtgcccagggatcatttgtgatcattgaggcaactcgccgaggcatttctcagagacaccacgttgttggtcccattaccattactgtgcaacttcgggagatttgcttttcaaaaaagcaaatctcagctccaacttttagctcatcagaacgtgcctttcactatagttatgtagaatgtgctctgaaaaacagaggccaaatctgaccctcagatacaatttgctcgtcctcgcggcattttaaattggaatttattaccaatattgtttatatggattctctttttaaaaaacaacaaaaaagcaacatcaggcaaccctgagccaaatttccaagcattaaggctggggctccaattccccaggttcccaaccctcgttgtcttcccaatcttacagccaggcgtcgatggtcatttattgccatgtacttggcctgtactcgttttattacctgctggggtaataaaggcccctaagtttgcaaccccttcccataatttacccctacccctggcatagcccccgtcaaagcatcatcaaaatcttgtcatttggattttcatgaacatttagagggtccatgaatgataggagttgtgaagcaggtagaccccctaaaatcgtagactgtacacctgcaccaaggagcacttccccgaggagaacattcataactttcatcagcttctcaaaaacgtctgtgacccccaaaagcataagggcccacagatcttgagtctggtcttcctgaggatggtgatgaataacaaagatccatgggaaggaggcagtaaggctggggacagggaaggcaccagcaaggtggccatatagcaaaggcgatgccgtgtctgttacttgacccctaacagcccccaactcattcccccatctctgtctcccacccccactacccacaacctggggctgtgcgtggaactcgggtgacgctgacgtcccctctttggcccctcccaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgtaagtccaacctcggcgtgaactccctactcctccccacacgccagtcacccggagccagcgtgggcagggtctcctggcggtgaccccttcctggctcagtcatgtggtgtttgttggctgtctttcacatactggtctgaaggtagatacccaggcatctcctgtggacagcttgcttgcaaataaagacagttcattccttcattctacacatattttctgaacacctactgtgagccggcatcatgctaggcccaccagtttctacaacagagcagagcaggtagtccctgccaacccttacggagcttacagtaaaaccagaaagttgggtgctaaatgaagaatggtagtgaagtgagaaaacaactagaatgattaaatatatctgagcctccaattagccatgttaataaagggatgtgttggtttatcaaaaaaaaaagagctaaaaaattatagctgggccatggttggtgggtcatgcctgtaatcccagcactttgggaggccagggggagaggatcacttgaggccaggagttcagtactatcctgggcaacatagtgagaccccactcccttaccccagtctctacaaaaaaaaaaaaaaaattttttttttttattagctgggcatgatagtggcatgcacctgtggtctcagctaccggagaggctaaggcaggagaatcacatgagtctaggaattcaaggctgcagtgagctatgatcataccactgcactccagcctgggccacagagtgagacccggtatctggaaaaaaaaattttttttaattaaaaaatttttgaaaagttatagcctcgtggaggacaaaggcacagcatgtggggaccgacagacatggggctgacacctgactctggcaggcttcctaagattaggccatttgctccttggatctgagactcagtttcttagctgtcaaatgggggagataattaatgcctacctcctacagtggttggggagactaagaaagatgatgcaagcatggaactcatcttgaatcctggcacagagtaagccctggatgagtggtagtggtcttcattattattattattgttgtcctctctaatttcacaagtcatcagaggaaacagcaggcccctttccctgccctgctgctctccctgaatacctgtgaagttcccgagctgctcctggtagagggaagtgcttaggaaggagctgaagggcttggagggttgggagaccctggagaaaccttcctgggggttttaagttgtcattggtatgtccacaaaatgaaaacagatccttggtaattgatgggtgctgaaaacaacgcatgcccacgcggaatactcagaaagtcccctaaaccccagccgaaggaggcttcctccaggagaaggaggaagcagcactgcatatgcctccccaaactgctgggcccctctgttgatgggactgatgtcaaagcttccgatggctctgtggtccttcaccgagtgtgaggttcaggcagcaatgcagcaaagccatggggggtggaaggaggggcctcgtccacagctaacctaccactcatcttgcttcctacacaggcgactgaatgacaatgaggtatctgttctggaggccactggcatcttcaagaagttgcccaacctgcggaaaatgtaagtcaacttcaggaacttggcagcagcctctgttctctagccagagcctgtgttctagactagaggaaccaggggaccggcctctcccccagcctctgctccactccctcccagccttctcctcagccccgctgtggcctctgttaggaagcaagacatgtagacacagaccaaagtgatgcttcatggtttcagttgagtgttatacagagcgagcattccacaccatccctgacccctccctggaccctctgctcaccccacccctacacgccatccaacacctaccccagggctggtgggtgggactcaggtaaggactagcaatggggcacgggtatctaaggtatatgctatttggcaatttttgtgtggtgacagttaaatgtctgttttcaaatggaatcaaaagacccctgcatcagtgatacacatcagaatgaacatgccagcagcttcccacagtgggtttcctccaggagtccgtgggtctgaccatgccttggcctaggcaagggcccacttgcctatgttggcttctccactgccagagatgcagatcatcctaaccctctccctgcacaggagctcagacctagtcataaaggtaatgagaatgatgttggtgcaccagtagagtccttgtcctgagctaaggaccatgctccctgcgtcacacccattgtctcactgagtcttcacccacccatccagtgctggcttcacagtcccctttgtgcaggtgaggaagccagggctcaaaaagtttctgtgacttctctaagaccacacagctaatgggtccccgagctggcattcagacttgggtccacctgcagtcatgctagtgtgaggctggcttgcttctcctcatcttccgtgcggggtcccccagcagaggtaccagcacagaagaggaggctctttaccatctaatccccaggggggcactctttggcccctctgccttaccccaccccctacttcatgtctcctggccccagagttcaggtgtgcctcgaagaccagggaagtaaagtccatcctcatgattcatggattccatatttgagaattcgccgactcactgacatttgtgtaagtccaaagtcaagactctccgtgccttcacagtcattctcgggtgtgcacagaacaacaaaacaaaaaccaaaacaaaaacagagtcacccacacccacgttctcagctggggtcgagcgaggccacgctctgccttcttctgtcacctctcatgctgtaaaccagtgtccttttgcgttatattcagtgccgtgggttttgcatgtttgtggtttttgttggtgattttgctgtttaaaatggccccccagacatactgccgaagggctgtctagccatcctaagtgtgcaaaggctgtgatgtgtcttacagaggacatatgtgcgtgagagcagttttattacaggcttgagttatagtgctgctggccatgagttcaacattatggatcagccatatgtattacataagctatctttaaacagaagcatacatataacaaggttatacgtcgataggttgataaaaatgtggagaccagaggctcgcaggaccctaatcttgtatttccctaagagcaatgctttggtattcactaatgcagtgttcccagcaactgtatacaacataactactgtgagtactggttgagtatcccttatctgaaatgcatgggatcaggagtgtttcagattccagatttttttggattttggaatgtttacatgtacacaatgagatgtcatgaggctgggatgcaagtctaaacacgaaattcacttgtgtttcatgtacaccatatacacagcctgaaggtagctatgtgatatttttaataattttatgcatgaaacaaagttcaagtacattgaaccttcagaaagcaaaggtgtcaggtgtggaattttctacttgtggcatcatatcagcactcagaaagtttcggacattctggttagggatgcttacttataatgagagtggactgtaccacctcgtttttttctcattacccatgctcccacccatcagttccctgtagacaaatatgacagaggccttctaggccctgggcagcatctggatctcactggtgctactcagatcgctttcctccctccgtccctgcctgcagccaccaccttggtcatggctccagcgaatgctgtgtaaccgggtgcagtggagagcacgttggggggccagctgagagaagggcacacttgggtgaggatcatggctgtcactggggtccagtgccccactagcttcagggtcccaacacaaacatcacccatcacctaccaggaattattctttttatttcaaaccagagaaatgtactttgtttttaacctgaagacagaaacttacaggcctgtgggcgtgaggcagatattaagatgaatcaagctggccaagcgcatatttgtcttctgaacaggatctgctagtctttgcttctgcgaagaaatacgtactctcccatttgaggtgaaactcaagcacttggaatctttcatcctcccagttttgataggaacatgagtgtagagaatatttctgtatgccccagaaaacaacagcacaaacacatgataagtgtcaaccaactcccagcatcagcaaccaagcaacaaaagggagtggtgaggtctctggaaaaatatgggcctagatctcatcaaaagggacagatgtcactcagctcatcccagtgcttgccatgttggaataaaagtgagggctgccaaatgtttccatttctcaagagctgccacaactcccggtgtggaaggaaaatgggcagacaagcctatgtgagttctgagttcagctctgcccttcccagttatgtgacaccaggaatgtccttagcctttctgagccttagtttcatcatttacataatagaaataaatccaccttccttataagttatgatgtggatcagaaatatgaggaaataaagatgaaagacatggctgtggtactggggagacagggtgtggaaagacaggagagggcatctgagttgagtgacccagagtagctggttatatatttaaaacaggggttgggttgggcacggtggctcacgcctgtaatcccagcactttgggaggctgagccaggcggatcacaaggtcaagagatcgagaccatcctgactaacacggtgaaaccccgtctctactaaaaatacaaaaaaaattagccgggcgcaatggcaggcgcctgtagtgccagctactcggggggctgaagcaggagaatggcgtgaacctgggaggcggagcttccagtgagccgagatcccaccactgcactctagcttgggggacagagtgagactccgtctcaaaaaaacaaaaacaataacaacaacaaaaataggggttgcacacccagacactttcaggagcctgggagtagcacaaatgtggaacttggctgcgtgcaaggccataaaaataataatagctagcagtgagcacaaattaaacactttaccctgcgctagacagtacagatattaatgcacttaaccctcaccaagaaaccctcaggggctctgaactaacccaaagatggagagaagccccctgggtggccctggttttacattttgtggtttcctgggatctggggcaagatactgctctaagaatgtgatcggctcttacaaaacctccatgcacttgttttgtttctggagtgtttgccccaggctgcactttctgtccttcagctactgctgcctgtagttgcgagcagtgctttgatggatgtagagacggcagcagccagcttttctggaaaattatatccccctcttttttactctccttctgttttccattctcccagcctgaggaaatccaattcacaaaccttacagtaatgtgatgttaattttgctcatttaaagaaacagatgtcaggaaatgggaaccctcccacttcatagctgctttaactcatctgcattgcccatcacttgtattttaatccccaccctccccaacaaagaagctcaactctggagcaaaagccttctcttctggcattcgggtgacttatagctgctggagagcctttatctctcctcctgcatctcatttgggggtaattggcagtctcctcagggcattaccttcattcctgggttatcccagaccagggctaccaggatttataagaaaaccggccaagtttaaggagaaccaggcagggagtggaaatccagtctgcgagtctgctgactgtctcagaccttgggcgagggatgctgggaatgcttactcctgttttcctggcaggatgggaaggagagaaggagaacgaggtcatgccaaggagtaaggagggaaccaaggcaccggctgtttcctccacacctgcccacaagcgcaggcatggcctcaccctgggggcctggtccctccttgggaagagggcagtcagcctgcattgagtccccaattctgtcacttgctccaagtcagtccctaagggagttctcgccccctggcattgttgtgggtcagcccagagctcagaccagggacttggtatggtcctagatccccttccaatgctctgtgacctggagcagtgccctcctgctctgggactcagtatcttcagcagtaaaatggtcctggtctatctctgcgagcccgccaattctgccagctttcgtgtgctctgtgagttcacgggctccacctccacctgcgatttccttgtttgcagaagatggttccccatgcaaggctctgaataggctgtctgcttgggaggctggactctcccctgagctaatataaacactgtcatcaccttcagttcatccatctggccagggatgctttccagggccaggcattttgatggtccacacaagccccccagcaaccctgccagggagaactgctaactcgcagtgctaatggctctgcagcatctgcttgctgttctgatctctcttgaggtctgtgcaggatgtcagcatgcagcctcggagggaagggctgctttcagacctcaggggcagactcagaaatggcagcaccagccaggcatggcggctcatgcctgtaatcccggcactttgggaggccaaggtgggtgaatcacctgaggtctggagttggagaccagcctggccaacatggtgaaaccctatctctactaaaaatacaaaaaattagcagggcatggtggcaggcacctgtaatcccagctactcgggaggctgaggcaggagaatcacttgaaccctgggggcagaggctgcagtgagccaagattgcgccattgctctctagcctgggcaacaaggagagaaattctgtctcaaaaagaaagaaagaaagaaagaaagaaagaaagaaagaaagaaagaaagaaagaaagaaatggcggcactgagggtttgataggaccaagctcactttaagcaaatacaatatccaaaatcttgaattttgtaaagaagtaatatccacatagtcaaaggaatactcacttatgaaagaagaggttcaatggagtacatttgatatgccagaaaacctggcttcaaatcccagttctgtcagctgggtgactgcaagcaagttagttaatctctgtgaacctcagtcccatcatccgtaaaatgagacgataataataaatgagtccgacagccatcgttttgagggtttgatgtggttgtgttggtcagatccctcatgaggtgcctagcacataagaagtggtcaacaatagtaactggaaagcaccaatttatttgtatcagggatccttaactggtgagaaagcttagaagttccacaaatgccctagtcccaaggagtggggagcatgctttatatttttctcctgccttcctcttgaaaatcagtgcttagtgagaatctctaatgaagacagaaaataagtttgagagtcactattttaactctgtcagtcccccagagcattgaaaagacaattacacagaaaaaaacttcaaatcccatccagcctgtttttttaaattgatacataacaattatacatatttatgggacacgtgatattttgatacatgcatgcaatgtacagtgatcaaacaggatatttaggatatccgtcacttctaacatctatcatttctttgtgttggaggtatttcaaatcttttcttctagctattttgaaatacatattgttgttaactatagtcaccctactgtgactgtcaccctatctaacactagaacttattccttttagctcccccattaaccaacctctcttcatctccctcaaaccttcccagcctctggtaaccatccttctactgtctccctccatgagatcaacttttttagctcccacatatgagtaggagcgtatgatatttgccttgctgtgcctggctcatttcacttaacacagtgacctccagtgccattcatgttgctgcaaatgacaggttttcattctttttatggccaaatagtcttccattgtgcatatatacaccacattttcttgatccattcatccactgaccatacagtctgtttcacaaaggtagcttcacctgtatagggccagggtccctgctccctgggccagatgctgaagaccaaagttcagggagccccagactgagctccttccaccatccagtcctcagtctcaggggccccagagagtccccagcagctgcagggcaagtcatcccctcccggcatcaagaccatctgctccttttgattctcccctattctgtttcttccttctagaaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgtgagtgcctggggtggggcctgggccaagacccagagggagacgggagggcaggggaattagagacagactacgaaggcaagtgggacccaggcactgtcttggcctgctgaatccctctcttcctggagtcagagtcatcagacattctggagccttggatgggaaagaatttagcatgctgaacacctccagcatgcacactcacacacacacaccacacacacacccaacatagtcacccactctcgtgtatacacgtatatagatttataccagaaacttgctgaaggaggcacacaaacagacatttacccacaaacataagcataaggacctttataaaaatgatatatgcagacacgtgcaacatgcacataaacatatatacaaacaggcacagacacacaagcacacacatacatacaagctgatgtctacaaccacgtcttgattctctcttctcttcccagaaatatgtgtgcacaccctagcagccacacaatatgcgtgtgtatacacacatatgcatgacatgtgcttccaagaaagcatgcacaaacaataatgtacatacacatttacacacagccccagtggggctccagtccctgctatcacaggacaaacctgatcaacatggctggactgagcttagaattggcaaaagcatctcacctatacacacacacacaccaccgtggcaccatttgggacagaaaagatcatgcctgtgctctctcatccccacccctctccctgtaggatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccatgtaagttctcctgggtccactgcccacggactctgggatcccactctgcagcgctctctcctcccagctccctgctacctctagccaggctcatctatctgtctgtccacttaaaaactcgtcaggctttctgtatgtgccaggcaggcatcgtctaggtgttgaggctgcacacacccggcccctccttcctggaactcacagcatagtgaattgccacagaaagcatgtccacagtgatttgaaaacccaagctggaaggccaggcatggtggctcacgcctgtaatcctaacactttgggaggctgaggtgggtggatcacctgaggtgaggaattcgaaaccagcctgaccaacatggtgaaaccccttctctactaaaaattcaaaagttagccagttatggtggtgagtatccgtaatcccagctacctgggagactgaggcaggacagttgctggaacccgggaggcggaggctgcagtgagctgagatcatgccactgcattccagcctaggcgacagagcaagattccgtgtcaaaaaaaaaaaaaaaaaaaaaaaaccaggggctttgttgagaaacactggagctgtattctggaaggtaagtgggaggtagctgttgaagaaagtggacagtgcagttccttcagagggaagggcatgtccaagggccctgtggttggtcgcaacagagcatatatgtgggactgaacatctgtcagcatggtcacagtgctgaatgagggagggcatgacataaggcaaggctgaagaggaagccagggtcaggctgcaggactgctgtgggccatctcgtctttgtccagagcacattaggaagactgggacctttaagtagaccttaagtaagacatcaccagacaggggttttaaaaagatgtcactggcagccaggcttggtggctcacgcctgtaatcccagcactttgggaggccgaggcaggtggatcacaaggtcaagagattgagaccttcctggccaatgtggtgaaaccccatctctactaaaaatgcaaaaattgcctgggcgtggtggtggtgcacacctgtggtcccagctactcaggaggctgaggcaggagaatcgcttgaacccgggaggtggaggttgcagtgactcgagattgtgccactgcactccactccagcctggcaacagagcgagagcgagacttcgtctcaaaaaaaaaaaaaaaaagatgtcactggctgctttcagtgggtatcaggaccagaattagaacccagctttctgggcacctaaaggagtgctcctgcccgggtagtgcgctgtcgtgggaagggagcctctgtggaataatgggtaagactctagagccaaatttcctaggttcagatcctggctgtgcctcttgttagctgtgtgaccttgggaaagtgacttcatctctgtgtgtttccatttcccttctgcataatctacctcctaggatggttatgaggattgaatgtggtgatgcttgtaaaacacacagcaagggcctaggtgtagaaagtgctcaacacgtgtgtgttttacagctgctcgtcgtatttccatgtggctctgttatccttagtcgctggtttattgtcccgtctctaaccttccccaaagaccctttagaaggcagaagcaaaggctgctgccacacctcctgttgctgccctatgcctactgcacttggaatcaaagccgaagttagaggagggcctaaaggccggccccacgtcatctggcccctcatgccctgcctgtcccctccctctctccattctagctccgtggggctcctcgccattttcccatgatccaagcccactccaaccttggaacttggcactccctggagcaccctcccccagcctccctccccctagcctctctcccttccacctttgctcaagggtcacctgcctcaccccgttctacccctctgccatagccccaatccctctagccctgccccttaatattacaaagcactaaccatgtcctaacatactgtgtcattcactaacttgctgttaatcatatattatctgcccaccatcatataagatcccgaaggacagggatttgtggctgttttgttcactgctgcatccttaatgtttagatctgtgccaagagcacaagcagatgcccggcatataattgttgagtaaaggaatgaatcgaatgaacgagtgatgtcaacaggagaggacaatgggttgggagctaacatcagtgaactggtccattttagtccatatttagcccctcctaggtacctccacattggaaatccaaagacacctaagatgcccagaagggcagagtcccaaagcattcagggaaccagctctgacccatgaagtaacttgccccgcttcacacagctactgagtgtcagagcctggactccaaccccgaaacagccactctcaagcccttcattgctgtatcatcctacagccactcaagggctgtctgtcccgcttaaataagctccccaagcttcactttcctcatgtgagaaaaggaagataatgttacctccttcatagggtcgctgtgacaggaatgaatgagacaatggatttataaagtgcgtggcatggtcccagtcctgtagtaaacactcaggaagggatagctgccatcatcccctcatctctccatcagtcccattgtttcagtccacagatgcatataaagtgcctgtgatgacataacgctagtttctggatatgcagaggcaaacagaccctaccctcgtgtatgtagagtccaaggtgcaaggcgagcacagaaaccagtcaccgcacactcccatgggtgctatggggagaatgaaagggaatgagggaaaagatatgatagggctgaagtatcccacttgatatgggggactcagagaaggcttccttgatgaaatgtcattgaagccaaggactaaagaatgagaagaagccagccaggcaacctgtaaagatacgggttcccagcaaggagagtagcaagtgtgaaggctctcggggtgaatctctgctaaggacccaaaggcagttcacacagccagggcttggtacccaagggagggcatggcgagacaccacagccacatccatcagaggcgagggtctggaatgagaccctcacagagactgcatctggggaagagcctacgtttccttcctgagacctcctccttcctggctaggagagctgggctctgggcagcagatcccagggccgctcccacagtagaaggatggaggctaagcacccttctctcttcctagaaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggtaagaaggctgtgggtcaaggtctgcggggaaggccctgggaaggcaaggaagatggcgaagatgcacaatcagatactccctgagatccaattccactttgctttgggcatgcagctggagctctggagagctctgcagatctgctactagcccacatggctccttcatgcaaattaagaaaaggtgcccatttcagcagtcattttacttccatcagttagaaatctgtcataatatattgatttcattaagacaagacacctgtccattaaaacaagatactgccatctatgagaacactgttgtaccaaatatactcatctatcatgtccacagtgagattggtgccccttaaatgatatggcacccttgtggagtgcacaacctatacaactgtacatgggagccctggcctcagtcttcctgtcagcatcatgatgagactcagtatgtactcatgagaaacagacttcaagaaaagtcttgtcactggctggggatatggatatctgaggctttggttctcaggatcccagagggcatatttatttgcataaattcaagccagcacagttctttacttgatcaactttgggttatctagagacagataattaactgagattaaggcacaatggaggcttgggacatactcaacaccccggagggactgtgtagttgtgggagcagagaaagaaaggagaaagaggaagggaaaagacaaggctctgcccccctccccctgaccactccttcaatcaattcggcttattcctgatatggttaacggtgacctctttcctgttactcttgctgagcctccttgatggtcttcatcttatgtcaaatgaggtaaaaggtaggcgacacccgccaaccacggatgagaccagcgggtaccctcttcctggttctagaacacagcggggacaggggacaacttgtctttgtggagaacacgcagccttgctcactggctccccctagtggggcttatctcccacaaccctcaccctctctggggctctccacaggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtaagtacccccagctgcctccaagcaccctgtcatctcaccaccagcagcatcctccatactttaccccagaatctcaagcaaggcaacatggcgaaactgccggggggagaccctacttgaatggatcccagcaagatggcagtggagccctcaccaagatggcagccatgggctttgacaagggcacaggaaacatggctcccccagtgcctctgcctggcagaggaggagtctctgaccctgtaattcctaaagataccctgagtataagtgggagggttattgcctcattttccgtatcacccctgaaacctctgctctgtacaccctcttcctaagactcctcagcagtctctcagtctgatcccggcagcagtgcaggataattgtgaaaacattgtccagcgggcaccgtggcttacaaagcacttttctgaataggatcctattccacgttcaaacagccctgtcaagcatgcggccccattttacagatgaggtcttagctctgagtcccattcattctcagaacaggagctttcttattccacaacccgagctcctgccactgactcctcaggtcctgtttctgcaccagaaactcccagctcaacgaaaaaggtgttagcctcttcctgtagggctcttaatattatggagaaaatcctatttctgccccccaggaaagcacagacagaaggacaaggcacggtcccccagtgagggggcctccctggaatgcaccaagagcactgcagctaggaccagaggagcaccacacactcacacaaccaacacacaccatgtgcacactcgcatccatccactccttcactcatccactcaacgcatattgaccaggtttctcaggtatgaagtactctgctcacattggagagacaatggcgagcaaaatgggtgtgacccctacactcacggggctcgtggtttattaaggaaggcagacattcactcgatcattgcagatgcacatgcgaagtgacaactgtgaaaaatgctacaaaaagagaggtacaaggttgctaggacacgcaaagtgagaagtgtgacagagacatgaagctctgagaaagctgccctggtgaaatgatgctagagccgcaatctgaggggtgaggggcaggtcactaggagggaggaggcagtgctctggctgaagttgctgcataagcaaaggccctgtatgggagcgggcagagccagggagaggcaacaggaacagcctaagtgcctgagcagcaacacacccacaaacccacaccacacaccaccacaccacacaccacacatccacaccaccacacaccacacaccaccacacccacaccaccacactcacacaccacacaccaccacacccacaccaccacactcacacaccacacaccaccacacaccgccacacccacaccaccacactcacacaccacacaccaccacacccacaccaccacactcacacaccacacaccgccacacccacaccaccacactcacacaccacacaccaccacacaccgccacacccacaccaccgcacaccaccacacaccgccacacccacaccacacaccaccacacccacaccaccacacaccaccataccaccacactcacacaccacacacccacaccactacacaccaccacaccaccatactacacaccacacccacaccaccacactcacacaccacacaccaccacacaccaccacacccacaccaccgcacaccaccacacaccgccacacccacgccaccacactcacacaccacacaccaccacacaccaccacacccacaccaccgcacaccaccacacactgccacacccacaccaccacacaccaccacactcacacactacacaccaccagacaccacacacccacaccaccacactcacacaccacacaccaccacacacccacaccaccacactcacacaccacataccaccacacccacaccaccacacccacataccaccacaccacacatcaccacacccacacacatctgatgcttgactttgacatctcttttgccaggccccatgcacatccccttttctgggccaggttagcacgtacaggcataccttggagatattgtgggttcagttccagaccaccataaagcacaaactgcaatgaagcaagtcgcacaaatgttttggtttcccagtgcatatcgaagttatgtttatactataccgtagtctattaagtgtgcaatctcattgtgttggaaaaaaaccaatgtaccaatgtacataccttaattcaaaaatgctttattgctaaaaaatgctaatgatcccctaagcctccagcgcgttataatctttttcctagtcgggggtcttgtcttgatgttgatggctgctatctgatcagggtggtggtggccaacattgggtggctatggcaatttcttaaaataagacagtagtgaggtttgtcacatcaatggagtcttcttcatgaaagatttctctgcagtacacaatgctgtttaacatcattttcccatagtagaagttcttttaaaattggagtcaaggtcaggtgccgtggctcacgcctgtaatcccagcactttgggaggccaaggcaggtggatcacttgaggtcagaagttcaagaccagcctggccaacatggtgaaaccccatctctactgaaaatacaaaaattagtagggcatggtggcatacgcctgtgattccagctactggggaggctgaggtatgagaatggcttgaacctgggaggcagaagttgcagtgagccaagatcgtgccactgcactccagcttgggcaataaagtgagactctgtctcaaaaaaaaaaaaaattggagtcagtcctctcaaatcctgctactactttatcaactgaggttatataatattctaaatcctttgttgtcatttcaacaacgttcacagcatcttcaccaaaagtagattccatttcaagaaaccaatttctttcctcatctataagaagcaactccttatctgctcaagttttagcctgagattgcagcaattcagtcacatcttcaggctccacttctaattctagttctcactattttcaccatatctgcagctacttcctccactgaagtcttgaacccctcaaggtcatccatatggttggagtcaacttcttccaaactcctattaatgttgctattttgacctcctaccatgaatcacaaatgttcaaatggcatctagaacagtgaatcctttccaaaagcttttcagtttactttgcccaaatccatcagaggaatcaccatctatggcagttatggccttacaaaatatatttcttaaataataagacttgaaagttgaaattactccttgatccatgggctgcagaatggatgttatgttagcagacatgaaaacaacattaatctgtgtgtacatctccatgagagctcttagatgaccaggtacattgtcagtgagcagtaatattttgaaagaaatctttatgtttgtgcagcaggtctcaacgatgggcttaaaatattcagcaaaatatgccataaacagacatgccatcatccagtctttgttgctatatttctacagcacaggcagagtagatttagcataataaaagccctaggattttcagaacggtaaatgagtattggcttcaacttcaagtcaccatcagcagtggcccctaacaagaaagtcagcctgccctttgaagctttgaaaccaggcattgacttctcctctctatctgtgaaagtcttagatggctacttcttttaataaaaggctattttgtctccacggaagatctgttgtttaatgtggccaccttcatcaattatcttagctagatcatctggataacttgctacagcttctccgtcagcacttgctgctttactttacactttcctgttatgaagatagcttcttttgttttgtttcgttttgttttgagatggagtctcgctctttcacccaggctggagtgccgtggcgcaatctcggctcactgcaagctccacctcctgggttaatgccattctcctgcctcagcctcccccttagctgggactacaggagcccgccaccacgcccggctaattttttgtatttttagtggagacagggttacaccatgttagccaggatggtctcgatctcctgaccttatgatccacccgccccggattcccagagtgctgggattacatgtgtgagccgctgcgcccagccggcttcttttcttaaacctcatgaaccaactattgctagcttcaaacttttcttctgcagttttctcacctctgtcagccttcacggaattaaggagagttagggccttgctctggattaggctttggcttgagggaatgtttagctggtttgatttttctatccagaccgctaaaagtttttgcatgtcagcaataagtctttctcatgattcatgtgtatattggactagcacttttaattttcttcaagaactttttatttgcgttcacaatttggctatttggtccaagaggcctagctttgatccgtcttcgtttttgatatgtcttcctcactaaacttcatcatttctatcttttgatttaaagtgagagatgtgtgattcttagaggccgttgtagggttattagttggcccaatttcaatattgtactttgtctccggaaatagggaggtccgaggagagggagacagggaacagctagttggtaaagcagtcagagcacacacaacatttatcaattaaattcatcatctttgatgggcatggttcgtggtgcctcaaaacaattacaatagagacatcaaagatcactgatcacagatcaccataaaagtattataataatgaaaaagttttaaatattgtgagaattaccaaaatgtaacacagagacatgaagtcagatatgctgttggaaaaatggcactaatagacttgcttgtggcggggttgccataaaccttcaatttttaaaaaacgcaatatctacaaagtgcaataaagcaaagtgcaataaaacaaggtacgcagtaccctcagatgtaagtgacagaacgcgacccagactcctccagagttgctttgatctgcccttctaataatgcttttggggacagaacctgaacatgccagtttcttagactagcacatggcgtgaacctccagggttcatgccattttcctggcttagcctctccggtagctgggactacaggcgcatgccaccacgctcagctaatttttgtattttttttttagtagagatggtgtttcaccctgttggccaggatagtctcgatctcttgaccttgggatctgcccacctcagcctcccaaagtgctgggataacagacacattctgacagtatcattgcagtacctgcatccagccctagagcccggtatcttccagtgccttcttcagttatctgagttgataaattctctttatgcttaaggtggtttgaactgattttcttcctctttgcccaggaggaaagctaatataccacttcataagctagctgtaagcattaaaagaccagatgccagtggttcagaagcactcagtcacattagctatgatgattgttatcactgtcatgactcctcctctatgtttttgagtggattttggggccagtcccctgggagttacccacatagagtagaagcctgaaagtgtgcagctggtatgtctcaaaggccgtggtgagtcctgtgacctgattccaggactgcagaggagacattgcatcttggcagagcggtcagcacctgtcccctttctctctgcatcttccatttcaccccactcctcaattcccatcagaggcctctctgggtgaggaagaaaatgcctcatttttacataggccagctccctccagtctgaaatgggtgcagataaaaacatgctagcctgcgatggggaagcaggtagaatgtggtagaaagagcactgggctaggagcccagaggtgagtcccagccttggttctgcctgtgccttggggctactcagcagcatctcttcccactcctgcccccagaagccacattgcagccacacctgtagcttcttgtgattcccccagtgcatatgcctttcctgacttcagggcctctgtccagggcatttatattctcccggcctagaatgttcttcactcccatccctacttaggtaaccccctctggtttctcagtctcagtcctggaagcacaagttaagaggagtgattctgaaaacaaatagtcttgggtttaaattccaactttactacctactgattgcatcactttgggcaagttacttaatctcattcaacctctatttactgatctgtgaaatggggataacagcggtatatccttcacaaggcagagggtgactaagataacataactaaagcacttagccctttgtgcagcacatagtcacggtttgatgaatgtcagtgctgattattaaccttcctttcagaaagccttttgggtggctaagactgggttaggtgcctctcacttgtatccccatggctcttctctcaggtatcgccttgtgttgtagttgcttatttacttatttccccttctagaccaagagctccctgagagcagcaattgtgtctcattcactgtttgttttctttccccctccagagttaagcacagcaactaacccgtagcaggcattcctctctgaatctgtcttgtcttcttttttttttttttttttgagaccgagtcttgctctgtcgcccaggctggagtgctggaatgcagtggtgtgatctcggcttactgcaagctctgcctcccgggttcacaccattttcctgcctcagcctcccgagtagctgggactacaggtgcccgccaccatgcccagctaattttttgtattttttagtagagacggggtttcaccatgttagccaggatggtctcaatctcctgacctcgtgatccgcccgcctcggcctcccaaagtgctgggattacaggcatgagcctccgtgcctggaggcacatggattcttgagtgtgtgttgtggctccaggcatttcccaatgctcagaaaaactgaaactagggctgccagcccaggggaaggaagggaggtcttgacagttgctaaaaagttcatgtccaccgtgagtttgagctggggtcatgccctggaagttctgtgtacaaaaatgcccccacgtgcagtgagcttcctgcccttcccttggaccgggctgtgccatgggacggggctgcagagaatgacccagttatactctccttcctgggccaattgagtgccaagtgacacatgtcaaaggacagaaatgccatgacgatagcccgtgaatgcttttccccaaagctcatggaacgaaaactgaaataacaaagataattggctgcaattataaagtaaacttcagcactttgggaggagacctgattttctgatttggaaatggtatcacttcccttggccaggcatggcttccaaagtgcaccgaggaaggcagccctcacttctttccccaaaccgtcttcctggggtggagggttgggggtaagcaggagaatgagtgtcaaagaaagtgaaagctggcagacctggagaattatggctgggagcctctggttcagagacattggctgagtccagatccagggtttccaatgcaagcttttcagctcccttgggtctcattagttatctcaggcagagctgccagcttacaaaacaaaattaagtttaattcaccaagaaaaaacaaaaacaaagttgcccagcatttctctaaagggcagagtgtgagaggctgttgcaagcatgcaagaccccagcaatgccatctgagcaggaggtgatttttttctccagtcagctctctattaaccctcactggcccttctctcacagtctcctttcagttctaccctgggtgagtcaagccaaactgagcctcattctcacattcagtcttgcaagtgctctttgaagtagggctacagtaccagttgccctctttgtctgaccccaaatcctgtgctcatgcccattccaccagaggctcttaaatgtttaggtctcaggactcctttatgcttttcagaagcatccaggactccaagaacctgtgtttatgtgggttatagctattgatattgatcatattactaacactgagaaaatgttaaaatatgcattaattccatttaaaagtaacaattatatacccatgacatgtttatataaaaagcacatttttaagacaaaccaaaagaaatgcaggtgagaagagtttcattgttttatatttttgcaaatctttttaatatctagcttcctagaagacagctcaattttcatatctgcttcaccattcactttgttgtggtatgctttttggatgaaggataagaaatttggcttcacacagaaatgtatttgaaaagggaggagccgggtgcggtggctcacgcctgtaatcccagcactttgggaggccgaggtgggtggatcagctgaggtcgagaccagcctgaccaaaatggagaaaccccgtccctactaaaaatacaaaatttgccagacgtggttgtgggcgcctgtaatcccagctacttgggagggtgaggcaggagaatcacttgaagctgggagggtgaggcaggagaatcacttgaagctgggaggcagaggttgtggtgagctgagattgcgccgttgcactccagcctgggtgacagagtgagactctatctcaaaaaaaaaaaaaagaataaaaagaaagaaaaagcgaggaatactttaatagtcttttcaggtaattatgggtgttcttctttgattaagaccaaagctcaacaagtggcattttcttaaaggctagttgtagtgtggaactgcacttgtaccagtgaacctttggtcctctgttacataactctaccgatctgtcttacgctttgaatggaactttccccatgcacgatcttgtaatatcatgtgttggtcaatggaaaaatatcggttcactgagttatgcagatcttccaaatgctaacacatttcattatacaatatattttttaaataatgtcctttgatatcaccgctgatctcatcagaaaagtctttaagtgagggaaagttgttaagctcaatgtggcagtgaaaagttttccaaaattttaatttttacttggaagcacgaatttatcattggcaacaaatactgtgagctgcttttttttttttttttttttgagatggagtcttgctctttcacccaggccagactgcagtggcgccatctcggctcactgcaagccccgcctcctgggttcacgccattctcctgcctcaacctccccagcagctgggactacaggcgcccgccaccgcgcccggctaattttttgtatttttagtagagacggggtttcaccgtattagccaggatggtctcgatctcctgaccttgtgatccacctgcctcggcctcccaaagtgctgggattacaggcatgagccaccgtgcccagcctgtgagttgctttttttaaagtgatgggcttactttgttcattttcaagaaattatctactaaatagccatgtctgaataatgagtttgccagtctttcttttaggtaaaaacagtgttccatgaaaaaatgtaaaagccagctagttcagcttgcaactcaattacacaggtacttttctctagacaaccaacatgctgtgtgtgtacatctcccattttgtcatacgggacattaaaggaatgtgtgctcaagagttgaatgttaatacaaacaataattcttggtacttcatcaagggcattcctggttttggtaaaacctgcaagtgcacagaggtgaagaatacagtgaccaccagtttcatttggtagcgatgtcctgattcatgctgaggtgccagcagttttaccctccactaattttgtaccatcagtgcaaatgtcaacacagggcaaaaggaaaataacattttaaccttattgtaaatatagttttggcctcatagacccctgaaaaagcctcagggacccccggggtctatggatgacactttgagaaccactctggtcattacatattggtgggcaatggatagagagagataactgctctaagtcagcacgaagttcctaatttaaaaggcaagcttacagaatcttatggaaagcaggacagaagcaaatacaggacatctcagccctcaaagtcaccagaatactctctgtgaaggtagggcctcactgccttcagaaagtacaattattgccatgcaactgtccttttaaattcatgcttacctcactattttagaactgaaacctaaaaatctgcttgcttccatttatggaaatgtttacaaacatcaggtttcctggttctggaaacaaactctgcaaagcctacatcttcataacggttagagaagaaatgcagaatccagtgctggtgaacagctttcccccatatctacccctggttaatatccatgatgtttagacatatatttttggtctaaggacaatgagcatggatttgttgtcctataacttgatatcccaaggaaaagaggggggaaggatgacatagctccaggcacaactattggaagaaaggatttgtattaggatgcggggtctgagaacactgtgggaagcaggctggcagtgtgcatatgcatgtgcatgtgtgtgtgtgtgtgcacagcactgacaggagacaggaaaaggatggggctcaaccaggaggtaggagggcacagggctgagatgcaactctctgagagtgagtgtggcaagaggtgatgacaagaatgcactggttgaagaagcaagaaggacctggcctggcactgtgtgggttccaaggagttaggggatggaggtctggggtccagaaagctcagtggcacttggtcctcatccatagttttattgggggagacatgcaggcaggagaagggggagtgcgacgcagcagatgacaagcacaagggagtggctcaggcaatatgtgctctgggaagagaggaatccaggaaattctgcccacctggcctttaagaaagcaagcaagaatgtcctgcctatgctacaaaccaccacagccaccatttctagagcatttactgtgtaccaagtgctgtgctgggttttcttaataggtaatctcatttcaccctgctaacaactcttcaaggcaagtgtcattattcccattttgcaggtgagataaccggagctactgaaggttgaataatttttgacgatcacactgccaataagcagcagactatagactcaagcccaggtccatctgaccccaagtcctccctgtggcagaaacccaggtccctatgtgttctgcccagtggcctggcttgctgggggcttacatgggtcctcttgaaaactgacatctgcattgcagcagggaggaggcaagcccaggcactctgcattgcagcagggaggaggcaagcccaggcactctgcattgcagcagggaggaggcaagcccaggcagcctgccatgaggctataggtacctgtcagtggttctggctatgtccatcctgacagctgggccttctctagcaaggcaagctgctgcccgagaagagcctgctgcttttcatatcccccatgctccccagagcacttaatagaacaactgcccagcactgactacatccttgacattctctggcccagggagagagactgaaatgtgcctccagccagctggaggggttgatcacatctttggagagtggaccagctctgggcacagcagcacttatgagtcctggcacaggctctggcccagagaagacctcagcagatggcaccagtagaggacacttctccacactattggacagtgacagccatctatgggaggggctgtgggtggcctgagcacaggccgagagctgagaaggctcccttccattcattgagttcattgtgccacacactgtggtagcagctgaaggtacagtggctaccatgacagataagatcccttttctcagaaactgagagtaggggagaaagacagtaagaaaaccgaccagatcaggcatttcacaccaggagtagagggggatttcccaggaaagtaaaggagggaaacagagtagaaagaacatgttttatgaagacctcaaggtggaaagatcttaaattcaagaaaccaagaaggctgtgagatggagcaaataggatgacaaagagggtgatgtgtgctgaaagcttgagaagggatatgtaagttcttgtaggtatagggagagctgactccaagagaaatgcaggaatccaggaagaattttaagtggcatgatccaattctcattttagaaatactaccctggaggaagaagaagagaatgaacagcaagaggaacattatctttcaataagctatgtgtattattggatggagatgtgtgtgtgtgtgtgtgtgtgtgtgtgtgtgtgtgtgtgtgtgtatctatctgtctatatgtatgtgtatgtatatttaaaatgtgttggccaccagtgtgccgggtactgctctgagaactgttcacagagactcaaatttaatcctcagaatcacatcaaggtggtgatcattataagctttgttttacaggtgactaaatgtaagctcaaagaggttaagtacttcacccagggtcacacagctcttagatagtagagccaggatgtgagcctcagctgcctgacccctgagctgcccccacatcactccaggactctagtggaaattctggcctggagcagagtctctgggaaggtggcttccctccctctccattaacatcagctggtttgagttctttgtggggcatcagtcagcaccccaaagctccaaacaggaatggggaacacccattcacagagatctgtgtggagtttcatgcaaggcagatgtgtccttgtgtgtttgcactggggctgaaacagagcatttaaatgcaggccaaatgcaaagggtgacctgccagaaacactccggcagttctaaggctggtggggcaagagggcagtctcctgaaagggtccctctgggagcctggactgtaggctacagacaactttggagttcagagttttcatgaagggcctgctacaaagagagctctccccaccactgcatctgcatttctgatgtgaaagctttgattctgagtcttctgagctgtgctgccaggtcgccggggacattctgcactgaaagcaacttgtgcttggctccatcatgccaaacgcagctctccctgaggagttcaggggttttcatcacacagatgacgtttcctgagcatctgctgttgccaggcagagtgcgagaatgctgtggtgagccaagcagacatgattctgcccacattaatcacagaatcacacgaaagatgtcaccatgggggtcaaatgctgtgatgaaaagacagccaatgctttggctgtcttatataactttaggccaaaagcacttaatagacatttacagagattctacccaacaactacagaatatacattcttttcaccagcacatggaacattctgtaatatcaccagcacatggaacacctgtaatatcattggtaggtgtgggaactgatattgaaaaactaatgctggagctgagatccatgcatctgtaggagttaacctggcaaggagggaggagagacactagtgtgtacaaacacctgccccccaccagaggggatggggcattttaggaaggttaaggccagtggagttggaaccagaggtcaagggaaagtctgataaaagatgaaccaaagacaggaggcagggctctaacagttaatttcctgtctcaactgggtaggctgtggtgctcggttgtttggtcacatacttggtctagatgttgctgtgaaggtattttgtaaatgcaattaatatctacagtcagttgactttttaaacaatatatttaggaggtacaagtacaggtttcttacatgcatatattgtgttgtggtaaagtctgggcttttagtgtacccatcacccaaatactgaacattgtgcccaataggtagtttttcagccctcagcaccctcctaccttttgtagtctccagtgtccattattctactcggtatgtccatgtgtacccattgtcatgctcccactcataagcaagaacatatagtatttgactttctgtttctgagtcatttcactgaggataatggcctccagttccatccacattgctgcaaaagacaggatttcattcttatttatggctgagtagtattcaatgtatatagatattccacattttcttttttttttttaatttttttttattttaagttccaggatagatgtgtgaatgtacaggtttgttatgtaggtatacatgtgccatggtggtttgctgcacctatcaacccatcatctaggttttaagccctagatgcattaggtatttgtcctaatgctctcccttcccttgcatcccaacccttgacaggccatggtgtgtgttgttcccctccttgtgtccatgaatatacaccacattttctttatccaatcctctgttgatggacattgaggttgattccgtatctttgctatcgtgaatagtgctgtgatagacatacaagtgcaggtgtcttttggatgtaattatttatttctctttgggtgtttacccagtagtggtgttgctggatcaaatggtagttctatttttagttctttgagaaatcaccatactgttttccgtaaaggttgtaccaatttacattcccaccagtagcatatgagcattcctttttctccacattctcaccaaaaatctgttgtttttagactttttaataatggtcattctgctgatatgatatggtatctcactgtggttctgattggcatttttctgatgattagtgatggtgagcatttttcatatgtttgaccaattgtatgtctgtttttgagaaatgtttattcatatcctttgcccgctttttaatggttttttttttcttgtcaagttccttatagtttctggatatcaaacctttgtttaggcatagtttaaaagtatttttcccatcctgcaggttgtctgtttactgttgtttcttttgctgtgcagaagctttttagtttaagtcccatttttataattttgtttttactacatttgcttttgaggacttagtcataaatcctttgcctaggccaatgtccaaaagagtttttcctaggttttcttctaggatttttatatttgcatgttttacatttgggcctttaattcattgtgagttaatttttgtatatggtgaaaagtatgagtccagtttcattcttcatcatatggctatccaattttcccagcaccatttattgaatagggtgtcatttccccagtgtatatttttggctttggtgaagatcagttagttgtaggaatgtggctttatttttgggttctctgttctgtaccattgatttatgtgtctatttttataccagtactgtgctgttttggttactatggccttgtaatataatttgaagtcaggtaatatgatgcctccagctttgttctttttgctcaggattgctgtggctatttgggctctttgaattatgaatatgaattttaggattttttttctaattctgtgaaaaatgtaccaaatgacattggtcatttggtagggattgcaatgaatctgtagattgctttgggcagtatggtcattttaacaacgttagttcttcaaatccatgagcatgggatgtttttccatttgtttgtgttgtctacaatttcttccatcagtgttttgtagttctcctgatagacatctttcacctccttggtgaaatatattcctagggttttgtttttgtttttgtttttgtccttgtcttagctattgtaagtgggattgccttcttgatttggtccttgactagatagttattggtgtttaggaatgctactaatttctaaacattaattttgtagcctgaaactttactgaattcatttattaagtctaacagttttttggtcaagtatttagtgtttattttctagatataagatcatatcatcagcagaaatatttgacttcctcttttccaatttggatgccttttgtttctctttgctgattgctctggtgaggacttccaatactacactgaataagagtggtcaaagtgggtattcttgtcttgttccaattcttagagggaatcctttcaacttttctccattaaggatgatgttggctgtgggtttgttgtatatagcctttattatttgaggtatgttccttgtatgcctagtttgctaaattttatcatgaagggatgctgaattttctcaaatgctttttctgcatctgttaagatgatcatatggtttttgtccttatttctgtttatgtgatgcacatttattgatttgcgtatattgaagcatcctttcattcctggaataaatcacaacctgatcatggtctattatctttttgatgtgctcttggattcaatttgctagtattttttttgagaatttttatgtctattgtccattcaggatgttagcctgtagttttcttttttcattgtgtccttgtctggttttagtattagggtgatactgacctcatagaatgagtaagggagaattacttccttctcagttttttaaaatagtttcaggaggattaatactagttttttgtgtgcttgttagaattcagctatgaattcatctttggatttatggtcctgggctttttggtggcagtttagggggggatattttgtattactgattcagtctctctacttattaggggtctactgttcagaagttctacttattcctggttcaatttcaggaggttgcatgcttccgggaatttatccatttgctctagattttctagtttgtgattgtatagttgttcataatagtctgatgatcttttgtatttctgaaatatcatttgtaatgtctcctttttcagttctgattgtatttatttggatcttccctcttcttttcttggttagtttagctagtgatttatcaattttgtttatctttttgaagaaccaactttttcttttgttaatcttctgtattatccttttggtccccatttcatttagttctgctctgatttttgttatttcttttctgttttgttgttcatactagaatccttagtctcagcatgatctttgttatttctcttcttctgctaactttggggttgttttgttcttctttttctagtttcttggggtatgatgttaggttgttaatttgtgatctttctacctttgtgaggtaggtattcaatgctattaacttccctcttagcactgcttttgctgtatcccataggtttgggtatgttgttttttcattttcattcatttggatttttttttaattttaattttaatttctttgttgacccagtggttgttcaagagcacgctgtttaatttccatgtatttggatagtttcaaaagtttgtcttggtattgatttctagccttaaattaccgtgatctgagaaaatacttgatataatttcaggttttttaatgtgttaagacttgttttgtgggctaacttgtggtctatcttggagaatgttccatgtgctggtgaaaacaatgtatattctgtcattgttgggtagaatttctgtaaatgtctattaagtccatttggcctaaagtccaatttaagtccagtgtttctttgttaattttctgtctcaatgatctgtctagtgctgtcagtagggtgttaccaagaccctactattattgtattgtcgtctgtttctttcattaggtccagtattatttgtttgtgttatttgagttctccaatgttggttgtgtatgtatttaggattattacatcctcttgctgaattgttccctttgtcattatctagtgaccttttttgtcttttttttttactgttttatgtgatatgtcttttttatctgatataagtgtagctactcctgctcacttttggtttctgtttgtatggaatatctttttcaacccctttactttcagtctatttgcgtctttatgggaaggataagtttcttgtaggcaggatatagttggatcatgtttctttatccattctgacaatctgtatctttaagatggagcatttaatccatttatattcagggttagtattgatatgtgaggctttgttcctgtcatattgttgattgttttcaagttgttttataaattccttgtttctttctttttctgtctttgtggtttggtgaaattctgtggtgttgccatttgattcctttctcttcttcctttgtataattgttttatatgaactgtgagttttatattttcatgattttttgtgatagtgaatatcgacctttcattttcacatttaagacctcattgaacatttcctatagggttgctctagtggtggcaaattcccttagtatttgcttgtcagggaaggactttatccttaatttataaaatttattttggcagaatacaaaattctgggctgacagtttttttttttctttcagcactttgaaaatgccatcacatttctcttctaacctgtaaggtttctgtgaaaagtcttctgttagtctgaggggtttcctttgtatatgactccatgcttttctcttgctaattttaaaatcctttatttcacttttatattaaacattctgaatataatatgctatagagatatcctttttgcaatgtatttgcctgaagatttctgggcctcctgtaaatggatgtctaactctcttgacagacttgggaaattttcatcaattactttctcaaatatgttttctaaactttttgatctcttttcccccttggtaatatcaacaattcataagtttggtcactttatgtactctcacatatctcaaagcctttgttcattctttttattcttttttccttatttttgtctgactggattattttaaaagacctgtcttcaagttctgagattctttcttctgcttgttctagtctattattgaaattttctaatgtattttgtatttccttcaattaattttttagtttcagaatttctcagttggcttttttttttgtttctttggtttttttttgagacagagtctaactctgtcactcaagctgaagtgcagtggtgtgatcacagctcactgcagccttgaccttccaggctcatgcaatcctcccacctctgcctccctagtagctgggaccacaggcacatgctaccttccccagctgactttttattttttgtaaatacagggtctcactatgttgcgcaggctggtctcaaattcctgggctcaagcagtcctcccactggcctcccagactgctagaattacaggcctgagccactgcacctgggctttggcttttttattttttttaagatgtctgtgtccttggaaatttcttatttatagcctacattgattttttaatttatttgtgttggttttcagatttctcttgcatctcattgagcttctttaagaataacattttcaattctttacctggcatttcaaggaattctttttgattgggatctgttgctggacaattgtggtcctttggtagcatcatatttccctgctgtttcatgtttcctgtgtcattacttggatttctgaacatctggtgtagcagtcacttgttctaattgtttgaaattgcttttgtaggggagaattttctctgaggatatatatatatatatatatatatgttgttgattaagatactttgggtttgattttgagtgcctgtggtagtgtgatctttgtatgaattcctcggcagggcataggatcagtggtctctataatcacatcctcagtgacttagggtaccattattagttgaggtggtggtgaagtttagctggagatttacatgcaaactgagccagtctttgggccccagtactggcagcatagaatgagcagcatagaaggtgggaagccactgtcaatctcaggtcataccccttcctagcaactccctcggatctccctggagaagagatcctccctggaccagcgcttctctgcctgtcctgctcattcctccagctcctgcctccaagctccccatagccacactgtccacagaacacttcctgcaggtgtgtgaattatggcccaacagtttgtcctccccttcttcagcctgcacagagcagagcctccctgcccaaaggaataagctggatacataccccctcccagtgtctgctccttcccaccaccggctgagcccctgcccctgtttggggagtagggcaagcattcactcagaatgcaaataccccacagcctttcatgcagggagggcagagggtgagtacagatgagaggcctgaggaagctctgcaacaccagcctctgcccttgtctgcagtcatggcctctcattgtgctttgaataaaataatctccaaggcctcagcgtgatctaccctgtctcccactgtcctctccaggcccatgagacttcagcccctcagcctgccttctctgccttggaactcaagctctggactgtccacaggctgcattcttgccagactcttccacctcccctgctctttccaagtcttcacccttttcacctaccaatcctcatctgaaaatatgtcctcctcagctgtgcatcttccttttttttctttttctttttttttgagacggagtctcactgtgttgcccaggctagagtgcagtggcaccatctcagctcactgcaaccttggccttctgggttcaaatgattctcctgcctcagcctccctagtagctgggactacaggcatgcaccaccacacctagttaatttttgtatttttagtagagacagggatttgccatgttggccaggctgctctcaaactcctggcctcaagtgatccacttgcctcagccttccaaagtgctgggattacaagagtgagccaccgtgcccagccagcatatttctttttttttttttttttgagacacagtcttgctttgtcgcccaggctggagtgtagtagtgcaatcttggctcactgcaacctctgcctcctgggtttaagcgagtctcctgcctcagccgcctgagtagctgggattacaggcatgtgcctccacatccagctgtattttttgtatttttgtttttatttttgttttgttttgttttgtttgtatttttaggaggggggtttcaccatgttggccaggctggtctcaaactcctgacctcaaatgatccacatgcctcggcttcccaaagtattgggattacaggcatgagccaccacacctggctcttcaactgcatctttctgcagtaagccccttggtgtttccttgctccttcccaagaaagcacagattgcaattcataatttatatttctttatacatctgcctgcttgctctcctgtatgcactgtctctctccctgcctccctccctcccctccctccctccctccctgcctccctctccctccctgcctccctctccctccctcccttcctccctccctctccctccctccctctccctccctccctgcctccctcttcctccctgcctccctctgcctccctgcctccctctgcctccctgcctccctctccctccctgcctccctctccctccctgcctccctctccacctatatttgatttttaattgcctgaaagcaggaattatggctcttattcaccagtatatacgatacttggtacatcataatcgttcaataaatacttgggcttgaatgaatgcatgcatgaatgaatgcatttctcttggcttttctgtctgagggcacaatctaagcatgtgcatgactgaattttaggctccctgagacagaaatggaatctggttcatctttgtatttctcccaggatctagcatagctcttggcccataatgtgtacacaatcgaggatcaaagcaaaaggacatcagtccaatatgccatggccacctaagaccttattaggtccagtccagcaccctgtgccatgagagtccccaggggccagccataggaggaaagttacttggtcttaattaaacaattaaagataatgcacgttccaatgtggccttaaagctaaggctggttcagtcattgacaccttgacccatattctgttttaacccatttctatcccatttagtcattttgtggtaggtctactggacaccaggtagtgtgctagcaccttattactcaaaatgtggtctgcagaccagcagtcaccaccatcacccaggagctcattagaaatgcagattctccaaccttaccccagacctagggtcagaatctgtggtctagcaaaatccaggtgatttgcatgtatgttgaagtttgagaagcaccaggctagcaagagatagacctaggtctagcctcatggagcttaaggcagacacttgacaaatggacagcagtggctatgtgttgactcttataggagaggatgctatgggagctttagatcaccaaggagatcaaagcagttcttgtaagccatcttaaatgttcttcagctttgtcctgagagcaacagaaagcctggagaaaggggtttacagcaagggtggcatgtccccacttgaggatagcattaacttttatttataggtaggaataacctttgtaattcatgattacataattacaatgagacgttcttatcttaagccacacttgagtctctaaggaggcggcctcatcctaggtgagcaggtcagtgtaggatgctgaagtccaggcagatcttagctcagcctttgcatgtccagaaggagtccccatctgttgggtgcaacctcactctgaacccctgtcccctcctgccatgtagtccttctgctgggaactgtagtacagtgctccaacaacagagatagccccccatttcctcagtttccaaatgtacatcagagatagtcaacattgaattagggttcttaatcatgcctggctcagttctcccaacagcttccggaagctaagtgtggaattgtggtaagactacagtcagagctgggttcaagtcctagctcaaccacttgcttgctgcatgaccttgggcaagtgttttaacatctctgaacttttcttcaactgtgacttcctgctacataaggatattttgagggctgagtataaaatgagtgctttatttattaaacaaatatttattgaatacctactatgtatcagctctgtaaacagccacggggggatccaacggtgggcaattttagacaagaatcctgccaacatgaaatgtataagtccagtggagaaaaaaatgtcattcattggataatcaaataaatattaaatgacaaatatagtaatgctttgaagttggggagggaggctctaagagtaaaagagggacctaatccagcctggaaagtcagggaggcttctctgaaaaggtgagaatttgtacagtgtctctttctcaggtgttgtctctccacacctctttcaggtacctggaaggaaaccacctaacagccgtgcccagagagctgtccgccctccgacacctgacgcttatgtaaggagcccagtattgggtgggatgtttatttttccctgctggggtcgctcaggaaactgaagtggatggtaagagagaacagagctgcaggctgatgcaagtggtaattgaaagatgcctgtctgcttaggaccagaagccagtctgcaaagggaaagtgggagatcttgcagaatgaaagagcattacccttgggaaagtaggagaccttctctgaaaagctgaaagaacaccatctctctgtgggatggattcctataaactcctgaaaccagcctctagataaggatttctcaacttcggaactatggacattggggttaattattcgttgttgggaggctgtcatagacattataggatgtttaacaacatctgtggcctctacccactagatgccagtaatacttaccccagtattgacaaccagaaatgtcttcagaccttgccaaatgtcactgagggagcacaagtgcccccagttaagaatcactgctctaaagcaatggtcctcaccatcagctgattagaggaatcacctgagcagatttttttcaagctactgatgctcaagcccatgctagaccaattaaatcagaatacctgggcatggaactcaggcatcagaggatttaaaagctccccaggtgattctaatgtgcagctaacattgccacagctctggatgtttatccccgcagggaagctcgaggttgcagctggcagaggactgcacccccaccaacctcagtcctcctaagacagaacctgataagacggagtaaatgaatgccagaaaagaagggggatagaggaacagtgaaaagaattaatcaggggaaaaaagtactaaaacaaggagagattgttattatatgtatcatattttgttggtacagtgaaatggatgaatagtcatgtaactgaatgattgactagctgcataagtgaatagatggataaatgaatgacagttgcttgaatgattgaataagtgtttgaattgaaaatgaccatttggatgaatgagtgggtggatgagtgagtagataagtgggtggatggatggtgggagggaggaagggagggtgggatggatggatgggcaggcaggcaggtgactgcctgggataaatatgataaatatgtgaggggtagatgggtaagtgggtgggtgggtagatgtatggatggacggatggatgggaaagcggatgggtgagcaggagagtagataaacaggccagcagcgggatggatagatgagtgagtgaattaatgaataggtgggtggatgggtggatgggtagatgagtgggtggatggcaggtatgtgtgatacttgggaatggcctcctacagatgcaactaagacaaaagcatgacccctctgttttacttttcctagtgacctgagcaacaacagcatcagcatgctgaccaattacaccttcagtaacatgtctcacctctccactctgtgagtacactgagatgctgtgtttaccatgcccttgggcctagcagtagatggttactctttccctccctcccagcaggactagtttctctgccctaatgaccctcaggcctatggctgccctagcataagatacaccttaatcatcagaaggaagataaagtaggaagccctccactgtccaggcagttagagaggaactagaacctcgtcgcttctgaagaaggctgtcttaggaataccttttgtggtttgtgaattttctttcccggaaatggttttcctacacaattatattttgctcacacccatttatttcccattagctttacacattgtgagtactcatcattggacaggagagagaggtgacgaacaagctggttagaaagccagcctgccacagaacttgagtaaactgaggaaataaagccagtgcgcttcctggattggtgaagaggtttcttgtccctttaggggatgttctgtcaatatatcaacattgaaaagataaaccatttgctttgtttcacaacgtgaacagtgcacctatgcatggtagagaatagaaagacacaacagggcacatgcctccttttccacaggatcctgagctacaaccggctgaggtgcatccccgtccacgccttcaacgggctgcggtccctgcgagtgctgtgagtaccccaatgtgctgattttgacttacacattgctgagtgacagcaggaagcagactaagcactccccttccccactctctgcccaaagcccactccacccccaaacacaccttcctacccagcacccttatttgctcagtggagtagagagagctacctttgagagtctgccattcccagggtccagcgcactaccactgtggaaccttgagcaaatcactgagccccttcaactttctgcttctttatgtgtaaaatgggatcaatagcacctcctttgtgaggattaggatatgcaattgtattctaccctctagtattgagcatagtgtgtggtcatagccacgtttcgatgatcattctgttgacagttgtttcctcagaggggcaatgcagcatggtgaacctctgcatggaaacagctcctaccccagagatcacaagctggaaacccagggcccccgtccagctcacagacagctattagttagcaattgtggggttggctcatagagtgtctttttaagaacacaaagcttaataagctgtcaacatttaaatatcagatttcttccacaaatcccactctctatattcttttggaaaattgagagacctggccgtaccagggccctacccctgcattcctgcatggctgagcagccctgcccctttaaacagagttgtgcaggctgcagcctccacagccggcccactctcctcgcctgcctggccctgtcctacacatgggtagctgagtgtcttctcatccataaaatcagataattatggtaattgcctcacagggtcttatgaggattaaatgagatactgtatatgaagtacttagtgcagctctggcactgtaaatgcttaacaaatattcacttgttattattcttatatcacagcttgctagggcaggaaggcaccccaccaccacccccaatcctgggcctgattaacacctgatttttgtgccttcccatcttgcttctattttattagcacattcctttgaattcctttggtcctttgaatatcacccttgaatgctattcatgaaaacagagatgccagatactccgcccccaaacctatcaacttcctgactttctagatcattattactataatagtgatcaacatattttatgggacagttttcttcgtctaaccttttgcaacactgctgtgagaccaagacagttctgcccattttaaacatggagaaactgaggcccagactggtgaagtaactggccaaggtctagcagtcagtaggttgcagaatccagcctcctgggacccgggagccattccagggccgagtagcaatccacaaacagcacccaacaagctagtccatttcagagcctccaggctgatgtgatttattgaggcccacaaaacaccggtgtcagtgacaactcccgccacatgtcatctgcgctgttattaaaaatcaattctctgggggcaaagaagtgcccgcgctgacagtgtgcaatctgttattgtcacttatttattatccaccttctctggggagtttgagaatggatacatcagcacaaccatttccctgtttccagttgaacacagcaggagatgggctcgtatcactggccagggctgaagccggacctgctcccccttccttctcctaccattccccctcaatcccaacctattgtcttccatcccagtctaatagttccgtgtgtgggttcactgccaggaggtgggacctgccaattttaaggaatctgcatgcatctgttcataattagagtagtgatgtttggggcaactcaatatgtaagagggagagaaaatgtttgcccgtccatctgtctgtcttttggggtggtgggggtgatggggtgaacaccaccagcctgaccagggttttctctttcctcagcatcatttgtcccagtctggcactactactgccatgagttcatcagcggtacacgtaaccatacaacacgctagcacttgcttcttgaaatacgaattagtaggcttgccccagcatggtggctcacacctgtaatcccagcactttgggaggccgaggtgggaggattgcttgagcccaggacttcaagactagcctgggcaacatagtgaaaccctgtctctaccaaaaaattcaaaaaattagccaggcatggtaacatgcgcctgtagtcccagctacttgggaggcggaggtgggaggatcattggagcctgggaggcagaggttgcagtgagctgagagcacgccattgcattccagcctgggcaatagagccagaccctgtctcaaaagaaaaaaaaaagagaattaataggcttttagcatcatcattttagaatcatgagatcttgtgcataaaaagggatcttagagcacctcagtccaaccatctacctcagtggggagcaaccattttctgcctaagggccaattcaggaaaagtaaaaatgtcctttctcccactaattacacacctaggaatttaggttaaagaatcatccaaaatgagggaagattctgtgcattaaaatctttgttgtactgttatttttaacctaaattttaagtattacctacaagggccacagtggggaaatgtttaaggaaaccatgaggcaaccagtcaatgaagtacaattattaaaagaggcaaagatgaaaactagatagcaatgtgggaaagtgcttatcacatagcgttacatggagaaataaacctaacttgtatatatgttacaattataacttgtaaacatttatacctatgaagaaagactgtaagagagcaaatgaaaaaaattgtgatagttagtgtttatataaagtcatttctataacaaatgaaggcaaagttgaagatgaatgaagaccgggcatggtggctcacgcctgtaatcccagcacttcgggaggccaagacgggtggatcacctgaagtcaggagttcaagaccagcctgaccaatatggtgaaaccctgtctctactaaaaatacaaaaattagccgggcatagtgatgtgtgcctgtagtcccagctactcaggaggctgaggtgggaggatcaattgaggcaggcaagtggaggctgcagtaagcagtgattgagccactgcactccagcctgggtaacacagagcaagaccttgtttcaaaagaaataataaatcaataaagatgaatgaagatggtaacatatttacaactgagggagttggaagaaagattggctttttaaaatcaggaattacattatctgcaactgcatttgaacatttgtatattctttcctcatttctgaggggtttcattcttttaattaaactttcagaaatgaccagagacccagagatgttgggtgtttgcggcagcaagaagaatgagcatcaaggtttagtttgggcgtagacaaaggccaaaaagtgatctggaaagcaggaagagaaaactgacatttaagagagagagagaaagagagagagagagagaatgtgtgtgtgtgtgtgtgtgtgtgtgtgtgtgtgtgtgtgtgtgtgtgtgtgtatgggtggatatgaatacatttcaggagagcacaacaggagggtggtcttttagccctgagtacaaaacattgtgtggaaaatgctttttctacttggctccgaatctgaaaatagcgaaaagagaacattcttgtggacatcttcatccatcttaggggatccatgcattccctgatctttgctccacaccaagtcacatgccttgtatgcgtgtggtcccaactgtcttgccccagtcgcaggagggccacctggaatcagttagctctgggcaggcaatttcagtgtgtgctcacgaaggagccagtgggattatcattcaccatcctcagtatctttagctcctagtccccgaagtaagaattgtgctgtttatacccacggggctgttcatcactgctctaccaattgcctgagttctccttaaaacatccctgtaagggagccctttgcttgattaccttctgagacaaagagatcactcccttaccaggcaactctattccacttttgaccagctattagagcatcagaaaattcttctgctgagccagaaggtgactcactgtgacctcccaaccatggtccagggttggcactttgacatctgtaaaataaaaataagtaaacaaaagtttaattgcagaatttaggattgaagagtgaatattgaaaatttttctgtccaaacgtttcatttataagaagaaaagacaggccgggtacggtggttcatgcctgtaatcccagcactttgggaggccgaggcgggtggatcatgaggtcaggagatcgagaccatcctggctaatatggtgaaacctcgtctccactaaaactacaaaaaattagccggacgtagtggcgggtgcctgtagtcccagctacttgggaggctgaggcagcagaatggcatgaacctgggaggcggaacttgcagtgagcagagatcacgccactgcactccagccttggccacagagcgagattcggtctcaaaaaaaaaaagaaaagacagattcagagaggtttagtgacttgttcaagatcattgtcttattcatcctttcctgaatacctgctaccggttagttgctgtgcttaactctggagggggaaagaaagcaaacagtgaatgagacacaattgttgccctcagggagctcttggtctagaaggggaaataagtaaataagcaactacaacacaaggcgatacctgaaagaagagccatggggatacaagtgagaggcacctaacccagtcttagccacccaaaaggctttctgaaaggaaggttaataatcagcactgacattcatcaaaccgtgactatgtgctgcacaaagggctaagtgctttagttatgttatcttagtcaccctctgccttgtgaaggatataccgctgttatccccatttcacagatcagtaaatagaggttgaatgagattaagtaacttgcccaaagtgatgcaatcagtaggtagtaaagttggaatttaaacccaagactatttgttttcagaatcactcctcttaacttgtgcttccaggactgagactgagaaaccagagggggttacctaagtagggatgggagtgaagaacattctaggccgggagaatataaatgccctggacagaggccctgaagtcaggaaaggcatatgcactgggggaatcacaagaagctacaggtgtggctgcaatgtggcttctgggggcaggagtgggaagagatgctgctgagtagccccaaggcacaggcagaaccaaggctgggactcacctctgggctcctagcccagtgctctttctaccacattctacctgcttccccatcgcaggctagcatctgtttttatctgcacccatttcagactggagggagctggcctatgtaaaaatgaggcattttcttcctcacccagagaggcctctgatgggaattgaggagtgggatgaaatggaagatgcagagagaaaggggacaggcgctgaccgctctgccaagatgcaatgtctcctctgcagtcctggaatcaggtcacaggactcaccacggcctttgagacatacaagctgcacactttcaggcttctaccctatgtgggtaactcccagaggactggccccaaaatccactcaaaaacatagaggaggagtcatgacagtgataacaatcatcatagctaatgtgactgagtgcttctgaaccactggcatctggtcttttaatgcttacagctagcttatgaagtggtatattagctttcctcctgggcaaagaggaagaaaatcagttcaaaccaccttaagcataaagagaatttatcaactcagataactgaagaaggcactggaagataccgggctctagggctggatgcaggtactgcaatgatactgtcagaatgtgtctgttatcccagcactttgggaggctgaggtgggcagatcccaaggtcaagagatcgagactatcctggccaacagggtgaaacactgtctctactaaaatttaaaaaaatacaaaaattagctgggcatgctggcgcacacctacagtcccagctactcaggaggctgaggcaggagaatcgcttgaacccaggaggtcgaggttacagtgagccaagatcatgccactgcactccagcttggcaagagagtgagactctgtctgaaaaagaaatatgtaggctgggcgcagtggctcatgcctgtaattccagcactttggggggccaaggcaggtcgatcacctgaggcctggagttcaagaccagcctggccaagatggcaaaaccccatttctaataaaaatacaaaattagataggcctggtggtgcacatctgtaatcccagctactcaggaggctgaggcaggagaatcgcttgaaccggagaggcaaaagttgcagtgggccaagatcgtgccactgcactccagcctgggcaacaaagtgagactgtctcaaaaataatcataaaataaaaaataaaatgtacctctgcctctcgccctgttttcctaagtggatttcattctcaggcagtctttctctatttaagacacagagggtcctgatgggctgaaagtttacattctagcagcttagcagccccacaaaattaaactgcttctgccctcatcgttccagagagagccccagaagtgtctctccttggctcccttaggttgcatgctcaacctcacaccaatcactgtgactctgattggccagacctgagccataggttcatacagaggccaaaccactgggaccaagaggtggggaggggtaacccccagtagaaaacagaggaacggctacagaaaacagcattgatgctgagaaacccacatcccctaaaaatgtctactatatgtagttactaagaattcctccattttagagatgaaaatatctgagaaaccaaaatatctgagaaaccaaaaaatctgagaaaccaaaagtcaattgtctcagctcacacagccagtatcagacgagggattcacacccaggcagtctgactccagagccttgggttcttaacccccagatcacctgggaatagcttagcctgctcagaagagaattcacccacccacacccacatttagaatgaggatagttcccactgtttattgtattaaccgtaggacctaggggttcagagacccaaggttcgcgcagcccagaactaaggaatggttatgccctaatgttgccctgatggtgccctcatctgcattctgaaattcttaagtttgcctttaacatcccctaagagttaggcaaagaggaggagttccaagtgcttgaagatgagccactgagagttgacagttgcttgccagcccagccgctgggaggcatcagggagaaggggaggagaaaggggaaggagcactcattctcccacttctctagcatcctttaggatggttgtttgacaggcaagagtacttctttgggggccaaaccaggatggagaacctgcagtgtaggcggatttaatgagttgtcctagtaaattataatcctgttactctgcagggtttttttgtttgtttgtttgtgatggagtttcactcttgtcgcccaggctggagtacaatggcacaatcttggctcactgtaacctctgcctcctgggttcaagcagttctcctgcctcagcctcctgagtagctgggattacaggcgcccaccaccacactcggctaatttttgtatttttagtagagaatggagcctgacttgcaggtgtcacaatgctaaagctgcccttgggtccttcggtgttttaaagttaggcctcatgcctctccaggggcccaggcctcatttggaaatgactaacaataaagctgggtgcctatgcaaaacagcaagcagccatgaagccatgcaggcaggggctggtatgattcataaataacctcatgaactagaggctaaatgatgctgataaaagtgttaggaagtgcttctagctcttccttactcggggaggtgagaagctatcgtgaacactctagatggctgtttgccatcttcctgctgtcctagctgcctaagcactgaggctcactttcaccctgagaatttcaccagagaactgtgaggtgggaggagaaggagctgatggtgatgaggatatcaatggagggtaactaagaggagaaagagaagagcagattatatgggaagaggagagaaataagggccttgccttaaagcaataggagaaacctttctaaacccttgctactggcgtcagcatcacctcagagtttgtcagaaatgcagaatctcaggcctcacctcagacccactgaatcagaatctttggaagtggggctcaggaatctgcatattcactagcttccaaagctcactcagtgtgagagccactgttctctatcaagagtaattaggctcatgtctctgtcagctgaagaccaagggcaagctaacttcagttgaagggagaagaagagcaaattcattcgttattattccatctgtacttccactgtcaacactaatcgtctctttgttctactaggactcactgcctgcaataaagttgttagtccttaccctgaagggtgattattgccaacacaggtgatggtgcccatcagtcactaaagaagcctttgagtttctattaatttgcagatttttttatgcagttgatgattaatcctttaatggagaatataatccatgcgttgtggatttgctcgtgttgctacttgagcacggagcagtgttcattgaggtttttcatgcacctatcctccaggcatttgtggaaggcttagtatatggcaccactgtgtaagtgagaatagctcctagctgcctacaccacagggtggagagaggcatgattaataccaagtggggtgcccggcccctccaacgtgctgtgggaagatgcactcaggtgcacacaagtgccagactcgtgtatgtgtgtggctgatgccaaagccgtttccataacaatgagtgttcggctccagagactctcctcgggagctgaggaccccctccctctgtcaccaaagctgggattggtagcatttctcaacgtgcctaagatctctttaggtaaatacgaaggaaactaatttactgacctccttgatacagatacccttcaagactctttcacaaatattaatattgattagtcatttagcacttagaaaatgctggctctctctacgtggattaacacacccatgacaactttccgtggcaagcctttttattctcatacctgttttacaatagaggctgaagcacagagagggtaaattgctttgcccttagtcacacagctggtaagcgacaaagtcaggtttgactcacacagcctggctccagaacttccggtcttaagcacagctcttcatatgatctctgaaactccagtaactcccttgggtctcttcctttctcagctgcaaaaatgaaggcccagaaaagtgacgtaacttatccagcattccacggctaagagagactggtttctgatttcgcctcaggtctatcagattgaaaagtccacccccttcttccgcaaaccctctactccctccatccttgctgctgagctgggcatagaacattcatgcacccagagcaaagggggcagcagctactgctaggagcagtggggctctgagcaaaactgaagggtggcagggccaggcactggaggccctgagaatatgctaaattcaaattagtggatgctaaccttccgacctgtgccctctgcttcagaaccctccatggcaatgacatttccagcgttcctgaaggctccttcaacgacctcacatctctttcccatctgtaagtagcagtgtttctccccaatgaacattcaaaacatgaaagcatgaaagtgtcagcgacaatgtcatcactgtcagcattttggcagatgtcctttccttatgcatacagtatattatacaactatgtatccacactatgcatattgtcttgtttcccacctcagaagccttcaaaggaatcctcaattatgtaaacactgtaaatatttaataagaactaatagaaaacatgtactatggggtaaacactttagataagttttctatttatttcttacaactgtaaggcatttttatccttttattatatataataacattgtgtctaagcatggcacagctagcagatggcagggcccaggatcagatctaggtttgccttgactccaaagcacatattcttaaccactttgcactctgcaacaggtattcccttcttattttacacaggaaaaactgaggcccataaatattaggtgactagctaaagtttgactatcaggtcagtgagatgttggactagaatctagattccctcactcccaggccagacctctcttccacagatcaggaatctctacatttttttatacacctctgtcagtgaacattttcgagtttgtattccttctatatgcatatttaattattttcataatgtgtgcatacactataatacggatatactacgtatgcatattctaaaactttcaaaagtagaattgttaaaggatataatttaaaaaaaaaaacagaatttctagtattttcgtcccagtcacaactgggatgaaagtctagccaagtggtttgaagctgctccctaggttgctgggtttcagaaccttctctgcagagtatatcctccagtggacccttcaacagggcaagggaaccagataatcagatggccagtgatccaggaagctccctaaaggagctaggatggggttgagttgaagagtgagtcttacttgcgtaggtgagagccacgcctcagaagtggaaggggctgggatgggagttgaaacttccacaggattggaagtacactctggagatattaactttgccacagtggagacgactactccgctggccccatattggatacctccagtctagccaaagtctgaaaatgcatttccagagagccaaggatatgaaggctactggccaagctgggcagggggccctgacttcctgttctgcctcctagggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaaggtaggtgacgcccacaccccaccctcccctgcccctcttggggtctgctgtgttcccagcaacctgtcagagcagggtatctcaacagatgtggcttcagaaaccttcaccctgtctcttccatgggtcccacaaagaggctcagatgctgacgctgatgtgaaccctcatctaatgggccaagtgtcattctctccaagttccctgctggcattgccacacatctcctcactgacttctttctgtacatgtctttccatagtggagaatatctttttttttttttcatcttttgtagagacaaggtctcactatgttgcacaggctggtctcaaactcctgatctccaacgatcctcctgttttggccccccaaaatgctgggattacaggcataagccactgcacctggccttgagaaaaatcttcaacctgcattttttaatccaacattattaaaacataagcattttcccattttatccagcaaacttttgtacatgtgatttttttattgatcatattataacaacaaactactactgagtttgtatgcaacaggaatgatggtaagcactgtctcatgtattttcttctcattcttcatgtaacaacttatttaattctctaatacctctatgtgatcaacttttaatattatcctcatttttaaaaatgagaaaattgaggcttaccaggcttccaggtccatctgattccagaatgcgcagtctttatcaccaagccataatactccactgccacttaatccatttctggttttgaatctttcgagtatttccatttttttgtcttaccattgacacataaagatctttctctgtttgaaatcatgtcctcagataagactcagagaatagaaattactgaatcaaagtacattattatttttaaggtcttcacacattttgccaaattgattttcaaaaagggttataaccaatttacattcccagtagcatcctttggttgcatttttcattagactctcattattttctcttattttctcattgctaattcaataggttaaaaaaaaaaaactccttttattttgtctttgattattggggaacctgaatttttcatcaaaaacgtacttttcatttgtatacacagttgtttgataatctcttttgctcatctctgagaggcttaatacttattttgatatatagatacactttaattaccctctcaaactttagtgtgtcctacacttctgctgcaagcagaaaaacattccattggcttaaagctaattttaattttcctcctcctgcttctaagctatctgatctgatactaaagaggctcacctaggccaagaacagtataggtctcaatcttggctgcacatttggacatcatacaggagcttttaaaattactgaagcctggctccaccctctaggtttagattaaattggtctggggtacaacctgggtgtggggacttttaaaagcactgcagccagggtccgggcacggtggctcatgcctctaatcccagtactttgggaggctgaggcgggcagatcacttgaggtcaggagttcaagaccagtctgcccaacaaggggaaaccccatctctactaaaaatacaaaaattagccaggtgtggtggcgcatgcttgtaatcccagctacttgggaggctgaggcagaactgcttgaatccaggaggtggaggttgctgtgagccgaaattgcaccaccacactccagcctgggcaacagagtgagactccatctcaaaaaaaaaaaaaaacaaacagaaaacaacactgtagctggtagtgtaaggcagctaagtcatctgggttttgtctgggccattcttggttttagcactgaaagctctgtgtcctgcaaaccccctcagccccaagcaaaccaagacagatagtcttcctcttctaatgtgaagtcgggttgagcccctggtaccagctctcaatcaggccattctttttactcatccacaaacagtcactcactgaagttcatctcagcccatctccaagttgataactgttaaccccaaggtcatttatagtcctgacactaaatatggcctgtttatccagggctcattgtcaaagctggctgcagcagcaggacacagccccctttgcaaagctctgggaaggaccctgacctccctccagtgctcgcagctaaagcaagcacacggctgaaacggtcacagacgtaacatgtacctgagcagttttctgtccattgtcagcatcatcgctgtgtcctctggggccatccatttctttcttccaaggttttccaggggggacttcctctgtgtgcctttggcccaagcactgtgccctgcttagcctggcacagactattccatggggaggggtgtttgtgggtagaaaaatgggaggtccgaatggagcctgggcccagagcttcctggaatatgaaaagatacacagggggtttctaattatggtgcattgtttgcagattagcaccaaaatcggatcaggctaattacagtaattgatttgactgcagaagtgtttctgaatgatgtcccactgtgatttttcctcactggacagtggctgaattaatgggactctagctggactggatgtgctggctgaggagagccagctgccatctgggcatggagttgggaaggggctggcgctggctgagggagggcccagagcagaggggaagggaggtatggcagtgagcgcactcaggacctgccatcagtactctggttttgctgcccagggccagtggacatcaacattgtggccaaatgcaatgcctgcctctccagcccgtgcaagaataacgggacatgcacccaggaccctgtggagctgtaccgctgtgcctgcccctacagctacaaggtatgctggaggccctgcccccccgtgttcatgcctcaggctcctccttcagccctggccctagagaggggcaccatgccctgcgtaccctcccttctccaagggacagcctggatgagtccatcgcacaggtcaccactccaaagcagcatttgccagtaacactgttctctgaactagcgggagctgccagtcagagaggcccccatatggtcttgacaaggatgtccagagagaaagaggaaatgtaacatttgtattttctttgtgaaacatggagaaattaagtctcagagaaaaagtgtttccaagtagaggcatcccttgagcccactctcccaatttcccttctaaagggatttccagaacctccaccccaccatgcccctgccaaaccccaccctcagagcaaccagccttgaaagtgctggttccagcttgatgtaaatatagggattggggattgaaaggcctaggggctgcaaactcacccaaaaggttgatcggctaagatcagccagcaagaggatgagatcccagttctcccctctgtcctcccagactacctccaagacagtccttccttctttcacccagagcacggtgtcatgcccctctgctgacccctgtggatatcgaccatgtgcctctcaccagcacctaccgagtacagactgtgccaagtactgtgcttggcattttactcacctgttcaaacacccccagcaaacctaagaaggcctcattattccctttttacggatatggagactgggcctcagactgtcaagagttcaactcaatgtccgaagcttgtaagcagtagagctgtgattaagaccctgggctttgtgattccagaacccaatccttttcccctggagggtttcctggatagctgagcccttccttgggcttcactggaatcagcaaagctgtggctccatcctcttctgcagggcccgcccagcttccagccttcccagggcacccatccaaaggcactgggcaagcgcagagtttcaggacagccccacagcctgtctaatgcacacatctgatgcaggtggagtgagagtgagctggcatccccaggtctctgcccccagtgggattgtgtgtgcgtagtgacaggcttagaggcagcctcattctggggaatgggactacctgatgtatttctagacgatggctgtgcttctagcagatggtgtcagagtgccacctatgggcctgggacaagagagccaaaggattccctttgaagccagccacctccaaagtcttaaacttaccactgagtcccagacccatacaccgtcatttcataagctgattataaaaatcagagaagagactaaatgcataaggtccagatgagtgcctggcctttactgatgattcaaaagagaactatactatgtatggaattgagaatgttataaattcagtcacagggcacccacacacacaaaaaaaataataggaggggagaatagagattaacagcagacatactcaggatgtgtggatcctctcaaactcccttgtatggattcagcagagaaaattcagactgtgcaattacacagagaagcaggtgtggattccagctttgtcatttactagctgtgtagccattgctagtaatttcatctgtcttcccagctgcaaactaggacctgtctcataggtttgccgtaagaatcaaatgtacagtaatgtacgcaatacactaggatgatacctggcattcagtgagcactcaataagctggcatactgctgcctttcacctttacccttgcatggtggtccctcatacctgggtgtggaataggccatcagtaacaggtggtatgttgctagtttgatccaggattatcagtctatggcactgtgaactgccaagaaacttcagtcattctcctagaactgtgactgcatttgtaacattctcaattccatacatagtatagttctcttttgaatcatcaataaaggccaggcactcatctggagcttatgcatttattttcttctctgatttttataatcagcttatgagatgggtagtatcatccccattctaaagataaggtaaactgtttcacattctgattcttgcttccttctctttaaaactggcctgagtctgaaagtagtagagctgggtttgaagtccaggcttcttccagctacacttgactgtactatgaagcatgacctgaccgtcagtgtcagagcaaagagagtatcttcagagctactgcaggataaggccacttgtttgaactttgttctcaagattctgaacatcatgtcaattttagaagaatgtgaacagagattttgatcttgaggaaagtgttgagcccaggcaggtctagggtgcatgatgttgatggtgatggtgaagatgatgatggtgaaggtgatgatggtgatggtatcggtgatgatgacaaaggtgacaatggtgatggtgttgatgatggtaatggtgctaatggtacagatggtggtgatgatgatgataactatgataataacagtaacataagagccagcatttattgagtatctactatgtactgacagtagactaaataaggtacatgtattatcttgcatactcctcatcagagccctagaatacagttcctaaaatgaccctcattttacagttgaagaaactgagcatggtaggtaagggagttgggattcaaagctcagaaccaactgactctagaagctgtgctcctggccactgcactcactgcctgttggcaagtgcagtgattgcaggggctaaggtggaagatccctgactatttaggacctgtctgaatttccaggttagagacaagtagagtgtagccatgggaagaacaccaagcaggaccctctggagcctgtgcctatgtgatgcatgaccttggacagaactcgctcttctcctcacctcagtttcctcagctgtaaaatggaggaggttgaacccaagggatcctttaactgagggttgcatcaaattctctgtgctatgtccctgctttccttcttgccggggttagagcccgcccaaacagagcgactaagatggtagttctgcatgagtggctaacagaaatccccagatacccacaaaaccaagctcaaagttcaggcatttacctctttccaggtatctccattttcccattgactagctgagtgaccttgggaagccacaatattataaaaaagcacaggaatcactgtgtaacatttggtagcagctactcttaatctactataatgccaggcctttgtgaagcagtttaaacacattatctcttgtagtactcttaatcaccttgtgaaataagttttattatcgtcttttaatagatgaaacaactaaggttcagaaagatgaaataatttacccaagctctcacacttaggaagtgcatgagctacaaccagagctcagctatctcttgcaacaaagtctctacactcacaaccactccaagtcagattctccctaagcctcactttccccacctgtaactgagaatactcatactcatgtgcagggctgttggaaggatgaaaaggggctgtgtgtgtactttgcctacctcagtgccaggattcagtagatacttcacaaagggtcagtattttgccattatgttaagatttggggaaaaaatatatctgttggctgattctttttcagccatttagtttcaggcacatatgttcaatgtctcagaacagtgcttctcaaacttttgtgtgcataagaatcactggagagcttattaaaatgcaagttctagttcattagatccgaggtcaggcctgagagtgtgcattttttttttttaatcagctcccaggacatgccagtgccactagtccaaggagcacgctttgagaagtaaggacttagcagcattcctcgtgcgatctcagaaagaggtttccaatgagggcagctgttcccagtgtcttttttttttttttttttttttttttggagacagagtctcactccgttgccaggctggagtgcagtggcataatctcggctcactgcaacctctgcttcctgggttcaagcaattctcctgcctcagactcctgagtagctgggatgcccaccaccacgcccagctaatttttgtatttttagtagatacagggtttcaccatgttggccaggatgttctcaatctcttgaccttgtgatccgcccacgctggcctcccaaagtgctgggattataggcgtgaggcactgcgcccagcccccagtgtcttttaaaggttgattcccaacctttttggcaccagggaccagtttcatggaagacagtttttccacggaactagggtggtgggcatggtctcaggatgaaactgtaccacctcagatcatcaggtattagttagattctcataaggagcgtgcaacctagatccctcgcatgcacagttcacagtagggtgtgtgctcctatgagaatctaacgccacggctgacctgaaaggaggcggagctcaggtggtaatgctcccgccccatctgctcacctcctgctgtgcagcctggttcctaacggggaccggtaccagtccatgtcccaggggttggggacacctgttttaaaggaagccagtcaggattcctggccatgtcctacacacacacacacacacacacacacacacacacacacacacacacacacacaaagtgggatgaggggtagaaagtgtggtggaggaccaaggagcaccacaaatctggtagatttgagcaaaatgaggctgaagagaattgaatcaggctaattaaccaggcgttggcaatagtgattatttttcaaggagaggtaagtgacagaaatccccacttccaggcccaattaccatgtcatcaagcgctaggctctgcctcctggatttctgtgcttggcgtaaagggctgcaggagttgccaccacctccaccaccaccgccatagttgggagggtttgacctggagtcactggtacttaccagttccccagagcaggggctaacccaggcaggggctagagaggtcttgccttgaccttctcaaggttctttgtcctgcccttcacggtccatgtgttggccaccaccactctcatatatgcacctctggaactacttggcaccaaccaaagacctgaaaaagtattttagtcactcacattcagccctgcctcagaccccaagcatcatcatcatcatcatcatcatcatcatcatcatcatcgctattatttatggagctgccattacatgctaggtgtcttacatatataaccattaactaattccccatagggtagttcatattatttccatttcataagtggtaaaaacaaggctcagagagaactagtcatttcctcaaggaacacagcagccaacttagaatgtgcactcccatctgtgtgcccctagaacgcatgttttgagaggggctagccaagtggtcctgcatagaggctcccagcactaactttgggctggatgcctgggttcagctgcttgctccccatttcacttactgctgtgcgatcttggccatattacctcactttctaagtctgtctttcctgtctgtaaaaatagtgtaataacaatcacaccaatctcatagggttgttgtgaacatgatatgcgatcatgaatataaaacacttagcatgaggcctggaacggaaaatgtgctcggcaaagtgggtgagaattagtattacagtttccattccacaccaactttcagaaaggggccctgtgttgttatggtttaggataaaaccagataccagcccaaactgcactctccctgtccccctccaagaaacctctgactggcccctttgctgggacagggcatgaagggaaccagacggacatggcccatgccttccagctgctgaagatgggcctgaggctctggtgtttgagagggtccacagcagaggctgtcctgggcccaaggccttcagcccagttggctgcagcgtcgcagccaggaagccccagttccattccatcacatcaccagcaacagcagaagagggaagaggattttctcaggcagatggcgagcaggtggtgtggcagtgggtgggctcccatgatcacctccaccaggtctgtgccaagccactgagcccagggcccagaaaggatgcagcagtcacctccccaggccccacgctaccaggtcctgtaagggactccatgccaagcattgggtgagactggtctgtcagtcccaaaggagaagcaggagccagaaggccaagaagagtcgggctgttccctgggacagtgggtctcatggagctcagtctccaccttggggctgccttcctcagggccgctgccctcactgctcctgctgcctggcacgctcctctccccaccttccacacagttggctccttctcagctcacacgtccccttcagaggggcctgctccaaagaatcccacaccaccctgagttctctatcgcaaaggttccccacctggcctaaccttaggcttaccttcagaactttagaataccaaagcctggaccccactccagatcaatcaaggatggttctctggggttgtcactttgtaggagacaaggtctgttggccatacttcagccttagtcttccctactcaagttgtgggttatatttaaggttcagtgaggctcatggtaatgttatcttctagcatttacagaatgcctactatgtgctaggtggattacacacgtgtaaccttttccttacatgaaacttttccttacatgaaagctcaagtttaattctcatagcaaccctgtgaggtggacttggagaggtcaagaggcttttatgaggtcacgatcagccaacccagatgggatggagctggaatgtgaaaccagctgtatgtgaattcagctttgcctgaatccatagcctgggctcttgccctgcagtttgggatacagaagggtgcaaattctgcgaagtagtgaggctggaacctgaactcctggcttctcatcactcttccccttcttactgtccagtgactaggggttagggctcccatgggtgggctccaagtcacacagcaggcctttcctaggggctccttgttgtcatctccccagcctcatcacagagaatgctggaacccctggagtcccctgggccatggcagccccagaagtccccctaaccaggtgcttctccctcttttgctcctcagggcaaggactgcactgtgcccatcaacacctgcatccagaacccctgtcagcatggaggcacctgccacctgagtgacagccacaaggatgggttcaggtaacagttcacccctggcctccctcactgtattagtttgctctcacactgctaataaagacatacccaagactgggtaatttataaaggaaagaagtttaaaggactcacagttcagcatggctgggaagcctcacaatcatggcagaaggcaaaggaaaagcaaacatcttaaatggcgggaggcaaaagagagcttgtgcaggggaactcccatttataaaaccgtcagctctggtgagatttattcactaccatgagaacagtatgggagaaactgcccccgtgattcaattatctccacctggccccacccttgacacttggggattattataattcaaggtgagatttgggtagggacccagccaaaccatatcactcaccttggagggctccctgggcaggctaaagaagcagagatacgaccagcgagggcgtgcccagtgcccgtgctgtgctggccctgtatgagaatgatctcaaggctcttcgcaccctgtaagggaagtacaatttatccccactgtgcagataaggaagttcaagcatcagagggacaaatcctctgcctagagttacattaagcattggcacagggatttgaaaccaggtcccaacctcgtgcttcctccaagggaggtgtctgctgctggctaaagtcagagaaggattgggtgaaggcttaaagactgcccgtctggcacttccaccatgcttttctgagttataaaataagtggcatttattatatgctcactatgccaggtaccaactagtcaagtattttctcatttaaatccctacagaccctatccagtaggtaggtattatcttcattgaacagatggggaagctgagacacagaaatggacttgctctaggtcgtatctcctgatgctcattcctggatcttccaggcccacctccagccctctttccttcctgacattaacatttcaagaagaaaagggaatagaagtcacttaggtttttctcctccctgtcctaggaatgggattggcttccacccaacctcaggaccccttcctgcttcccaccttccccagcagcttttagatgcccagtttcactggcctgtggctctgaccaaagcagactgttgggaacgggctcctttggcatccctggtgagccagtcaggaggcggcagccccttggcaataaaggcaggggcaccccatgccaagccatgtgtgggtgtcttagagctcaagttgcaaccaattaaatatcaaaagcactctggccagtgctgccgtgtggtctggggaagaaatcaaattccaggctcccggttctcttcccccgggaacccgcccgcccacgtgtccacctgccaagccagctccatcaaactctgcctcctgaaaagtgaaattcaaggcagagttccttttcctgcctggagtcagccaaaccacccactcctgctggctcacatagagcaggggtgagaagaaactgcagggaaacatggaggtggccacggggccccagccaggaaacacccctccagggcacacagcctgggctgccccacccaggcgagggattgggggggtcagatgagggaagagctccccgctgcaggcaactgtgtttctcccatctcagctggaggttcggttgagcagaaatatctcatttccatcttaagttgttgaagagtttcagatgaacagaaaatatttttagaacttaatgtaaaaggaaaagggcccagatctacaggatcagggaaatggggtggaaggttaaggcaatgaggcagttactagggatgggagagctcgtatgcagtcctcaaggaatagggaaactcttctgcatcgggccagcacctggtgggtgaaggggagtggtgcttgtcaggaagctcccctttgctcccctcttccattctagagtaattccttagggctgccataataaccacagactgggtggctgtaatcaccagaaatttactctctcacagttctgaaggatagaagttccaaatcaaggtgtcagcagggccatgctccctctgagcctctaggggagggtccttgcttgtccctccctggcttctggtgttcctggcaatctttggcattctttggcttgtggctgcagcacccctctctctgcctgcatagtcaccagtgctctctctgtgtctgctttcccatgaccatcttcttttagagacacctgttatattggattaggggtccacactcttttagtaggacctcaacttaactaattacatctgcaaagatcctatttcaaaataagatcacgttctgatgtactcagggttaggacttcaacatatcttttttggggggaacacaattcaacccataacaggtcttagtcatcagcatcaccagcctcttcatacacatgcttctctaatcttgctgcattgcctgctcacaaaaacagcaaaggttggcagagcaggccccacagaagaccaacacaggagatgagatctgctctcatccccacaaccaactcatggcacctggagtctcctggacagctctccaaggtttccaatgaagacagggagacatcagcctccttccaccctgtcactcctttagcaacctctctttcctcgaccagccaccatatctcactgccaggtagccctaaggctctgggggagccaaagtaactggtctttagaaaaacaaatgggcaacaccatggtttaggactttcagaaacctaccctctgtctggctctgaagaagtagcctttttcatgagtgcccagagtccctaacaggaaaaaagaatgagtcattttgctgtaccccaagagctgagacctgagaggcccctggccttttgtagaaaatgtgatatggttttcagttgtagaaaggagaccaattaagtaggattctaggaccactgaaattcactgcctgttagctgagtgtagtttacttttttagctaaatcccaagtcagagcaatctctgaaacctgaaattccagatctgaagctgaagcgcacactcatagatggagtgagaatccctgacaaacgggttaggccaaagaaagatcgagattcattgcagcatttatttaatcagatggatgctcactccacccccgactcccatcccttccgcatggcctttatctgttctaaccgatcttgcacgcccagtcctggggatatgaccaagatcaggcagagatgcaggcagttgaggtttttatccaagagatttaacactctagagacaagtgaaggaaatgcatcttgccgccccacagcgtttgaagccaagttgacccgaaggcctcactcttggcaggcgagggatcctcccactctagccttcatcccccagaagctggaggggctcagaagtagcaagaatacatgatgggaagaaatggcatccctgaagaacagttaaggaagtagggtggttttgtgtagaactatagcttgctaatgggttctgagcattttctatgtgctatgtacccttttaaacattttgcttgtataatctcaatcttcacaaccacccaggtcaaggtcaagtagctagaatgtatcaacaggaattcattcccaggaaacctgggtacagagtctgggaccttggccactatattctgcccaccccctcaccctgagatagaagggctgcctttgagtaaaaaaatcacttaaaggaggatgtttactatgctgtctctctttatttgcaaaagagattgtgcctcagaagagccaaagggagggcagtttggaggacagctggaggaatttaagccatatccaggaaaccacttccagctgggggaatgatgacaccggccttgttggtggacattagccccagagcgaggcagccagcatgggccaggggagatagaacattgcctggagatggggttggatgaaatgaccttttaggttcctaagggtcttcctgctcaggaccccaaggcctcatgtgtccaaagtgctttctcagacctccatctggaggaaaaactaattgtatttcccacccgtgtcttcctctctgccatcccaacccacctctctccctgacccctgactcccctgctctccacccctcacatcccaaagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtaaggatctcatgactgtatgtatggtggggtggaggggtgtcgctagaataccattttcttaacttcctccagggactctcttcctctctccctgaggacagagactaagaccccaagactgtgatatgccaagaggggctccccaaaggcctgtttgcttctccgtgtcctccaccaccagccaccagcaaatcactgctccttcccacttgaaacagagtcccaggctctttagctgctgttcatctcattgctggccattacatcctttagggcccctgtagacctagtggtgtttgaggctggcagagaggcgcttgcattgtgtttatgcttccttcaggtctagtcaaccgtctcttgaaatccacattttccagacacttagctaggagctagggatacaaaaatgaccaagacagagttccttctcataagaagtttatagtcaggtggacagaggcgtggattcattagaaagagaacataacatctataagccctggggtgtgggatcacacagaaggaacctaacccagccagagaatccaggaaggctcccacaagagagcattcctcaggaagatcattccacccacctaccccccaaacacaaaacctttattttcctacattaataacccctaaaaaggacagttaaatatatcattagattgtgaagcaaaatgctaccaattttggtgcaaacacagcccgctttgttatgagatcaaccaaagtagcgtatcccagactggaattccatgaatttgaggaaaaatccccatgagacaagaagtttgggaagcactgcatataataataaccttcttcttggtgtaccatgatacaaataagcatattagaggttccaaaaattcctgctttaaagaaagctgtttgtttaacccagcagttcccaaacttatctgatctcagagcttcccctttccccatcctcgaacactattcccagcccagcgatcctgtgttgcaagaagcacttttaggaaataccagcctaaggcaaggagaaaatgaggagggggaagctcagggactcccatgtcctggactactggaaccaggcctttatgtcaggagtgaagtgggtggtgggaagctgtggaagatgaatagaagcatccttgaagatggcagagaaggaagccaaatggctcccattgtccctcatagcccatacctttatcaagcctccagcccatagacagtatccccaagtacactcttgaaactgtaggaacgtaccaccaccaactgagaaaaccacttgctctaataatcctgggcttcctaggaccccagacaagcttctgtgctgggagaaagtgcatggaaatctgctgtgggggcggatgcagtggctcacgcctgtaatcccagcactttgagaggccaaggcaggcagatcacctgagatcaggagttcgagaccagcctggccaacatggcaaaaccccagctctactaaaaatacaaaaattagctgggcatggtggtgggcacctgtaatcctagctactcaggaagctgaggcaggagaatcacttgaacccaggaggtgaaggttgcagtgagctgagatcctgccactgcactcctgcctgggagacagaacaaaactctgtctcaaaaaaagaaagaaagagagagagataaagaaagagagagagacagagagagagagaaagactgactgactgactgctgaggggttacctccccttccctctttcatcttctgagagcggaattgtagccaagagttgcattagcaacaggcaacacttactgtgcacctactgtatacagactactaaattagccacttagagagaccaagaaatctaaggtatgccctcagcccacaagggcttctggtccatgaaaagaatcactgtatagagttgagtcattggtcaagaagaatcagcttagtgccagaagagagatgacagaaatcccagtagtgaaaatggagagggcagtggggctctaacaaaggctttgtggcaggggaggggcttgaactgaatttagagcaggcagatgggcagcaggagggtactgaggaggcattgatgaagtggtttcctgccgcagttgaggcctacctggtgtctgccgttgaccagggtgcactgctgatttgttgcactttggtcctgagagtgagtgcttgtataatctcatttaatctccacaactgccaaagtcaaggtcaagcagctaggaagtgtcaactagaattcattcccgggaaactcaggtacagaatgaggctttgtggtttgctctgtcccagaaaatgtgcaagtcccacacagatacttgtctgcttctctgggtgtctccagatgacaagaaagaggaggcttctcaggaacatagtgccttctgtggtcttgagaggctgaaggcaaaatttggagagggaggggttcagtgctccctcccaggacatggttggggtcagcctctccccaccatagcaaagaacagacttaggggctatctgttactcattaccctgcagccagccctctggacctacctgcctataccctgggagcaggagctaaggcagctttccccgccctgctcccaccccattcctggagagaacgttcatggttagacctttccctctcttagatcactctccatctggcttgacctagtggaatttgaggaaacccaaaactcggatcttaaaagctggtgttgcttgggagctgctgtcctgccttaccgccctcccccacattcctaaaacacattttcaggtggtgtaagcttttcagggcttatctgcaagggccatccctgggtgtttatgaccgttaggtattttgtagcactgcagacttcaaaggcaatgtgtctagagaccagaacttcaaattcctttcatacttccttccctgaaaaatccaaggggcttacttttctgtaacaggtgaactgggctgctaagccttgtctgtgtctctgaagcctcctctgacctcctgggggaggttatgggtcccccttgtgcttccacaaagtttgcccttctggtcacacctacaagtctgtattgtaattgcctgcttatttgtagatcttcccaaataggctgtgggtaggaaaggacccagtcactgttgtgtccccagtgcctggcacagtacctgccacacaggaggtgctcagtaaataagtgtggaatgaaaaaacaaatgaataagcatggcccaaagtgagggccaggcatcctgtgctctcagctgcacctgcccctgcccctgaaagatcaagtaaaacagccaaatggtgatgctaggacagtgtccaggaggacacctggaatcttcccgtggtcactgccaaagaaaccaaggcagaggtgcaggaggatacacaaggagtgagaacacaggactcctgacgtccatgcccacctgaccaggggctggatgagtctgatcttctggccaggatatcccccctagtactctgatcttctggccagggcatccctaccctgcctgaggcctgagctatctcccccatctgtgccaggtgagctatgcgacgaggtgattgaccactgtgtgcctgagctgaacctctgtcagcatgaggccaagtgcatccccctggacaaaggattcaggtaagacctggcttcgtgcccccagcacagagtccatgaaaactctgcctctaacagtctaggttttaggcagtctctggtctctctgcatgctctctctctctctcatgtgcttctctgcatctctgattcagccatgatctaattatctcagtctgtttccctatgcgtgcctctgtctgtctgtgggtgtctctaagtctctgtagatagacaggtaggtagggagagagaaagagacagagagagagaaagatccactctttctcttccctgccccttcttccttgcctctcctctcctaccaacttcccagtactctcagcatatccctcctttctagagctaaagaagtagagcaattccactggggaagcagcgtctaaagggtatttggtcaccttctccatgtgcagcctttgcagtacgctgcccctccagtctacagcaagtttttcagcttatgcacctgttgcaggggaagggggcaggagcactgtggtccagcagcatggccattggcggagctgtctccatggtgagcagcagagcccataggagccaggggagcacgtgagcagccctaagggtggatggagaggctgcctcaggtcagaaagccatgcagctcttgaggctgaggatccaatggcactcctgggaaatccctcccaggccctgtactcatctcttcctttcaccttccttcatgaaagcttttgccactgcctcttctagagaagattgtgagacccttgagactgggggttttctgacatcgagagggagatcccagaactctgtggccaaaaacattcttcccaaccccagtgctgccttctacacccagctgcctccttcttctcccagcaatctctgtccaacaccagaggaaagccactagcaccaaggagtcagggttttgggaaacaggcagtccggggcaactggagagaccccaggatgttagcagaccccataaatgaccttacagagcctcccctagagatgagggccctgggcccagagctccatgcctgtgctgatgagtctttaaggagaatgcccaccagtggcatctccagcctctggggccagaagctcatgctctaggtcttgatgggtccagaagctgtcatcacccagaatctgtcctgttctcagtcacagggcagagagttagactctgggggtatttgtgactatgattctaaacaacaagacttaggacttcagggaaccccaagatctcagaaagcccaatcacagaatcttagaaatttagaatcatagaatctctgaaacttgaacttgtaagctcttagaatcttagaatctaagaagcaggagttctagttgttgctccagccagcccacccatcagtccacagatcttgattgtgtggagtatagtggggattggaagatggttttgattcatctcctcaaggcccttgccatggacctaggggaagaagatttgacactgagcaaatatttagaaaagaaagaagttctaggccccacgattctggctctgttgctggggttctgaggaaggaaaaggctgctggaggagagaagcagccccacccctttaggaatagaatgtgggtgacccttgagggtgggtggaatttggatgggttgagagaaggaaggacggctccactgggggaagaagaagcaagtaagtaagggtgacaagcagacatgagcatgtcttttatcgtgtcttccttttctattttcacatcacaagcctagatctcatcaccaggggaaatgccaagaggctctggttgctcaatgagaccaaatgaagcttcagcccttccatgtgtctaccccattcctatctacctcatctgccccatgccccctcagatatgccaggtgggacttttaggcagtcaagttacctgagtacaagggtgagagatacctcacaggacctccccgcctacttccacccccctgatttgacttcagttcactgctgatctttacgaagtatgggatactgtgaggggacagggaagaatgaaggggcaaggggtgggaagagacatgtaaatgcaaacgtgaactcaaagcagagcaggccaggcaagcagagtgctctgggcatgcccgggaaggggcagggaatggggatctgcccatggagaggagataaattgcctcttggctgagtggacagcaagctcagaggacacaggcttacaccagcactggtcagaagtggtctaggggccaccctggccaacatggtgaaaccccgtctctactgaaaatacaaaaattagccaggtgtgggcacactcctgcaatcccagctactcaggaggctgaggcaggagaatcgcttgaacccaggaggcggaggttgcagtgagctgagattgcaccactgcattccagcctgggtgacagagggagactctgtctaaaaaaaaaaaaaaaaagaaagaaaacaaaaacgtggtcaagggtgcaggtgtggggttggttggagtgctggagagctaacactgccaggtttttatgatccccagaacttattcctagaaacctctattgtaactaaagttccttgagttctaagacaatataggaaagaataaaatcagtctagctttcataatcttgagatattgtatttatatgtgatgtcattatcttgaaaaggtctacaggccagctcaatgttagtgtttcattaaaatgtgtttaaatcaaaaattattcttccagtgcaacattttatcattttatctccttcatctcccatcaccaaacagctcatatcctatggcagcctgtagggatattagccaaagagatacacagtcagggtgacgtttgtccaagtgtgaagatgtttatccttggagttctccttgtacgttccctctccctcaatgaggtctcaatgaagggcagatactacctgtccataatacaatagccaaaagaaagatcacaatgactagcatgtactgctaacttattctttgtcaggcaaggtgtattatccaacatccaacaatcttagaacgtagaaactcattcacattttatgaggctcactgaggtggcataagccacctccatgcacacatataaaggggtggggctgtgaatcagtctgggcctgactgatttctcagctaaatccagagactccagatgtcctggaaccaaggacagcatgcggttactctcccttgtgcagaatcaatagacccaacacatattaaaatgcataaaatttaactagaagaaaaaggcaagcatttgagaacaatggagaatgcaggttacagcaccagctgcctctctttagttgatggagaagtactatataggtccttgctaccagaggttcttgaaccagcagcatcagcatcacatgggcgtttgttaggaatgctagttcccaggccccacccagactccctgaatcagaagacacattttaacaagatccctgggtgttttgtatgctcattaaagtttgagacttgctggtattgagagggctgtagcattttaaaagaaaaagaaggtcaatacatttgcctcccgacctccactgcttagtctgagagtgagaatagcttccctaattcttaataaagatctcaccagtagccttgaagtccaggcttaaaatattggattttatcttgtaagtattggccagctattattgccttggagaaagtcatatagcttaagttgttctgcaactactttttagaattcaagagacacacagatggcttcctgggccaagtttaacacagtagcagaagtatacatggtgctgtattgagcacatgcccctcaaaggcattctcaatgtgtttccttaaaagactggttgaacatgtaagtttgtacttccagtgcagcaataggttatgtatttcaaatttgccaatcaagtaaacgtgaattggtcagatcttagcggatttcaatttttgagcataggccagtaagtcctcagtttcaggaacttgttccagtcgaggacacatcaccccctccgtgtcttacctagctatgaatctacagcctgcatcatgctctgccaaccacaacgatgccagtggggttgccacttgtggattccaccccacttctatccattcctaaagaggagagggaggagagggatgagggagaaccatccctttgccctgattcttccgtggggctgcttattagacaatctaagagtttagagagcttgcttccccccaaccctcacctccctgcctttgtcacctccttctgccatgccgcctcctcctctgacttggataggttgtggctattatttttacctgcccactagaattcagctgttgggcccagaaaggtacacaggctttgcagaaggcagaagcgccagtaagcatttgcttatatgtgcctgtgggtgcacctaagcctctgtgactcagcccctcggtgcattcaggtgtgtttctatgctgggattttggttgaatgttgccccagacagaggagcccagagatgcatgtttctggcccacactcaaggaggccaggttttagctggggcagcttcctctggccaggttttaaaccttgtctagaaggggcaataatggaattgctgacgcaccactcttttaggaagggccagattggtgtgcagggcctggggcagagcaggtgttcccatcctcttgcccaggtaatatgagccacttattaaggcagaagagatttttgcctttctcatcctggtctgaatctcagagtgcaaacagtatcgtattcctcttcattcatcttctacatgtcatgttgaatatttaacgtttaatgcactacacaaagcatatcatatcatttttaaagcaaccataagaggtggagttatttatcaattgcatttaaagatgaagaaactgaaacacagagaggtaatgagtgactgacccacttagaacagtttatgacacgcaagtgtaaactaagtattatcactcgatggggtgtgggggtcctcagggaagtgcctgcagtgctctctgccctctggtttcttccttacgatggagtatggtagaccctcccttacagggtcctgagaggcctcagtgagaactcagtgaaaggggcatagcacagtgcctgacccaaaggaaggaccaaactgaatgtcagtttcatgtaggaagtggcagatccaagccaaaagctggatgagtccaaccctgtgttcctcaccctggctctggaacacaagactcgccccaccatgaatggaacaaaggccatgggccaccagggaaacctgctgtggagccaggctttgcagatcccaaaggaacttgggtagatagaagagatggggagaggccacctgctgaggggggctggagagtgactgcctgcaagctggctttgccttgaggaacggccttgcctctgcctatgttccagctgcgagtgtgtccctggctacagcgggaagctctgtgagacagacaatgatgactgtgtggcccacaagtgccgccacggggcccagtgcgtggacacaatcaatggctacacatgcacctgcccccagggcttcaggtaaggcaggagggcacctcaggaaggagacagcctgggccaggtggcaggggctggggctgactggctaaggtggccagaatggagactcaggcccaggtggctgtagccccggttctgggtgatgcctttattcccctgatacctttgcagtccttacatgtccccatgagggaaatagagcaggtattggtaatcccacattgtagatgggagaagagctacttgtggcaactccacgtgaaagctgggcttaggttcagcttgtgtaatgtcatgcttgggtaggattccatctaatggaagatgccaccatcttgaagcccagcttgcaaggtggaggtagccacatggccacactggccagaatcttctttctaggatgaagaacaaacatgatggttcctcagtggtaacctctattctacttctgttgctatgaatttggctactctagatgctttatataaatggacacatacagcatttgtcctttgttgggcttatttcacttagtatatagtgttctcaagattcaaccatgctgttgggtatgtcagaattccctttgtttttactgctgaacaatgttccattggatggatgcgccacattttgtttatccattcatctttccatgggtaggaatgtgctcttttaagaaatcacccccaggcaattctgatgacactgaagtttagggacctctactctagtccaactccatgattttatttcttggagccggagtcttgctctgttccgcagcctgaactcgcactcctgtgcacaagcgatcctcccctgtaactgggactacaggctcatgccaccatggctaccccaactctcttaaaaatgggaaatatgggacttagagaaggaaaaggtcttgccccggttagtggcagggctggaactagcccctagaactagtgtcatttcccatctcactctacctctctgctcgaggttctttggcctgagtaactgtgattgtctcctcttggccattctcctatctccctccccattctctcctgccttccagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtgtgtcccgccctgccctgcccttggaaggacctcaacatgcccacaagctctgatagttcagaaaattgctggaatgccccatcttaacagtaaagcaccatcagggacaacactcagcttgaggacatctggaccaactcatccagagagttctatagataactcctgaccagctctcgctgcaaactgcagcccccacttccagcctcattcactcattcctccagaaaatatgcattcaactattgtacaccagacactgtgctgcagaattgggattcagttcaagacagacaaaaccccttgtctgaggcctatccactaatccaagaatctcattctgggtggctggctgtgagtgcaacttctgaaaccagcaactttcaaccttggcaatactttagaatcacctcgagaactttttaaattatctttggccaggtgtggtggctcatgcctataatcccaacacttagggaggctgaggtgggtggatcacttgaggtcaggagttcaagaccaacctggccaacatggtgaaacccagtctctactaaaaataaaaaattagcagggcgtggtggtgcatgcctgtaatcccagctattgggaggcggaggcatgagaatcgcttgaacctgggaggcagaggttgcagtaagccgaggtcatgccactgcactccagcctgggcaacagggcaggactctgtctcaaaagaataaataaataaataataaaattatctttgcctgggccccacccgcaagagattcatgtgtagctagtctggggtaaagtctagacactggaattttttttttaattccccagatgactcttagcatagtgcctggttcctagcaaacattgaattaattatcattgttagcattttctttataactcttattagccaggtgcagtggctcacgcctgtaagcccagcgctttgggaggccaaggtgggtgaatcattttaggtcgggagttcaaaaccagcctggttaacatggtgaaatcccgtctctactaaaaatacaaaaattagcagggtgtggtggtaagcacccgtagtcccagctactcaggaggctgaggcaccagaaacgcttgaacccaggaagtggaggctgcggtgagccaagactgtgccactgcactccagcctgggccaagattctgcctaaaaataaataaataaataaataagacttattattcttctttatacagagaaaccaaagaagggcctgaacttgggcgggatcatgttatgcaccagagggagagggcagattagagttcgggcctcctgacatacattaatatatgaacatagtggtgcacagtaggcactcagtaaaaatgtgttgaactggtttgctcagtcagcacttgctgaggtgtaagtctaggccttaccttctggggatttactgactagatggaggaggaaagatggacatgaatttagacgcagcacagattcagaagctgctgcctggaagagggctctgtgagatgggcagggaaggttcagtctcaggtaagcccttactaacacgccccggctgctttctccaggtggccactgacaaggacaacggcatccttctctacaaaggagacaatgaccccctggcactggagctgtaccagggccacgtgcggctggtctatgacagcctgagttcccctccaaccacagtgtacaggtaagggcctctctccctcctgacccactgtgtgttcctccgcatccttctgcctctgggcctgcaactcagaagggggattcaggagaactcgggtgtcccttctccccgcccctaccacgcacatgtgcgcacacacacacttcctcctcaccgagtggtgagtgggagggagaaaggcgtgtcagaggaagaggcagaggaaggcaggcccgcagaggggaggtgacacctcatcaccataagataaacaggcagctggctactgtgcgggagtgcgcgctgcagtggggacgaggctgcttaatgaggtgcccttttcaaaatgtcatcttaatcttttattagtttaagaaagacaacagggcacaattagcatgcaactcaaggggaagaaactcaagggcacggagggagcagggccaccccttaggtgactttcaaaccatcctgaagggcagcttttcctaaacttcagcctctccagcagccaccctggcttgtgtgtgatgggtgtggcagctggactttcacttcagatgctgccttacagcaactttcaactgctcactttcttttcttttttttttttttttgagatggagttttgttctcttgcccaggctggagtgcaatggagcaatctcggctcactgcaacctctgtctcccagattcaagcaattctcccgcctcagcctccctagtaactaggattaattacaggttcatgccaccatgcctggctaatttttgtatttttagtagagatgggatttcaccatgttggccaggctgctctcgaactcctgacctcaggtgttccacccacctcagcctcccaaagtgctgggattacaggtgtgagccacagcacccagccaaccgctcactttttgcatatagctgctccttaaggaatgaacatctggggaatcacagatatgttagttggatatgttagatttttttcagcttctcagtaaaataaatgctaaatattaaaataaaaatttagttataaatatttttataatagtaataaaaatgactactaaaagttaaaaatgtctgtgttacacctaaaatcatgtcaaactaccagtagaaggagagccaaaccttagggaaaccacagtacaaaagagaggccacactgtcccctcagaggcaagagcacatttcatagggattggtgaagagctgcaactttcagactttcttccccctgctaactaaatcttttcttccattaaaatcttatattaaacttaagaattgtaaatacttagaagcaaaaccgccctgcagtgttgaagcaaagatcccccctccacacacactgttgtcaaggcccctgataaatcatccaacaaacccaatttgaaagccattggttaaaaccagtggttctcaaagcgtggtccccaaggcagcagcaccagcatcacctacagacatgatagaaatacacattttcagactctaccccagaactactgaatccaaaaccctaggggttggccccaacacacctgtgcttcagagatccttccaggtaattctaatgcacaagtctaggaaacaccagtttccaaaggaaaacttcctgcagaaagagcagtctgagttgggccttgaagaaagggaagaacttgtgagagcagagagaacaggtgggcaaggcatgctgggaggtcagcaaagacagatgaggagcaaagaaaagggtgttgaccagagcaagaggctcccagtggaaggtggataaagaccaggcaggttaggacagttgggcacagtggacaccagaagaaagagctcaccctggtggtctccctagagcctgggccgcctaacatctgtgtccctggagccacaggtcctggccaagtggagaggacagagagccaaggaggcagggccagggcagcctgtgaagcatttgctatcacataaatccagatgtgaacaagtgattcagcctctttgtgcctcagtttttccccctcccccttcccatgtaatgtgagcaatagcaggatgtacctcttagggcagtcactgagggttgaaataacactggaggaagtgcttggcagattaagcctttacgcagacatgtcaaggacagaaggtgaaagccaggcttccagaagcagctgagccctgccctgagctgggggccttcccaaacagagcccagcctttgccctctgctgacgttagctgtcagggctggtgatttggtagaaggctggtgtgggtggtaggagtgtcgcagcactgtgctgagttatgaaatggaaagtcagagaattgctgtccagaagctgctgtcagggagccctgagtttgagcaggtaggtggccctggagagacaccaggctctgtcttagccacagggaaaccaagctaaggatgccctggcactcctggcctagatcttcatgctgagcctgtaacagatctttagtacccttcattcagtttccaatcctcaggggcccaaggctctagcaattccagattaaaatgattttgcttccaaacacttttccctgaggcagccctgtttctgttgccattagtacactctcactcattccacatctaccaggccccatgtttgggccagaccctgggctaggtgcaggggccacagagctaaacaaacacagtccagggaggaagacacacatatcaacaagcagtggttccacagcaaaatcaaatcattctcactggagacactggtgtcatgctacaggaacaccaatgatgaagcaaagtttttttgttttttgggttttcttggagacagtgtctcactgtgtcacccaggttggagtgctgtggcatgatcacagctccctgcaacctccacctcccagcctcaagtgatcctcctacctcagcctcctgagtagctgggactgcaggtgtgcatcacaacgtctaatttttgtttttttctggaagagacagggtttcatcatgttgctcaggctggtcttgaactcctgggctgaagcagtctgcccaccttggcctcgcaaagtgctgggattacaggtgtgagccactgtgcccaccaggagcaaatatttttgcttggaggaccttggaggaggaggtggtgtttgagctgagacatgacctgtgcctcagaatcattttctcaggctgagcagcgaggaagccctggggaggaggaggccccatcagcctgcatggaagccatgtgggagggctggggttaatggagggcacagcctgagctgaccagcagccgagggggccaggaggccagtccaaccacaaaaaatgagatctcctcctcagcatcagtacaataacctctagccacccaggaaggccaccttggcctcagggccagagtcagggagcccagccaaagctattctaactgggggagttggcagccaccagcttttggctcactaaggcccactgaccagcttcagagtgaggatgtcagcctgggttcccagcagggacctgcaggctagattccatggtctccattctgtccatgcctgatgttgttcatctgcacagccataatcacaaatggtgatgagggcacatgaagattctattccaggccccagggcaaatacacagagaagcccacctgagcccctccttgccccagaatggggacagacttcactgttccttggcactgagacttgtgagaaggccagactcacatgccagcaaggccaaatggccacataggtaacagacatggggaaaatgggctggagtccccatagggagtggtgggggctacagtagcctaaagggtggagccccatccaaaggagtggctgacctcagctccagcagacactgccatgtgggaatatagattatcaagagaagcgggaccaccggggtttctatgtgagatatctaagtttttgagtgttggccattttaaaacaccgcgtgggtgtgctctttgaatgcaatgcagtgcatgctctctgagtcttgatttctacaatcctgtccactgccaaggtctttgtctcattggatcctcactcctgttttagggatgagaagcctcatattagaagcccagtaagtggcagagctaggatttaaatccgggtcagttttccacccaaaccagctctcccaccgtgctggctccgggacatgaaagacagagccgagagagtgtgggctgtgctacaggagtagggggttgctgcagtggggcctgaggtctccgcttgctgcctacccgaaatcccaggaactttttgttactgcgaggctctatcgccacctagtggtcacgactcagcattcaggttagagcaaccagcacctagaggaataacaaacccttcctccctcaagtcccttaagacttcaggctgaacacctaaagtctctgacccttaagtcttttatttgaaaaatggaggaaaaagtgtgcctccttcctgggggttgttaggattaaataagagaatgcaagttaactgcttagcatagggtagcacaatgcctggcctctactaagggattaacacgtatccaccattattattaaaagcaaaagaaagccaggcatggtggctcacgcctgtaactccagcattcttggaagccaaggcaggaggatcgcctgagcccaggagtttgagagtatcctgggcaacatattcagactccatctatgcaaaaaataaaaaattacccaagcatagtagtgcacatgtatggtcctagctacttgagaggctgaggcaggaggatcacttgaaccctggaggtcaaggctgcagtgagctgtgattgcaccaccgcactgcagcctgggtgagagagcaagacccgatctcaaaaaataaataaatgcaaaggcaaaaaggccatgggccactctggccaatgcctgtggttatgccagttccaggcaggatgcgtccagccccaccctgacaactccagagctctccacctcccacttggcaccagttcagtctggcccagtagataatgaggaagaccctcagagcccccttctctcccctgaaatccttaaatatctctccaggagactaatcattggggcttgggaccactatatcatcatttcttttagtgtgaaccttaggttgttactattttttccttttttttcctctacttttgtcacagtagagccattttcccattattttgtttcaaaggctaagatttaataatgatttttgtttgtttgtttgtttttttgagacagagtctcactctgtcacccgggctggagtgcagtagcgcgatcttggctcactgcaacctccacctcctgggttcaggtgattctcctgcctcagcctcccgagtagctgagactacaggcacccgccaccacgcccggctaattttttgtatttttagtagagatggggtttcactatgttggccaggctggtctcgaactcctgaccttgtgatccgcccgcctcggcctcccaaattcccaacagggatttgtcagggagaattcaaggatgtaatcccaaagtgctaggattacaggtgtgagccaccgtgcccggccatgattttatttttttattttttaaggcaagtagaaatggaggcatcctgacttagggatgctggtaaaaagccagagcctttagcactgcctaccctgaacctccagggatccacagtttgaaaaacactggcttcagccattatatccaggagatctggttaaaagttgccaggaagaggcgacctgttaacccatgagcacctaccggcatagataacattatgggaggtttggatttggaagcaatcctgactttgaacctgagttccagcacttcttagcagtgtggcccctatcgggttacttagcttccttccctaaaatgggactcacaagagtcccctcctcagaaatgggaatgagccagtgggagtatacagagccctgagtggctcaaagccactcaaagccctgggtggctgtaagtttgccaaatccataggcaggttcttccagggcccactaacctactcccccaccccagttgctgccacacccagctccagcaagcccagagtaaggtcaaggagtcatcatttccacctttcactgagcacttgctaggtgtcacaggccacgtattgcccattaaaaccagtgtagggccaggcacgctggctcacgcctataatcccaacactttgggaggtcaagggaggaggatcacttgaggtcaggagttcaagaacagcctggccaacatggcaaaaccccatctctactaaaaatataaaaattagccggggatggtggtgggtgcctgtaatcccagctacttgggaagctgaggcaggaaaattgcttgaaccagggaggtggaggttgcagtgagctgagatcacgccaatgtattccagcctgggcaacagagcgagactccatctcaaaaaacaaaaacaaaacaaaaaacagtgtaggccgggtgcagtgacctgtaaccccagcactttgggaggccaaggtgggaggatggcttgagcccaggagttcaaggctgcagtgagcgatgattgcaccactacattccatcctgggcaacagagcaagacccctgtctcttactaaaaacaaccaaaaaaccaatgttgtaagatgagtataaaactcattgaatagaagcagaaacaggggcttacagaagtgatatgacttgcccagggtccctcagctggcaggcccagtgtgatcccagatctctctcctcaaagcatgacctggctgaaggctatacctcgagcctacctaggattctcccatgtgggcatcagatgaggccctccaggaagcccagcactggggcactgcagaacccagcactttgtctagggcaagagccagtgaccacacagccctctctgatctgtggcttctgccagaccactgtctccaggctgggtacccctgcaggctattcaccagcacctgggatggcaggaagggaagaaggagttgggcctggagccagctgccaggcaggagtaggtggtatgtgttcgctgtgtctgtgtgtgtgtgtctgtaatgggaaaacagctgccctgactccctgaatcataatgttggaagcgagtgcctgagctgcagtctcttgacaactccctttctgacaggtggctgtccagcatgttgacacacctccagggtggtgagctcatttgcatccaaacagcatccatttctaggacgctgtgggatatacctgcatatttttgcatgtgtggttagaaaactgtctgagggctcaaggtcacaagtttatggtctctgcacggggccatccctccccttcctgcttttaccagcccatctgtaggatcagaggcctctgccttgccctcagcttgcaacttggtgcagctggaggcttctgaaatagaaatagctctaccttcatagggctttttggctccccatcaaaaaaccagattcctcagtggactcttttacccaccactccacctcccactaccctatctcttggctagaccttacattgataagttgtcatttactttataggaaaggctaaggaaagtggaatggaagctttgtgagtgcagttaccctatcttccctgtttgtcactgatccacagcacccaggacgaggtggcccatagcagacacttggtgggtgggcggatgaagggtagatgaaggatggatggatggatggatggatggatggaagagagtagataaataagtaggtgggtaggtagagagatggataggtagatggatgcagaggagggtgggtgggtagatgaaggatggatggatgtgatgggatgaatggatgaagagggtagataaataagtaggtgggtgggtggagagatggataggtggatggatggagaggagggtggatggatgaataggtagaatagatggaaaggaagtatagatggttgaatggatggttggatagttggatgaatgagtgggaggagagatttcccaatggatttgagtgggtcctgggctcctgcatgtcctctgccatcactttctcccagggatcagcactagaacagggatcactagctttgcaggcaatggtccttgttagtcttctaacactaaaataactgctcacattttcccagtaattgacaaagcgctcttttgttgttgttgttttttaagaaataggggtcgtgctatgtttcccaggctgaacttgaacacctgggctcaagtggtcttcctgcctcaacctcccagcttgtcaagtaactagtgatacaggcacatgccagcatgcctggttacaaagcactttcacgtaccctctcttattttatttgaacatcacaatagttctgtgaggttattatcccccttttacagatgaggaaactgagaccggatgttctattcctatggttggttatggttccatccagcagtaaggggctagaatggactctgttttcttcagtataccccaatttagcctgtcttctcccaagcatttctcttgcctttttggctgctgagatttctaaatctgagttagtcactgaaatggtccctgcctgcctaatcagtgccaccccctgctgggatcctcttgttggagccaacaaggatttgtcagggagaattcaaggagagaggaagcctccatatgtatccctgatacctgaatagataagacagagctcagtctactcctcagagagcttcagggaaggaagaggtgtcacattccccaactcccatcatctcccaccactgttccctcccagcccccgccgagggtggagcgctggaaagagcacaatttgggagtcaaaagtgttgcctacaaattctgtctcttgcctgtactagctgggtgacctcaggtaaatcacttaacctctctgggcctcggtgtcttcatctgtgaaataggatatctggcacccacttcatagaattattgtaaggttcaaataagtgaaccacttagcaccatgtctggctcatctgggccctcggtgagtggctcttggccctgttagagacagcatgggcaagtaggatgtgcacactgaatatcccataaccagccaggcacggtggttcatgcctgtaatcccagcagtttgggaggccgaggcaagtggatcacgtgaggtcaggagttcaagaccagcctggccaacatggtgaaaaccccatctctactaaaaacataaaattagctgtttgtggtggcatgagcctgtaatcccagctacttaggaggccgaggcaggagaattgcttgaacccagcaggcagaggttgcagtgagccaagatcatgctactgcactccagcctgggcgacagagtgagactccatctcaaaaaaaaaaaaaaaaaaaagtgaatatcccataaccaaaacatttgggacccaaagtgttgaatacttgcattatgctggttcagcatctctaatccgaaaatctgaaatccaaaatcttctaatgagcatttccttcaagcatcatgtgggtactcaaaaagtgtgggcttttggagcttttcagattagggacattcgacctgaacctcagttcaaatccttgctctatgtcttaccaactgtggtgccttaggtaaattccttagcctccctgagctaccgtttcctcatttctgtagtggagataacaaacttacctagcatgagtattataaggcagtatttccccaaaagtggcatgcataccactggtggtacctgaggtgaccttaggggggacaatagcaaactattgaaattttaactgtgagagagtttgttttatatgtactagaaaaaaatataaaaaccacatcaaaactattttttagaacaatgctaacctttatccttgctgatatttaagggggaaattgggcaattgaaaagaacaagcgtgttgagtaaatagtggtccaggcagcatgcagatagagcaggattgagaaggtggtctgggaatggagtttgcttaactctatgaaataatagaaaagaatacaaataatgatagccaaatgcaatacctgaccctagactaaatcttggactggaaggaaataaatgctgtaaaggacagtattgggtccaatgcagaactggaatacagataatagactagataacagtgtggtatccatgttaaattcaccaaagttgacaactgcactgtgcttatataagagaatatctctgtccttaggaaatgcacactgaggtatctaaggataaagggctgtaatgtatgtaacttacctttaaatggttcagaaatgtgtgtgtgtatacataaaatgcacagagaaaaccataagcacattggagtaatgggagaaactgggtaataagcatcttctgtactgtttttatttttgcaacttatgtaagtttaaagttatttccaaataaaaagtaaaacaaaatgtaagcaatgcaggtcaagtccacagcacagggcccagccatggaaggcccttagtgaactctccggctttctccccttctctactggccagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggtaatgccctctttccctaccacctctacctccctctggccctctgtgctccagtacagaaacccaggccactgccaaagccaatcagggaaggcttcctggaggaagggacaacgaagctgatctctaaaaggtgaataagcactagccaggccatggaggaaagagaatgtgggacaggtgcttggaaaggaaagagaacaggactcctggaaactacacgttgtgacgggcaagggtgagaagggggaggcaggagatggaagcagggtctaggctctgctgaagtctgccagcttcaggtcatattccctctgctctgccacctcctcaaaccctcggaggttcaattaatgaatgtagaagaatttgagattaaaatcaaaggccaaaaatggaagtaggccaggtgcagtggctcacacctgtaatcccaacactttgggaggctgaggtgggaggatcacttgagcccaggagttggaggccagcctaggcaacacagtgagacctcatctctacaaaatatttaaattagctgggcacagtagtgagcacctgtagtcccagctactttggagggtgaggcagggggattgcttgagcctgggaggttggggctgcagtgagccatgattgtgccactgccctgcaacctgggtgacagagtgagaccttgtctttaaaacaacaacaaaacacaaaaaagtagccatcagttaggcagactctgggcctgaaatgcagcccctgcactgatagttctcaaggggttaagtgtaaaaaaagctaccaaaactgctcgttcaatcctaagattcccaagactttacccagagtccacctgcagagactagcacgggcccagaagagggtgttgttaatgggtggttcagatgtagggaggccagggaaagctctgtgccgagggcagccccagaagggacaccacttatccctggaggaggaccgtgccctgtgccccacctgctccaggtgcacccagaacggaactgggtgccctgcttccaggccagtcccaggctctcaactatagaaggtgggcagggaatggtgtagaaggggagcgaaaatacaaattattgaaaagcaaattaggtctttactaacagtctcttgaagatcctgagaagaggggtacaccgcacataaggcagcaaactggtctaaaaaccctgaaccccaaagtttcgttgatcaagcagctccccaaaaccttatcttatctcctcagctgtagctcacctgccctggattctcttgtgaggcctggatcaaagggctgaggagcctggtggggacagcaggttatttggtgcacttgcctattggggggaacggtctcctcagttcagccagtgggatcatagggcaatgggtgaccagatcatctcattttttctagggaagtccaagatacaaatttttatgggaaattttctaatattacatattggcaacaaattcacgtttttttaaggagtcccagtgcaggaccaaggatgcacgtccctgtatggaggaggtccgaggttttggcccgttaacctcgtttgaacagcagaggcccagagttctggccatgaatgtgtgaaaagtgctttttcgctctgaggacagcagggtggcaggggagggtcttcaggccactgtcctggctcccctcccacaggcatccccacctccaccggcctctctgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacaggtcagtgtcccaggagccctggctgtgtgctcgagctcccagaatggcctcagtccctaccccacctgagaaataggcactactggaggctggaggagttgcagtcagaccgcagataggatctgtgtaagtgtaactgcttaagaggtcaagaggctgagcttacacatctgagcagccagacctgcttggagggatcagcataagagggccctgctcaaaacactagtctctgccaggtggcctttagaacctgtccagagccacagtgagcccccactgtctctgtgggaattaaaaaaggcacccacatgggcagactcagcctgtgcaaggcaccaggtgtatataaccacacatcaaaccacatttaatagtttaagcaactactcattcaacaaagatttactgaggtcctactacgtgccaggcctcatgctaaatataggagatccagtactgtcagtgttaagaaacctgaatcagccaaaactaacaccagagccaacactggaaatgtggttggctaaaccagtcaggaaatgattttttggatcaggaataagggacagctatacagggtttgagcttcttgtgttgctcttgagcatatgtgtgtgtgtgtttgactctataatacggatcctggctctgcatgtcatctcaataggggcagtggtgcatcatgattcagaatataggctttaccttcatttttttccatgggtgaaatgtactgcataggagcagcagacaagaggttatgatggaaattcagagcaatactgggtgtaaagcacttaacacaattcctggtacatagccagtggtacctgctggtagtagtggggtggtagtaattcttatttaagatggtaaagcaattaaaatgtttagagaatggctagattctttcaagcagttgtttgctacttggctgcatgaggtgtgtgtgtaaatcagcaagccagcctctgctgtggtcacagctcacagtggacactgggtgacactcgcaggcttctggctggttggccaggggaaccaaggtggttaagaaaagagatgctcagcctaggaaacagagaaagctattggactgtactcagctccgggtcccctggtccctggctgggtggacagagggagtccccagcagcaccaactctgatccagttcccttctcatcctcctctctgcccctagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaaggtgggtctactgtgcctgtgggagggaggaagtgggggtcagagttggacttcacatccagatcacctcagttccagttctggctgtgccacttaaaggctgcatgaccttggttcagtcactttctgagcctcaattccctcaacttgaaaacggaggcaatactataccttcctgtatcagttatctagtgctgcataacaacttagccccaaaccatagcagttcaaaaccacaaaaaacattttttttagcctacattgttcctgtgggttgggaattcagaaagagcgtagctgggatctctcagggttgcattctacacagccatggctgcagttctctgtaggctaacccaaggcagcaggatatgcttccaatgtgctgcactcccatggcgctgggtgttggcgggaggtcccagttctgccctgcatgagtcactacacaggctctttgagggtccttgcgccagggcagctggcatgtcccagagtgaatggtccagaagagagtaagccacttgtcttgtatgacctacaattggaagtcactcacaccatcatttccaccacattgcattggttacatcagtcaggtacattcagtgagggaggggaccacataaagggcatcaataccagaaggtggtagtcactgggggcaatcttggaggctagctactgtgcttctttatagggttgttgggaggagtacgtgagatgttgagatgtaaagtcagaagcaacattgtcacgatgaaggccaaactgtcatttagaatctgcatgaccttgactatcctggccaacatggtgaaaccctgtctctactaaaaatacaaaaattagctgggcatcatggcggtcgcctgtaatcccagctatgctggaggcgaggcaagagaatcatttgaacccaggaggcggaggttacagtcagccaagatcaacctgggtgacagagtgagagcctgtctcaactctgcatgacattgagcagcatacttgtggttcacttcctcatctagatagggccaggagtggtggctcacacctggaatcctagcattttgggaggccgaggtgcaaggattgcatgagctcaggagcttgaagctgcaatgaatgcaccactgcactccagcccaggtgacagagacagaccctgtctccaagaaaagacaaaagtgcagataactcatactgccaaagttaagattctaaagcatggactttttaaagatgaaacaagtgtagaaaatggtcctcagtggacctctgcagggagaacacatgagcagtctggatggttcttttctcctcttttccagctgttggcccttgagatgccatgccttcaaaactaatgaaaccctagccactcagagtggccccctgacattgaccagcaccactgacatcacctgggagtcacctggggctcccaggccccaccccagcccttttgagtcagaacctgcattttgcaatgattcgcatatgtatccaagctgatggcattgctccacagcctccatccaaccctcttgcccttactgggtcagcagaagccagttctttggtctgacctaaacaaaggaaattatattaatattaaaatggttgtcttaccttgggggatctttctcctgcatggacactgagaagtcttgctccctgccaccaggatcccaggcagtccaccccgtgccttgaggacttttccacattttatacctacacgaaatactattcttaaccaaaactcatttttaaaatgttattaaatagcttattctgaaataatttcagacttacagaaaaactgtcaggacagtataaacagcttaatcccttcaccccagtcattagcatgttgccccatctgcactccctgtctctccccatgttatacacatgcacatgcacacattgtcattaacctctttctaatccttttaacaatctcataattttaaagacttttaacaacacctgaagctttaaaatgcataaagccctttctccttcacaatcgcctctggtgcccgtaacagcctgggagttgctggaaggacaggtaaatgtgttaccactttgcagacacggaaactgtgacttgcttgtcaagggtcaagggtcatggctcccttcctcaagtgccttgctgcagacattctcccactgtagtgaggacagtagaggggtggaaatgaaaagctgggtcagggtccagagtgtttaagcagatacaggggtgccctttcccagcctgcagttatttctaggccttctggaaaagctcatcgcaacacctgcttcttattcagatatcaactccagctcatttcccagagaagcctccctggcccctgggccaggtcaaatgccttttgaatacaaatgtcttatagcatacaaaaacatatactgtatgttcttgtatgaacatcttccctttctttatagcatctacctcagtttctttattaaatatattcacttaaatagtatctagactctaggccaagagagacagactattgggagtggtagtgactggggcaaactggagattgcctgccccatctaaagcactcagcttcagccatcactgcagtgcagggttgcaggctcagctctgccagacctccttgttttcaaggaaggcagaaatccagattttcaggtgaaatctcctgctttttgaatgttgacatttaattaatttttaggcacatgtagggtgatccaaattggtctggggtcaggatttggcccacagtctatcagtttgcgtcatctagttttagttttgactttaggtttcttgaaggaagggaccaagcctgcttttgtcatcattatatcctcacggcttaggtgtaagcctgtcagagagcctggtacaggaaaggcacctgtttgtaaaatagatgggtggatggaggggagggtaggcagatggatgagtgaataaattcttacagtcttcagagcacaagtatttcaaagcagcctacctgggaactgctcatggtcctgctggccacctagaccaccaatgccctgacttctatgccctctgcagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgaggcaactggaagaaggaaggaaggaaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccgcagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggtgggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactc

SEQ ID NO: 36489 - DNA, 639231 bp, Homo sapiens; identical to SEQ ID NO: 36488

SEQ ID NO: 36490 - DNA, 136034 bp, Homo sapiens
aggtcacattcagacagcacacctttgcccaattttctttctggatctcaccgtcctgagtgttgtacctgcaggttgctcacagcctctggagcccaagatagtctcccctttgggaggaggctctacagtggtccctggcgaagttgtgaagaggtgactatcatctcaggcacatcaccttcccttttccctgtgggccttcctttgctgtttcctgaacaccatgctttctagttcctactgggagtgaacacaccttgcatggagcatcttcaggccatggctaactcatgctcccatcttgctcctgcaggtctgccacgtctctgtgctcagtgtcctctctacatcctgtggcttgagcctgagcttgcccatattccctggctggatggagtggctaagccctgatatcgctctgcccagaagagatgagtggactcaaacttctccagccaggaagaggatcacgcatgccaaagtccagggtgcaggtaagtccatctgtcactggcttgaggctaggagagtggacctgctcttgttaaaggcagtgttcaccatgtgtgtgtgtaaccggggttggagggggagagtggggtggggtgggggggtgcagtaaagagcagggcaggacttcacgaagtgccaggattcaaacaatcctacggcatttatgtgatttatcaccagtttgctgattcagggctccttctgcagtttctgctcctcgctggtggccacctgaccctgtggcgtttgctccttccacctgctgttggccatggggcagatgtggaggccaaggaagaataggacaatggcgtttggggcagacaggcctgggttcaaatttcagctctgcctattcctagctctgcaaaccttgggcatgtcacctgtcttctctgcctgaggttcagatttcttcctggtaaattggggctaatacttattagacttaccgtgaagattaactgagatgatgtgtgtaaattgcccagctcagctcagcctctggcatctggtactcaacacataactcttctctccactttctgtcttgcatctccccatcttgtttttgagtggatcactgaaccacaaatatccacttggcgatgaagtctggggaacagggacaaataccaacacttcccatttttagatttacacgagactaacagctttccttcccacagtggcaacagagatttgcagagcagatgtcttggtgtgaaactgctacgaggaggtgtcctgtaaatgtttgctgacaaagcagcaaagcagggtttgaccttccagctctgcctccccgcaccaggctgggggattcacccaccccactccgtttcctgtgcgttcctctttctcagaggctgtgggcctgtcctgctgtccgatggcatcaggctgtgggacggggggccatcaggttggttggagcaagctgctcccatccggacctgtgtcaggcagcacttgttcaagaggaggctcaagagagtgatccaggatgcagggtttgggaagaggatgcagcatggtggggggcgacctgtccaagcgcagagaacacttttccaaacctcactgccctgggccatcgggtgctcctttgcctttgcttggatctaatgattataggcctgagcttcaaagcaggttataaacccgactaattgctggtctaggagagctggacgaggaggccaagcctgcccagagtgggcaccccggactgggccttctcgtgggactggcatttccaaccgggagcgcggtgctggggccgggatacccggggtggccgcaccgtcctgctggctccttgggtggctgccgtcgctgctcagcgcgggtcggcggcgccgcctcccccaccccggcccagctctgctccggcaggtggaactctccccattcaaacccgcgcgggccaatcagggccgggcgcgccctggccgttccaacgcttggggcagccctacctcccgctcgcgctcctcccgccctggagactccggttactggggagcaacacagccgcctcgggttgcagacgctcctgtccgggtcgcagtgggacgccatggagcgctccctgcaccgcgtctccctcgggagccggcgtgcccacccggacttgtccttctacctcaccacctttggtaagtgcccgctggggctggcggcaggggctgcttcaccctgctcccagcgcccagaaacgcagcccctcgtggtgacaggggaggctgggagcaggtgctctttctatctaggggcaccttctctggcccctttctcctgtgactgcccaggaggggctcagggcacaggctcagtccaagcaagctgctggacaccacctgctgcccggccatgagtgccaactgcggttggttctgcctcacttggctggaataatcacgctctggttaatctttcagagacctgggttgtcaccacggagtttctcattagcaagcagctcaggttaaatcaaggtcttgttatagcaactggagatctcattcacccactttcctttggctcagggagcggacaggtgctgggccctttggccctgctgccttgtggggaggctgcaatttgactttgttgggtatctgagccacagtggagatgggagaattctctcctccaagaaagaacaatcccttaggagggtcccagggctgcctcagggtttgaggtggaaagaagtgaacagtaggcttcactcccaagcccctaagtagcagactgagttcccccaaataacagctgggcggcagctgcccaaaggtctgggcaaacctggccttcctggtagccatagtaaaggtaacaaccctacccttgagggtaacccttcatttcctcactggtcctgcaactctctgtggagaggggttatttttcctctgtgaagacttgaaaccaagagatcttccatgagccagtggcagagttcgtagctgagctcaagctttccagagatgacctgtccagcgcatttttgtttgaacttgcatacaatttccttctaaaggttggggctgttactgaaacattactggacattgcccagctttcaaagacagagtgcccaaggagtttggtccctccctggggttcctggctcttctgttttcaggcttactcctgctcaacatatttggttttccacaacctgctttttttccttaggggtagagggaatgatggaagagcagtggcttggcctctgaaattgcctgacgtctggcagcaggaattcactggtctagttggtggacgataaagggcaattaactagccatcatttgttgagaacttaccattgccattccttatgccaagtgttttacctgcattatctcacttaatgccccagcgtaggaggcaattcctgctaaccccattgggatgcagggctctgtgagacaagggtggtttccaggatgatctgtattggctggggtaggagtgatcaggaaagggtgtcagggagctgtgaggccctcttaccttagctgtgtcctgattaaaaagtaaaaatatgtttgcttttttcctccttattatcatggttacatgtgtttactgctgaaaacttagtgaaaagaagaaagtgaaaatcacttgtaatctgacttcccagggagaccactgttaactttctgatttatatcctcccaggcttatttccacacctatttctgtgtgtgtgtgtgtgtgtgtgtgtgtgtgtgtgtgtgtgtgcctgtgtgtatttaggggtcaaatttcaacacaattgagatcaagtttgtatggacaattttgtaacccatatgttttccttagtggcctgatgtgaatatttccttgcattggtccatgttcttctattagattaatctgcctgccagatctgggaagctgaggagggttcaggcccagcagggagtggatcttcctgcccagccatggcctcagggctgagtctgatgggtatcagggaaggctgctgcttgaacaagtgactgtgacctgagtgtgcaggaggcagacaggagcctgggtggggtgggaagccacctgctcttattcgtgcaggctcctctcacatctctctaaggatgcttatgagagcatttgagaaattctctcctgtttcctgcactggctctgtttccctgggtgccatttgtcgtggtgcccctctttcaggctgctgattttctttatccactgtgatcttcactgatctgcttatgagcaaagattcctatcagtggtttccaaacccagccaaatatcagaagcatgtggggagcctgttaaaaatacacagattcctagaatcttcttctggagactctagtttaataggtctggggtggagcctgagaatatgaacacttaagaagccatagagcgttcagactgtcatccaggtttggaagctatggattcagagtcagttttggtagcaattgggaccacttttactgtgaaggttttggctaagtttttctcagttcactggcctttccttagcaaagtaggtagcccctggccttctactgtgagctttgccttggtagaaccagatgaagatgttgcttagctggtagtttcctgagcacagacatgtaaagggagcataatcatctatggaaatataaagagacaaaactgttttgatgagaattcccttcggggagagtactgcatgatatatgtatttgtgtgtacacatgaacacaaccccttgtcccccaaaaggagtatgttcaagtgacattaattgaaggacactgcgttctgaggaggtggccttacttcaggggaagggagtaggcaagctgaggctaggacccaactactctagagggatttttttttctttattgtgaaaaatgatgtaatttgaagtcattgtaggtatacataatatttttctccaggattgtatattttattttgattaggatatttgctgatttttcttgtaacagctttattgaaatataattcagatatatacaattcactcatttaaaccatacaattcaatggtttttagtatattcacagagatgtgtaactattatcacaatttcagaacattttcattccctcaaaaagagacattatgctctttagcttgtaccgtcctcccttgtcccgagcccaaagcaattgctaatctattctctccctctgtagatttgcctgttctggacatttcatataaatggaatcgtatttttttttttatgactgacttctttcacttagcataatgttttcaagtttaatccatgttgtagcagatatcatactccattcatttttatggctgagtagtattcattgtatggctataccacattttaaaaatttattcatctggtgatgaatattttggctgtttctcccttttgactattatgaataatactgccatgaacatttgtgaacaagtttttgtgtggacaaatgttttcatttctcttcatatacacacagtatatacctaggagtagatttgctgagtcctatggtaactctgtgtttaactatttagggaactaccaaactcttttccaaagtaggtgtatcattttatgttcccatcagctgtgtatatgggttttggtttttccacattccttaccaacacttgttattatctgactttttaattctagctatcctagtgggtgtgaattgatattcactatagtttcgatttgcattttcctgatgacccgtgatgttgaacattttttcatgtgctcattatttatatatcttctttggagaagaatgtattcagatcttttgttcattttaaaattgggctttttgtcttgttattattgagttgtaagatttctttatatattctagatgcaagctccttaaccgatatatgatttgcaaatattttctctctatctgtgggtttttttcactttcttgatagtgttcattgaatcccaaactttttttggggatggggtcttgttttgttgcccaggctggagttcagtggcatgatcatggctcctctttgaccatgcagcctcaacctcctgtgcttaagcgatcctcccacttcagcctcctgagtagctggtactacagatgtgcaccaccatgcctggctaatttttcttatgtaaaaaaaactttttgtagagatgaggtttccctatgttgcccaagctagtcttgaactcagggactcaagcgatctcctgccttggcctcccaaagtgctgggattataggcatgaaccactgtgtccagccagaaccccaaacatttttaattttgatgaagttcaatttactttatcttttgttacttgtactttgtgttatatctcagaattcactgccaaatctaaggttctgtcagttaccaagagatttacctgtatgttttcttctaagagttttatagttttggctcttatatttaggtctttgatccactttgagttaatttttgtgtatggtatgaggtaagagttcaacttcattgttttttgtggctatccagttgtcccagtaccatttgttgaaaataccattatttctctattggatgatcttggtacctttactgaaaatcaattgcccataaacccacggcttatttctaggctttcaattctattccattgatctatctgcctattatcattccagtatcatactgtcttgattactgttgctttgtagtacattttgaaatcaggttgtgtaaatcctccaattttgttcttctctttcaagatcattttggctgtcctgggtcccttgaatttccatatgaattttaggcataatattttatatagaaaataaaaaaactcaagttcacaaaaatgttggatagatagttttaaaatatcatcttgaagggataccaacttattagtttgactgatgaagcaaattattaatttacctggggtctctgaaccaaattttaacttgcttgggatctctagtcacctggatatggtgagtggtcaggagagagaacaggttgccttttctgcagggtatctgggtctggagatggtgggcaagctggacatgttctgaggtctgcaggtggctgtggacattgggtgacaaaatgcacctctctttagaaatgccagccccctatgaacctacaaaatgaaagctgtcgggagcagctctaaatgtaggctcgagaggactgcctggagtcactgatttgccatagggaagttgggaagatgtggttctggaggcagagtagacttaggagtgtcattgatttgctcagcattttttttttttttttttttttgcctcatgtttgttgtgttggtacaatgttagctggggcctgtttcactcctttctctgcctctctttagaagccgtggagataaataattcattttctgtagtgagagtgaagcttgggaacagatgtcagccagctgcgtggtgtgttgggcagtgcacggtcaggccctgaactggaggccttcaatgtgtccctgccagctgcccctggctggcacgtgtttccagtcccactgctctgagcctgggagattccctggcatggttggggaaacctatccaactgtttctcaggagctcatcatttgctggtcatactcctcagcatttattggcttttctgtcattcagagtccaactgctcaggagctttcagaaattcctcaaagtttctggcccatagatagccctttgtcctcttttcccattctgctttgtgtgttcttcttaaacatttaaaaaagtttgaaatattatacagacagacagaaaagtgtccccccaataatgtgcaatccagtgacttctcacaaaaaaaaaacctttgtaactttcaccagagtcaaaaattgaacatttctagtatttagaagacgcatgttgataatgcagtttttttctttatcatttacttcaaaatattttctaattttcattgtcatttctttttcaatccttgggttagttagaagtatatttctaaatttctaaatattggggattttctggtaatatttttatatttactttgcattttagtcagagaatatactctccatccttttaattccttgaaattaatcaaaatttacttgatgcctcagcatatagttgtttttttttttttttgtcgttgttgttttgagactgagtcttactctgtcaccaggctggagtgcagtggcgcaatgtaaactcactgcagcctccccttcctggattcaagcaattctcctggctcagtctcccatgtagctgggattacaggcacccactaccatgcctggctaatttttgtatttttagtagagatggggttttaccatgttggccacactggtctcgaactcctgacctcaggtgatccacctgccttggcctcccaaagagtcaatttttataaatgttctttgtgtatttgaaaaggattctgcagcagttgggtgcagtgttctttgtgtatgtcaagtttaggtcaagtttgctctttatattgttcaaatattccgtatccttgttgatttttcctgttttctctgtcagttcctaagagaggtgtattagaattcccactgtgattgtaaatttgtctatttcccattgcagttctgtcagtttttcctttacatatgttgaagctatgttaacaacatacagatttagaattattatctttctggtgagctgaaatttttattatgaaatctattattgttatgaagtcttctttatttctagtaggtataaagtctaattttcctgatattaacatagctaaccatgcttctttcatttaatatttgcctgacatatctttttccatcctttttctttcaacctttttggatctacattgtaggtgtgctgtgtctgctgcaaagaacaggcacatggctgggagtggtgagtggcccatgcttataatcccagcactttgggaggccaaggcaggaggatcactcaagcccagaagttcgagaccagtgtgggcaacatagtgagagctcatctctacaaaaaataaaaaaattagctgggcatgatggtgtgcacctgtggtcctagctacttgggaggctgaggaaggaggatcacttgagcctaggaggtcaagactacagtgagctgtgattgtgatactgtaccctagcctgggtgtcagagtgagaccctgactcaaaacaaacaaacaacaaacaaacagtataggcagagagttgttgttattattattattttcttctcaatgcagacctaggatgatattttccttcaaaaaatctttgttcgtttgtcaggtgcctagggtcactgggttagtcttaattcagtgttgggactgagagtacttgaaatcgagctgtagtccctggagtagctgtgtctgattacagttcactctattcctatggagcaacccttcagggtccctatgcaaaaggtggggctcagaagaaccctgcttcttggtgggccctggtccctagttcctattcctctagccctgagaagcaggcagaaactcactcagtctcttgatctctcaatcagccctctggaatttgaaaacaccccaggaggaaattagcccagaaaaacactaggtttccttctacagtcctccattcccctagatcctgcctggtagctcctctctctcttgttgtttatctaagaagatgctttaacatattttgtttagcatttctagttttcctcagtggatctgtcatcccagaaatggaagtcccctacatatattttctaagcttttttgagttggtttttgtttttttttccctccctttctgcctctctccctccttttctcctccctccctgcctcttccgtcccttcctcccctccccgctctctctctccgtccctcctttctttctccctgcctgcctgcctacctgcagttgtccgagcaggcattactggggctggagggtccctttccaagatggctcattcacatggctctcagcaggaggcctcagttccttgctacctgtaattaggaggcttctgtttctcatcgcatggacctcttcgtaggattgcttgagcttccttattatgtggcagctggcttccttctaggcaagtgatacaaaaatgaaagcaagaaagaactcccataaaaagatgagtaacccagctcaaaaatgggtaaaggatttgaatagacatttttttccaaagaaaaatggctaacagcatgtgaaaaaatgctcaatgtcattagttatcagggaaatgcaaatcaaaaccacaatgagatactatcatactagaatgactataataaaaaaagagccaataacaggcgttgaagaagttgaggggaaattggaacccttgtacactgccggccggaatgtcaaatggtgcaaccactttggaaaagtttggcggttcctcaaacaattaaatgtagagtttccatttgacccagcaattccactcttaggtataaatccaagaggaatgaaaacacatgctcacacaaacatgtgtacacacacacatgttcataacggcattattcatagtagccaaaaagtcgaaataacctgaaatatccatcaccagatgagtggataaacaaaatgtggtatatccatacaatggaatattatttggccacaaagggactaaaatactgatacgtgctacaatatgggtgaaccttgaaaacattatgctaagtgaaagaagtcaatcacaaaagaccatgcgttgtgtgattctgtttacataagtatccagaataggcaagtccttagagacagaaagcagattagtggttgacaagggctgaggggagaagggaatagggtgtgactgcgaaagagtatgggatttcttttaggggaggatgaaaatgttctaaaattagatagaggtgattgattacagaatcctgtgaatatactaaaagaaaattacatgctttaaattggtgaagtgtggccgtgcacggtggctcaatcccagcactttgggaggctgaggcgggtggatcatctaaggtcaggagttcgagagcagcctggccaacatggtgaaactctgtctctacaaaaaatacaaaaaattggccaggtgtgggtggtgcatgcctgtaatcccagctactcaggaggctgagacaggagaataatttgaacctgggaggcagaggttacagtgagctgagatcatgtcattgcactccagcctgggcgacagagtgagactccatctcaataataaacaaaactgatgaaatgtatgatatgttaattatatcccaatacagctgttaaaaaaagaaggaactaataatacctttaatatcctaatgttgaaagtcatccactgtcatttctaccacattctatttgttagaagcaagtcactaagtccagcccatgtctgaagggaggaactaggcttcacctcttgaaaggaagagtatcaaagactttgtggacaaattttaaacccatgataggtatagagaggctaacagtgggggccctggactgcctaaatgcaaaccccagctctgccacttactggctgtgtgatttggacaacctgttttagctattttcttttttttgagttggggtctcactctgttgcccaggctggagtgcagtggtgtgatcatggctcactacagcctcaacctcctgggctccagtgatcctcccacctcagcctcctgagtagctgggactacaggtacacaccaccacgtccggctaattttaaaaaaacgtttttggagagacagagtcttgctatgttgcctagactggtctcaaactcctggcctcaagtgatcatcctgcctcagcctcccaaagtgttgggattacaggtgtgagccaccatgcccagccaacctgtttacctcttaataatcttcagcttccttgcctgtaaattgggataaaagtagtaaccatttcacggagttattgtgaggagtaaaagaaataaaaagcttatagtaaagtgctgagtacctagtaaacatctaagaaacattgactttgttctctccatgtgtgtgcctagcctggtagttcactatggccctgaactctgggttgagatgtgtgtgaatcctgtaggatgtttggatctgagccccacaggactgctagtggtgttatgatccagccaagattagatgctgactgcagtagattcaggagttttattttaccagcttgcccaggacggacctagaatcccttgtgagtgatccatgggaatctaaattatcaagagactgaatgctaatttattagtttatgctgaaaaatagaatttctgagtagactagaagacttatgctggccggagcaatctctttctgtaaggaaaaagagcttgggaaactacattaatatcagctttcacaggaagcagagaggccaggggattgaactgacccatcacaatttttatgccagtgctgtgtgtcctatgtcctcaccttcgcaaaccagggccacttttttgaatggaactcagggttctccttcttttaacacagtagccatgggaaattctcctgggttatgtccatagagctgtgtggctgcctgtttcccagcgccactgcagcctaccatttctcccttagatcaagcaggcagtgaaattggtaaacacatgcttaaccatttctgagcctggatcagggctggggtgtggatgaggcagctgaagaccacagagagagggcgtgcctggcatctggctgggcaccctccctcctgcgaggaagacttgagtacagacgtgtcctcataaacggaggggaaatctgtggatgttagcggctggctaggctccatgtagacccaactgccttcatatgtttgtctggatatcatcacccttcctgtagcttttaacatgtgacagttcttaaatgggcagcggcttctggggtgaattggattttaggatgcctgctgcttcatgctagccaggcaagtccatcatagatgtattctctgcacatctcagggtggcatgggctcccactgggacacattccggctgatccctgagtctagcaaaggtgtgcagtccccatctacttcctttattttctgagtatgtctctttctgactgtggcctgtgggttagagttcatctgtggttctctactgagtattgtctgccagactgaatttctttagctggtgtccacatccatttaaaagtgcccagtaagtctgagcccttcaagtcctgtgcccagcagaatttgggtttgttgccttttccaggctttctgaagctcattcccatccagtatttttcctgccatatggggccctgtctattctccctttggctctgggccctggtacacacttgcagcctctctgggcatccatcaccaccaccttttgcacatagtgttggtgcccaactgcgatctcatgggaacaggggacatgccctgtccaaaggccctgcccaacctcgatgaggatgacttcaagccctttagcctgactgctccctgagtctagggaggaatggggagtgttgaaaaaaacagaggtgtaggagcaagaatattattgggaaaagttttaggtttttgttttttgagacagggtctggctctatcatccaggctggagtacagtcgtgcaatcatagctcactacaacttcaacctcttgggctcaaggaatcctcctgcctcaacctcccaagtagctgagactacaggcacgcaccacggtgcccggctatttttttaattaattttttgtagagaagggctcttgctgtattgtccaggttggtgtcaaactcctggactcaagcaatcctcccacctcagcctcccaaagtgctgggattacaggcatgagcgaccacaccccacaaagacaagtttttaaaggaacaagcaaatttcagaacaatacatagggtatgtatctgtggagggaggttgggtggggggggtgttctgaaaggatgccaaattagctggtgcttcggtgagctgaagactccagggattcagccctacttccccttcacctggaggtttctttctctagattggagacatttctaggaggctgccctctattttttttctttttcttttttttcctttgagacaggtctcacgctgttccccaaggtccaggctggagttgcagtggtgtgatcatggttcactgtgggctcaacctcctggattcaagtggtcctcccacctcagcctcccaagcagctgggactataggatgtgccactatgctcagctaacctcttggtttcttgagaaaagctgtggcacctggtgctgtccccgatggttctctctacctctgaatctgaaggttgtgttggcaaacgcagtgggcacagcagaggaggtgcgtgctagagggctgtgggtgttccagaagactgtgcacaggaaagagtgctggagtgggggtagagttctaatctccagctctggattctctgggcccagagcaaatcaccttccatctcaggcatgaccgttctggctacaaaatgaggagactggacaagatgacttcaggggcctgtgtgtcagacatttggtggagtagcatgatggggggaaggaggggacaggcatggccgagggagggatcttgtgaactggggcaggtgtgtcctggcctggggagcctggagtctggtctgctgggtttggtttctctgctgtaacagggtacagggcaccctggccttcctgagaagcccctggctggcagggcctggaacgggagcagtgcagtgtggtgcaaactcatctcaatcccgagtcagcctttgcccctgggcctttgtcagcctccagcttctcacttggccttgcccaagtccctgtcctagccactgggctgtgagccctgtgagggcaggcacctgcccagcctcgtgcagatgcccagcaaatatttgctaaatggaattagtgaccatttgtgtctggagatttcctgatcctgacttctgggcaaagggccactgttagttaggtgataggtgttgtggagcacaggggttcctgtggctttcggatccaagcatgtttgtgccagagctggctttgcacaggtagtagtttcagaaaaaatgtttcatgttaaacataggtgtctttgagttggtgaaattcaacccatgactgcgggcttcgtttgcctgtttccaaacctctctctctcccaccccacactagattgggcacagttttcataggtttctcagctctaggaagccacaatgaagtaattgctcagactttgagataatgataccgtcagttctcccggcgcctttcatccaaggagtcctcctcacctgccagcattatctgatcacagcttggagagtgccataacccctgttattagctctacctcacatccatggccactgtggtcctgaaagaagagggcagttagggctggaactgaaacaggattcctgggcttctgagatctgggtcctggacaggagaacagcagatatttctgatggatgacgggctggaccagggtttgcaggagcctgaattgcttgggactgaagcttaaccaccagaagtatgagggtcaagtgatgtctgggtcacagtgattggtggacttatgcagagttaggagacatgaagggttctccaaacctgttctctaaccagaaacaaagcaaagccccagctgccagcctagtttcaagaggcatgtccagagctggccagatgggatgatgaggggatgtctcactgtgctgtgagggattgtggaaggactttggagttcaggtctagaggaaagagcccagagaatgcagaactagatccgggcaatgaaagttaccgagaggccactgttggcttaatataagatgcagcattgaacaatcagagctctttcaaaagggaaagggctcccaccacaggaagcaagctccccattgctacaggtgactgggcagagggagggcacagctagccagggttgtcacagatggagccatgcctgggctttctggtagacggccctgccctgctttctgatgtctccagtgcctgtccatggggtggactgagttcagcagctttttgaggtcccagggaaagtctactggactgagagaaacattttcgatgtcaccgaggaagaggagtgtgaccctctctctcttctctgtcttggctggaggccattgggtatctgtgaggatgacctgaagttttgtcctgttttttctttttttaaaaaatttaaacaaaaatgggaaaagccaggggataaacctcacccggccactcattcttgccctgccttccagccccgtccttctgttctctttacatgtcccctccctccctgttctcctcccttcctccctgctctttctcttcctcccctcctttctcctgcctctttccttcttcctttgtttcctctttcctttctttttaattatagaagtgctatagttcgtggatatatttgaattattaaaacaacaattgtgatagattgaaattcctcttgactaccctcctccaattcctagtctgttctctagcagggatcactgtttttaatttggcatcctttcagaaccctccctcccccgccagatacataccctatgtattgttctgaaatttgcttgttcctttaaaaactcgtctttgtggggcgtggtggctcatacctgtaatcccagaactttgggaggctgaggtgggaggatcacttgagcccaggagtttgagaccaagctggataacacagcaagaccccttctgtacaaaaaattaattaaaaaatagctgggcaccgtggttcatgcctgtagtctcagctgcttgggaggttgaggcagaaggattgcttgagcccaggaggttgaagctgtagtgagctatgattgcacgactgcactccagcctggatgatagagccagaccctgtctcaaaaacaaaacaaaacaaaacaaaaacctaaaacttttctcaataatattcctctgccaggttgtatggtgctcctccattctttataacagctcatactattccatatacagctatagatggtttacttcactatttctatattgatgaacatttcaggtgtttccagtttttccttaaacaatgctgtagtgccagcctttgtgtgcacgtgcttgtgtttgtctacgacagtgacctggaatgaagacttttaggtggaagaatatgcacatttaaatttcagtagatcttggcagaaattaccctccattttcactccttccaacagagaatgacagtacttgttctcctacacctttaccaacatttgacaacgacccagcagtgagatttcccagcatccacctggctgcctgtacagtagtgagctccccatcaccagaggggcacaagcaaggctagagaaccactgctggaggcattcgaaagggactcccgatgtggtgggcggggctgaaccctgtggcttctgaggtccctgccagccagagacttgtgtgagtctttgaatggcttcacatgaacaaaagagcatttctgtcacctttcctctagttttttccaccacacccaccagggagctgaggcaaggttgtttctgttgctgtttccttaggtcagctgaggctgtccattgatgcccaggaccgggttctgctgcttcacagtgagtacggctttgtgcaggctcaccaaggaaggggcgggccactcagcttgctgcctggggctggggttgggggatggtggcaccatgggccaaggcttcttttctcatccttgtataaaggatgtgtccattgataaaagccagtattcacctggggctctttctatagagcagccctggtcctgccttggatgtgtctggagtccacatggtagacctttctcattgacaggctacagctgcccctgggtacctcaacttccttcttggccccagcagagcagggccacagaagagttttcctatcttccctcccttctttattccatcctttcttcttttctctatttttctcactcattcatttattcattggttgacaggcagcatagtatcatggttaagatcatagtctttggagccagaccactataatttgaaccctggctctgatacttgttgagtggccttgaacaagctccgttttctcatctgtcaagtagtggtggtaatactatgtatcttacaggttgctacaaagattaagtgagttactgttagtaaagtgcttagaacagtgctgaacttgtagtcaatcctgtgtaagtttttgttagataaaatagaaaactggctgggcacggtgactcatgcctgtaaacccagcactttgggaggccgaggcgggcagatcacgcggtcaggagttcaagaccggcctggccaacatactgaaaccccgtctctaccaaaaatacaaaaaaattagccgggtgtggtggcagatgcctataatcccagctacttgggaggctggggtaggagaattgctagaacccaggaggtggaggttgcagtgagccaagatcatgccattgcactccagcccaggcgacagtacgagactccgtctcaaaaaaaaaaaaaaaaaaaagaaaaccatacattccaaaaatagcgattgagcattagctctgtgctaggggctgggaacaccaaggagaagcacccacccctgtctagatggtgttgatgggatgccagggaagacttggcggagggggtgatgcccacacggtatcctgaaggaggaatgggcctgagccaggcaaagaggagcagggagggtgtggctagcacttcatgcacagggctagcaagtgcaaaggcctgggggtcagagagagcaggatgcatttgaagagctgtctagcatggctggagcacagcacaggaagagttcatactccacctgtttgtctgtccatgtgtccatccttccatccggcacatgaatagttacatgagttgctgtcatggcccccactgccaggactcttctgtttagcccagaaggccctgtctatctctccagcctccctggctcttgccgctgacggtaccctccacctccagctctatccagttacatgcactcccttgaatacatcttgcttgctcctgcctctgtgcctttgcacctgctgttcactgtgcctggaataacctttcttttgttttgaaccccttttgaaaaataactctccacctgctctgattttgcaagaaatatgcctgccttcatcatcattaagactcaggaaggaagggtcattttgccttattatttccccctccaggaatcatccccctgacccacctgtctgggctgggtttattgctttctcctttgtgtctttgtcacagccctgactatactgtgccacctgtgtctggcctctctgccagactgagaatgcaatgaggacagggactgggtgtggttcattgtcactgctggccagagagacccaggaggtcaccagacctgggtcctgccctcaagaaccacgccctcgagggaaatgatgcacacaggaacagtaaccaggatactgggcagagtagactagtaggcgcctgggtcctctggtcatggccatggggggcccaacgtgaagttcccaaggagcagcagaggggtgttctctgcctgccagggcctgactccagctgtgcaaacagtttttgcaaaatgcatcttggcctccaccactccatttgtcctgcacagtttgctttggcttcaccccagtctcaggcccttcatcccttcccaccggtccccactccttccattggtttcccaggccttgcacctcagactactgggagcactgtctgagccaaaccctagggctcaatgaaaaccagacgtaaggctgggtgcattggctcacgcctgtaatcccagcactttgggaggctgaggcgggccaatcacctgaggtcgggagttcgagaccagcctgactaacatggagaaaccttctctccacgaaaaatacaaaattagccgggtgtggtggcacaagcctgtaatccccgctacttggcaggctgaggcaggagaatcacttgaacccgggaggtggaggttgcagtgagccgagatcgtgccattgcactccagcctaggcaacaagtgcgaaactccatctcaaaaaaaaaaaaaacaaaaaaaacaagaaacaaacaaacaaaaaaatccagacgtaaaagaaaatagaactgaggctcaggttctatcaggtctattgtcttctttctatagacctcaggcaaatggtgctgcctactcttgtgaccacacctgcacccaccccacacctctccccttgcctttatttattattatttttctttagcaaacattttttgagcaattacttatttgccaggcactcctctgagcacttcaggcacattacctcatttaattggaacaactaccatgtgaagtgcatgttattatcactaaaccattaaaaatggcaaattctgtcccatgcaaagcaactcactctagcttatatggtgagtaagcggtgcagctgggattcatgcctgggtccgtccacccctgaggccccagcttgtgactcctgtgctgtgctgtccgccagccacagcacggctcacggcacaccgtgagtgccacggcatggctcatggcacatggtgagtggccccttcattcctagaaggcagtcttgtgtggtagagcactgagccgggagtcaagagacatgggttccaaatccagcggtcattcccattgttctgtgattgtgggcaagtttcttactatcttgggttcccctcgaagcctcattttccccattacatgaagggttagattctataaactgtagttctcttccagctgtaagattcagggaattgaatgtacctcgtaatgcattggtgagggtgctgccagagagtggaagatggtgggaatggcctagaccagagcaggttcatagccaatggtggttatgcagattaagggcctagtagcaggggccatagccctgctactcacagatacgcttttcttttcaggtctctttattcgtgtggatggatatgtctatgtgtgtctctctttctcgctgtgtgtgtgtgtatgtttccattcatccaccccaatgtctgaattctcttttagttatagaaggtaaaggcctgatcagcaaacagcctggcacctgtgatccgtatgtgaaggtatgtggtggggccggagatggagagtgggatattgaggggccatgttactgggctcagtcccaaggtcccagcacacctgtggggctggtgacctttgaggaggcagttgccatctcactcatcttctcaataggcatttattgggcccagtgctgggacaaacccattcccttagctcggctgggtccctggggcttcctgcaacagccaaaatcttaagggcgatcttggtcatctatataggtgggcagtgagtatgtggatggctgaaatccacaggtaatcccaagacctcttgtgaaaagcaccgttttcacccactttccccccaaactaggggcaggatggccagatttgggcagtagagtggagggagtgtctctgagggctggaagatccttctgggttgggcttttgctgtaaagacagggtccttataggggtggggctctactttcagtgagagccaaaggccaggagcttcctaaagtgtggcagctggggttccaggtgctggccctcagcattcttcctgaagccttcaggctgatcagaagcccctgctggcaaggaatttatcaggagcagggctagaacagccctgggttgagaacatggatttggggccttggcagaggctgacctggagccttcgtgaagggagcactcagcagctgctgggaccttagaagagaggagtcctttcgcttctggggaaaccactctgcttgggggaagagcagagatgataaagttgtaccccagctctggctgggccgtggctgcctttttggtaccacccaccatgaggccctgtcctggcatctgcctccaatgtctcttgccctgggctccttgttcccttgcagcatctgacaggggactctattctgtcctctgcagaggctgacttgaaggaccctgggaagcctttaacttggagatgtgcagagtcagctgctgggcttaggtgggccatgagatccgctaatcatgcttccttttttccaattcaagatttctttgatccctgaagatagtagactacgccaccagaagacgcagaccgttccagactgcagagacccggctttccacgagcacttcttcttgtaagagtctggtgcagctgggccctagaaaggagagggaaggagtgtttatctggaaacagctctgtttgccaaatctagaactagatctatgcaaaaaaaaaaaaaaaaaaaaaaccaaaacaaaaaaaaccagtgccttctaaaggatgtctttgttttctcactcacttgtgtccttgcatccctggcaccaggcccagcagcgaggtccacagtgataaggtatcacttggctagctctcataactaaaatgcccagcctggggctggcagcccataaaaagtgtaggcaatttcccactgtgccttgggccaagctttctcctttagccgaaggaattttccaagctgaaggatgttttgcctccctgcccccctttttacttcaactttctaacctctctgagccttggcttccttatttgtaaaatggggctaataatagtagcaacctcagagagctgtggggtataaatgggacagtataacataacacagggtaccagctattattgttattatttctttccccaatctctgaactctggggccaatgggaaggtaatgtacattttgtattttcctattagtgaaaattaatattttggtttttctcttactacataaagtagttttggttatgataggaaaatagaaaatatagatgagtaaaaagaagaaaatagaaaacacctatagccctcctactcacagatacgccctactgtatttcttttcagaccttttaaggtccttttcagaccttttcagaccttttaatgtgtatgtttgcgtgtgggtgtgtatgtttgcatgtgtgtgtgtatatgtctgtgtgtgtatgtttacaaaaatggaatttttttttttgagatggagtcttgctctgtcacccaggctggagtgcagtggcacaatctcggctcactgtaagctccgcctcctgggttcacgccattctcctgcctcagcctctggagtagctgggactacaggcgcctgccgccatgcctggctaattttttttgtatttttagtagagacggggtttcaccgtgttagccaggatggtctcgatctcctgacctcatgatccgcccacctctgtctcccaaagtgctgggattacaggcatgagccactgtgcccggcccgaaaatggaattattttataatagcatgttgtaacctcctttttgtccttaacaacataatataaactgttttatgcatggaggtagtcatctcttactttatttgtaatatagtttatttaaccagctgttgacgttacttccacatttttggaattatgactgactctatgagtcagctatggcctggagctcagcccttactaacactccgatggtctgattgatttcgcagtcctgtccaagaggaggatgatcagaagcgtctcttggttactgtgtggaacagggccagccagtccaggtgaggagagctgctgagctggagggggactctgctctgggctagtgggtgacagccaggtggccagcatacaccaggggttcgattagtgctttctggataaatgagtgatagtggcaatactaaattgcagaggctgcccctccttgagtctccatcattccaggtgttaccaaggactgtgttatcaatgagcatttgctgagcactcggtatcaaacaaggcactgtgctggtcactggggaagccgaccagcctacacatggaaatttattctcaaggtgtccactgttcacgtggggacaccaggcactgcatggagagaaattacaataacaacatgtacgtgctcagttctacaggactctaagcaccttgaaaaacaggactatttcttttttagtcatcacagtacctagtgcctggcatatagatgtttattagatattggctgcatgaagaaaagaatgacatgagtaataaaggccatcagtatgggaagagggagagttcactgtggtctgagatgatcaaggaaggcttcatggaaaaagtggaattttgaacttgggcacagatgaagaataagacaactaaagaagaaggttggaaatggcattccaggcagggcaaagcatgagcaaaggcaaggaggcagaaatactcactgtaagctaaggctgccatgatgaggccaggtaagggagtatagaagttttgtgtaggagaatccaaacaggctgatcttgcaggcagtgcaggacacaggagggctgaagtggccattagtgacggcagttagagcggagcaggggaggagtgccgggcaggtgagcatgagaattggctgttgagtgacagcaatgcactgccatggcccactgttagcggcagtggctcatttggctggtgcagcctaaggaatctgggataccccatggtcagtatcatttgcggagcaatcacatcactgaatggtgactgaaaaggggcttccgtgaatgaaaatcagctcaagtcaccagctgagacctggaaaacatttttgggttcaatgctctttagtactctaaatgttattagctaatatgttttttaaaatcggggtgtatttaacatacaaaacgaaggatttctcttttaataaagtatccacttttcatcctagggtagtatagtacaataaacctcattcattcattcatccagctgccatttcctgggtatcactgtggcaacaacatgctggggatgcatgcatagggtcaaagactttcctatcggatcaccgatagagacttggagctgagagtgaggagggggacgtcatgttaataacaatagcaattgctgactgggtgctgacctggagccaggggttaacagtgcattgtctcatttaattcttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgtctcatttaattcttacaacagctctaagaagagtgtggttttgtcctaagttttcagaagaggaaactaaagtttagagaggttaggaatttgcctaaggtcatacagccagttaacaatagagccgggatggaatccaggtggttggaccccagggtctttcctctcaacactgtactgactcatgggtggacaggtgaaaggacagaagaaagagccagtaaagtagagagggaagggcagggcaagagtggagtgaggagggatctgcaaactcattgacgttgctggaaggttaagtacaaagtagggactggctaaagattagctgaagaggttggtataagccaagtcagatgattctgtagattctctttggagtatggggtttctcctaagggccggtggttctcgatcctggatatacatcagaattccttgggatgcttgtcaggaacctagattcttaggtgccgcgtcagattaattacatccaactcttcatgggcagggctgagaaatctgcatttaaacatgtttgcagggtgaacctcctgcagtcactttggtgtttgggaatgtctggccattgggagatactgaagtgtgtcaagccagggaatgatggatgcacattctagatctatcactttggtaggtctttggaaggttgaggtgagagagaggctttggggctagggaggggaaaacagactcaggccatatttaggagattaaatcagtagtgcttagtggtgatttggctgtgagagcagtgtgagaagtcaagggtaactcctgggcggctggtggtgtctccacctaagacagagttactggaggtggaggtgagtcagcttgggatacggtgagatgcaggtgcttggaggggagccaggtcagagctgtgaagtagggctcacctttgcctacctggaacttggaagacagagatatgggagccatgagcaggaaggcagtgggtgaaattctgagcaagtgagattgtcaaggaaggtcatcgaatgctaaggaccaagggtccgctccctgtctttgaagggacaggccaatgaagggaaggtcctgaaggagacagcagagtgtcagagaggcatatggacgcccagaaagccctttgggtggaggcagacaccaaactgctggagaaggagccggtcatgcccttcatggcttttggaaaagaaaatgaggccagggaaagtgagtcagcgtcatggggcagtgtctccacgtgttgcctattttgggaaagtgagatgccttattaaacaaactacagccaaactcacggtcacagtcccagcccgaagctcaggaggatcagggccttgggagcagagggccctgtgaagctgtgagcagcacgcaggccggcctggcctccttgcgctctccttttcctctctcctttatcgatccatttcggagcgagaaggcctctgagctggaggaggcagacagagtgattgcaggaaacttcggctctgctgaatgctctcaaatcaaattgtgcctctctgaaggatggacattcaacttatcaacatgaaagacaattgtggaaggaaggaaacaaacatttatggaattcttctctgtgccaagcactttacatacattatctcattttatcctcatcatgatcctaagaggtaggacttattattgcccctctcttcagagaagaggaaactgaggcttatgaaagccgaggcacttgcttgaggttatgtaacagctcatatttaccaagcacttactgtgtgtggacattaagcacatggcactcgttctccaatttaaccctcacaacaacataagaggtaggtattattatttttgctcttttataggtgaggaaacaggcacagaggcgttacataacttgcctaaggtaacacagatagggtgccgtgaaaacaagatgtaaatgcaggcaagctgacgccaagtccaggttctcgcagctacattacggtacacttgaccatctcacatggatgataaatgactccaaagcatactctttctgtgtcagtatgcttgctcctcaggactcagggtgcttctctttgcatttatagtgtagtttcattgattgattgagacaggatctcactctgtcacccaggctagagtgcagtggtgtgattagagcttactgcagccttgaactcctgggctctaatgaccctccagcctcagcctcctgagtagctgggactacaggtacatgccaccacacccagctacttaattttttttttttttttgtagagacgatgccttgctatgttgcccaggctggtctccaactcctggctgcaagtgctccttctgcctcagcctcctaaagtgctaggattacagacatgagctaccgcagaatttataatggagttttatgtaaattattcagccaaatgtgtggtggtcacattttgaaactgataggagataacaggaaagcatctgtttcactaattctcacgatccttccagggatggctgtgaacttgtgttagagaaacaagatgatctacaaagaagttctggggaagggccagatgatttcagttcatcatggtgatcacagtgggaactgaggagaaccaggcctcagcacagtagattttggcttagctttgactagctgtatgaccatgggtcagtcccttccctgcgctgagcctcaatttccttgtctgtaaaatgcagtgatcactaatgtttctttcagcttcaagtttctgggagttttttataggcactttcaaatgtgtgcagaggtagaaagtatcatataataaaccctcatatactcatagcggagtttcatcaattatcaatatatggccaatcttatttcatttacaccccatccactttccccttctccagtgaattattttaaagcaaatcccagacatctcatctcatcggtatatatttctaaaagatggctttaaaaaaaatcatgatgacattatcacacttaaaaattaatagtaattcctcaatatgccattgaatatggaactcagctttaaaaattctgtttgataatatggcaaaagacaaattgaagcttccagtattaatcagaacttgtggccagggaacagacttggagagaattataatgttatgtactaaggtaaaaaatgcatatatgtattatatttatacctccaaagattatgttcaatatataatatattattataaattatataatatataaaatataatatattatattatattttatattggtatatataattatatataacttaattataattatattggtatatataattatatatataacttaaatataattatatatcgttatatataattatatataacaattataattatatcagtatatataattatatataacctaattataattatatatcagtatatataattatatataacctaattataattatatatcagtatatataattatatataacctaattataattatatatcggtatatataattatatataacttaattattatatattggtatatataattatatgtaacgtaattattatatattggtatatataattatatataacttaattataattatatattggtatatataattatacataacttaattataattatatatgagcatatagaaattatatatactaatatataattatttatatattatatatattctttatatattattatatattaattatatgtaaacattatttatatatgtaattaaagaatgttatatatatgtaattaaagggcataatctttttttaaagtaatttttttttctttttttttgagatggagtttcactcttgtgcataatctcagctcactgcaaactctgtctcccaggtagcgattctctggcctcagcctcccaagtagctggcactctgcaggcgcatgccaccatgcccagctgatttttgtatttttagtagagatggggtttcaccatgttggccaggctggtctccatctcctgacctcaggtgatccacccgccttggcctcccaaagtgctgacattacagccatgagccaccgtgcccaggcaaggacataatcttttttttttgagatgaagtctctctctgttacccaggctggagtggaatggcgcgatctcacctcactgaaacctccacctcctggattcaagtgattcttctgcctcagccttccaagtagctgggattacaggcgcatgccaccacgcttggctaattttgtatttttagtagagacagggtttcaccatgttggccagactgatctcaaactcctgacctcaagtgatctgcctgccttggcctcccaaagtgctgggattacaggcgtgagccactgcgcccagccagggcataatcttttatactaatagtaggtacatttagggagattctacttgtgatttgccctgcactgtcccaggcactgtaagtgtatgctctcctttaatctgttttataaatgagatctcagtgccaagtacagtggcctaacgtcagaaagcttgtgaccagtgatgggtactgagcttaaggaaaaagtgaatggaaaaatctaagttcaatttaagtcatcaaattaaatataaattaggattaaatggtataaccctgtaacagaaataatttacctgagagggagaactaaagtgcatttcctcaaaaaataatctattttttcatcttgtaatgagtctgcaaccctatgctcaaaagtaaactgaatactattccccatatgtgctgcatgaagttacttcaaagcctttgtaacggctgttccctctgcccaaaatgctcttcattctctctggctcagttcataggtcttcttccagcctgtgagccctaaactacctcttgtgtccccgagccttcagaatttgttgcctgcactgttcatctgtcaatcgcaccctgtcttgtgacatcccctgtattgctgtcttgaactgctatttaaattcctggatgtttgtgttgtttccttaacgctgtggctccttgcccagtgcctgccaaccgtggacgtgatggattcatccatttgtcaagccttcactaagtgcaccaagcctggagctcagggactggtagtcagaattaaccaaggcttggttccggagactttgcatctagtgagagttcaggcactcccgagggtgagcgctagttcccaagtttataaactgactgctgtattgtcatatactcaggttgctttaaaagaagtctttcttcctccaaagatttttcaaaagcaggcataagaaatagctaattgaagaacacttagagagaggttcctgcttatggacattaattgtggcaatttacgctgcctgagttaccatgaaagcatgggaggccccttagcaggaagtaaaactcgagggaggctattaaccatttaacattctctaaacaccagggaatgaagatttcgcttagtgaagagcagagagaggttgctgagctaatgcattggcctggagactttgaaagtttcagccctacccagtaggaaagaagtgtacaacagagtagtatgggcacctggatagcagctggagttctcttgaatgtgtgacaaataaaatgaaattggtatgaggactttggcaaagtcttgccaaggcttttctggaatggcagctcagattagttttggctgtttatgatagtcactgcaactgcctcctattagtgctgacttggctacttcccaagggggaggagtatttgtttttggtggtgggctggggaggtggatgtggaagggcactttattggggtgagagcattgtcctttttgaatagattattaatagagccttggatgatgagagaggcaaggaagaaggcagcagatggagccaaggctgaaggagctgggagcaggagtgatgaactgagagcagctgttgagagacagccagaagcaggggcctcagctctgggccatggggcagagcatgggtttgcaggcaggtggaccagttttgaggagcaatcccccagcatcctgcctccccacccctcgcttgacttggctgcctgtgagaagctagttttgttttgcttaggactgtccggtggtaagctgccacgctttctggagaatctgaacaatatgtcttttttgagaccttctagatcactggtctttgactggggcaggcataagtgggtgcttggcaggataccctggagagctttctccaggctcccatgctcgaaccccaccttggaccaactaattttgggttctcaggaagaagtcctggagcatatacctcagacaggctgttcaggtggttttgtggtacacttctggatagaaccactgctctagctcaggcccccttagaccaggttttggaaaacacatctctagggagtttactacctatccagaagcctgttccatctttggttttgatattgtgccttccataggacatgccaaatctctcagctatgtgggtccttcagctattgaagccagcctccagggttatgctccagcctaaatatccacgatgtttcttgattaatagttattaaaccaacctatgaattagtccaagttgaggatggggtaagagagaggagaacagaaagatgacattaaaaaaaaactcttactgtcaggatagaacaggatgtggcacaataaaagtccttaaaagtatattgatactgtctttttttttctcctgattataaaaacgatacttgttccctatgcaaacagtgaaaacccataaaggaaaattaaacccctagtaatcccacctaccagatatgaccattgttagtatttttgtgggtgtctttctcattaaactcacattactcattaaatttacagctttgtaaacttctttttctctaacaatatcaagatatttttggactttattaatattaactgatgttatcattattatttttttgagacagtgtcttgctctgttgctgcaactgcctcctgttagtgctgacttggccacttcccaagagggaggaacagtaacacacaatcacagttcactgcagctttgacctcccaggctcaagtgatcctcctacctcagcctcctcagtagctggggctacaggctcatgccaccatgccctgctattttaaaaattttttgtagagatggtgtctccctttgttgtccaggctggtctcaaactcctgggctcaagtgatgccttccaaagtgctggattacaggtgtgagccactgcacctggcccatgccatcattattaaaagctgccaactcttagtccctgattattggacattgagcctcaatggtggacattcttcaggaactctgaattcttcttcttcttcttcttctttttttttgagatggagtcttggctctgtcacccaggctgcagtgcagtggtgcgatcttggctcactgcaactccacctcctggtttcaagtgactctcctgcctcagcctcctgagtagctaggattataagcatgcaccaccacgtagggctaatttttgtatttttagtagagacagggtttcaccatgttggccaggctgttctcaaactcctgacctcaagtgatctgcctgcctgtgcctcccaaagtgctggcattacaggcgtgagccaccgtgcccagctgtgaattctttttaaccaagaagattgaatttagcccctcgccatagtctgacatccccatgaggcctgaccctggcccatgcctacctgccctgctggtggccaggtcagattggtctcagcagcttttgtgtcaggttggtttggaccttgatctgtagccatctaagaactgctcagctccttcctggacctgagatagaacttcttgagcttgaggtcccataactgttctcctccactgagcatcaccaatgatgtgggcaaggaggttccctgtggggaccagctcttcagatctacctagcaccagaacggttaaaactcatgaagtaccgctgagcttctgtgtttggtagaggcagtgctgaacttgtcctgtgaccttgggaaagggaccaactctgagtctccatttttccctctgtaaaatggagataatagctcctctctatcctgcctcacagagtcagaaggatcaaacgagatgatgtgggtaaaaagctttgtaaaccacagtgcatcaggcaaacccatgctatacttgataatggacctcccgatagagcccagaaaaaaaatgctgactcaagtctcacttgttctcccagacagagtggactcattggctgcatgagctttggggtgaagtctctcctgactccagacaaggtgggtcctagggatgcttctgtcaggatcatcccaactgggccggggctggtacaggcagagtttctctgtcagctcttgggcagggcttctctctgtgagatggtgccccactgagacaggtgccctgtggggtggcctgcatagcagcactgtgtttattacctgcctagctgagagtttgggtccccttcttggtttgtcttgccagagagcagtttgttaggcagccccaagtcttcccaggaggctctgagtctggtgtctgctgttgaagacattggcagatcccttggggcccagagcactcctgggcctgccccagaagatgagggccaggtgcacccgtggtccgttccaggggtcctcttcatgtgtctaccaggcctgatatttctgggcctaacaggtgctcaaggatggagtgagcagcaccatcctctgtggagctttccttcaggctggaggaggactctttgggacccaagactcctagctctgggtcactggtcccttatcaatttctacgctgcactggactccccaaactggaaggtggagggtggggagcactccttttgcacatccctggaaatgtcctggtggcttgtggcatggcctgccacgcagatttttgtcctggggtgggtggctgaggaccctttatcctgcatgtgagtcctaaagagcttctctctctctctctcttttttttttcttttgagacggagtctcactctgttgcccaggctggaatgcagtgttgtgatcttggctcgctgcaacctccgcctcccaggttcaagcaattctcctgcctcagcctcctgagtagctgggattataggcatctgccaccacgcctggctaatttttgtatttttagtagagatggggtttcaccatgttggccaggctggtctcaaactcctgacctcaggtgatccacccgtctcggcctcccaaagtgctgggattacaggtgtgagccaccgcgcccggtctagagcttctcttgactgcagccttggcttcattctcctagaaaagatgttccccctggagactgctcaggagccacaggatgccttttggtctctccatccctctttcactccttcacttctgttctgtcaacaaatatggctcctactgtataccaggcatagtgtgaggcacatcaaagagcctgtgcacaacttagtgggggagacaggcaagtagatggttgtcctccagggataagaggctgtgggaatttggcagaggggagagccagatctgccctgagcatcacggaaggcttcctggaggtgcaggcatggcagctcggggccaggaaggctggagagtctgtctctcctgtgggtgggtgtccagtggctacttttggagggggattggtggctgcctgacctgtgcttctgcctcctgtgtctgagcgtgccattccttctctcgtgacaggagatcagtggttggtactacctcctaggggagcacctgggccggaccaagcacttgaaggtggccaggcggcgactgcggccgctgagaggtacctgcacacccccttcagcttcccttcccaggacctgccccctccctcctttcctgcatagcggcatcagtactggtatttggtggcccctgctactgagaatgctatcagcctgctgggtgcagggacttctcaggagcacttgctagagtgcaggctgcaggaagcctcttgcccatgcctccactgtttatctggttggacttttactgtagaggctatggtctgaccccatgtggtttagctccctcccttgtggggtactttatgcttccccagtggccccttcccagctccatgtctcagggatcccccaggctgccttgctcatcttgggatacccacctctacagacagggcgtttaggtcctgccatgatccctaaggctcagaatgtggatttcatgacccttttccatgttctgcctttcccacatgcagccctggctcctgagtccctgtctggattgagcctcaggtgtccccacatcctgaggccaggagtggccctgggcagccccatgggcctgtttcccagtgctgtcctctgggtggtccgaggaggggagacttctctgccaccagaagttttctgattctgctctgtcaccttccagacccgctgctgagaatgccaggaggtggggacactgagaatgggaagaaactaaaggtaggtggggacaagctagggcattgctccaggagctggatctgctccttgacagcccctgggcccgggaaacccctaaaggggcagcatttggtgcttgaaactcagcaagtcatgtactcagaaggaataatttcttgattttcctgaggtgtattacaggaaataaatgctcttctcagggtatccatgatcgtggcaggggtggggaaatggccaggcccccacctctggaaatggaagcatctggatcttactaactttgggcctctagaaaccgagtcctccccttcccacagacttctcggccccctgcttcccctgggactgaggccgaatcaccctcccaggttaggcctgcttgatgtcagggggcagctgcgattctgaacctgagaccaaggtgttctaactctattagggcttcaagtctggaaaggagcctttttcatataaggagttgggagaattctccaaaagtcattccatctctttgcagggcatggcaggggatctacggttttctttaacaagtaagagagggaattacttggccaggtgtggtggcccacgcttgtgatcccagcactttgggaggccgaggtgggcggatcacctgaggtaaggagttcaagaccagcctggccaacacggtgaaaccttgtctctactaaaaatacaaaaaaattaactagacatggtgctgggcgtctgtagtcccagctacttgggaggctgaggcaggagaatcacttgaacccaggcagcggaggttgcagtgagctgagatcatgccactgcactccagcctgggtgacagagcaagactctgtctcaattgaaaaaaaaaaaaaaaaaaaaaaggaccgggcacggtggctgatgcctgtaataccagcactttgaaaggctgaggtgggcagatcacttgaggtcaagagttcgagaccagcctggctaatatggtgaaaccatgtctctactaaaaatacaaaaattagccaggcatggtggtgtgcacctgtagtcccagctacttgggaggctgaggcagaagaatcgcttgaacctgggaggtggaggttgcagtgagcggagattgtaccgctgcattccagcctaggcaagagaacgagattccatctcaaaaaaaaaaaaaaaaaaaaaggagaaacaaactcccagcaattcattagcccctgtataccaggtgctgttacctaatcttcactgcccgctctaaggcagctgttacttccgcatctcacagatgagagggacatacatggttcagagcattaggccctctctgtggccacacagctggcaggtggtgaaggcaggctctgagtgagggctggccaccttttcagtgtgctgtggcacactgcctcctgtgcatggcctagctgggaatataagacattgctgtagttcctaatagtattttacgtattacacaatatcggcgtattacaatctaccaaacattttcacgttcactgactcaagtcattcactcattcatcattcattaaatatttccacctatgtaggctgggccctgtgctgggtgctgggatgcagctctggacctgtctaaggccctgccccatggagcagtctagagctgtgctggccagtgtggtgaccacctgctacctgtggctattgagcacttagtggctagtgtgactggggaactgagtgtcaactttagttttaagtaatttcagtttacctggcacatgtgtctagctgcgactgggttagacagagaaacttgccaggagtaacttgtcaggtttgttttctgtggtttcattagttgaaaagctttcctctggcttctgtggggaactgcaaagacctttcctcctctctttctacttgccaagcacagagaggatggtgatcagggggcctccctcgtgattcatggaaattacatgggcatcaacaccgtaagtttgcttcctccaacatcacaggtttcttggtggcttgtaaagtcctcctgcgtgctggattctgcacacaggccctgagccccttgttctgaggtgcactggattttcctgaacttatgtgctcagagatgtctgtgggactcagcaaagagggtgtgcttctcagaggcttggttggggccgggggagagcccccagaggccatctcttcagctcctgtgctgtgcaggtggggagatggaggcccagaaacctgggtgacctgcccacagtcacacagcaaccaaagctgggttgaaccaaggaaccctctgtcatcaaggacttgagtgtgtggctgggcttccccaggggctctgagatgggcaaaagcagctgggctcaccatgcgctgctctgcaggatgctatcctgggactgccaggcaagaaataggacccaggttctggtcctagccccacactgccctgctgtttgaccataacctctccaggcctcagtttgtttgtcagtaagatgaggacgctgggttgtctgatgacctggaaatcccttccacatttgactttatggtccatgtgtatcaccagatcctgacagcaaaccacttccatggacaaaggacaaataaattgacttttttttttttttttttgagacagactctttctctgtcacccaggctggagtaccgtggcatgatctcagctcactgcaacctctgcctcctgggttcaagtgattctcctgccttagcctcccaagtagctaggactacaggcgcctgccaccacgcccagctaatttttgtattttttaagtagagacaaggttttaccatgttgaccaggctggtcttgaactcctgaccccaagtgatccatctgccttggcctcccaaagtgttgagattataggcatgagccaccacgcctggccgaaactgacttttaagtagtttccaagtggcaggcaggtcttcagactccaaatgttttatgttccctgtcatgagatgggatgtctgtgagtgcaaacccccccaaggtatccttggattctttaggctggggcagtctcctggatttctagcagggtccctgggacttgcagggggaggaggtgttgttatagagcagccacgttttctgcctgggttctcctccagtgaggggtgtttgtgagaacattggaatcacaaagtggcccatggcggagaatgcagccagaacaaaggcgccctctccccgccgggcccggggaatactaactagttgacaggaattttaatataaaactctccctcttccttgtcattctgaggtttcaggaagccttcgggcttatcgtgcagaggcacacagcacagacagggcttggggaggtgagaggtgatttcctgccattcttctgtggggcgggcttcccagggtgctcatgccaggctgacgggtccagtgcgggctcccgctgctgggggagagctgggttttcatggggcggcagccgaggcaggacccgcagccatgaaccgcttcaatgggctctgcaaggtgtgctcggagcgccgctaccgccaggtgggtgcttggcctcttgtggggagcctgtggggtgttcagggataggggtagagggaccatctgagaaggatctcgctcctcacaaggtcttctttgacctttcctgctccctgcaggctcacttggatatggggaggaggatagagacaggagctggacccaaggcccctttagggcccagctctgtatggagtcctaaccactggctgggtggtgtttttggtgagataatccagctagctttctgttctttttatctggggaggggctgtgggtgtgagattgaaaatgccatggttgctgagcagctgggagcagagtttgtatttttgctaacttttcctgcttctgacaggacagcagtgcccattctgccccctgtgcgtgtatgttggcacgtgctcatatgtgagatcgggtgttttcgtgtatatgtacatatgtataactttcctctcccctactgctgatgcctcactatggctcaggattcctttggctttggaatccaactttacagtgagggtttggcctcttagcctccggtcttagaaagggggaagactgggccattatgatcccattagctcccctgagcctcttctagaactgtgatgggccattttttctcataaaataggaatggggttagggatggtgaaggcaagtgatatctaatctggaagggagttctgaaattgtcctgattttaaaaaatcacatagagaagcccctctatttgttttaatgaccagattggactgtgggtcttgactcctctgactggcagtgcttaggtcccagggagatgcccagaggggtccctgcccccccacctgcctgctaggggatccagtgttttctctctagccctcccccgctctcaggttctgcccttcaggccccactctgtgtttcctgccctcatggggctgggaaaagcagcccctgcgacactagcgtctggatggcagagtggtgagacagagagagcactggttgggacatctagtagtccttggtcaccctggggctatgggctagaagactgggcatgctggctgtcagagtggggccaggagcaattgtgggctggacctagggctcagggactcagagttcaagatggtttctgtgttagaaaccagtgcagaattgagagcagcaagctttttgtcaggtctgagctcaaatctagctctgttcctctttagctgtggcttttgagcaagtcactgttcctctctgagcctttatctcctagtcagtaaaataggataatgaaatccagcgatggtgccatgggagtgaataggatgatgtgtgtgaagagcctggctcagtgtctgctgtgcatatttatctaggaggtgtttaatacatggcagaatttggggattacagtctaggcaggacagaggaacagaaactagacaggagagcagaggtaaggggctggcatgggtgagacctgggagcagtggctgttcctgccctggacaggaaagagcgagaaccacccgcaggaaggacaggctctgtcagaagccgccaaggcctcggggcagggctgctcctttcacctccaggtcagagcagggctgagagccggagggtggagggggtggcacttcgagtcttatctccttgtctgtaaaatgggcatactcattcccctaggggctgcagggatggtcaggttctttggacactaccctctcaatgtggtcagtgatcatggtggacagagtgtaattctgcttcctccgagctaggaggtgagcttgcctcccggcaccctctcctcttcccctccttcacactcccatctggcttggactgtggtctgggctggcacttcttaagctggtgcccaggagggtgaggggcccccagcccacagtcctgcttggatgtggggtctgggtgtgggaggaggaggctgttttcttggagcacactcctccccagaccccactctccagttactgccccataactggccatccagagcccagggtgctgggatgggttttctatgcagggggctttggccctggatggggtaggggtggggaagtgctggataggctttgggaccccagcttgtgcttgggttgagggttggcttgtgaggcccctaaaaaatccccgctggttccatggagggggccaggctcctggcgtcttccctggcctcaggcgggcccggcaactagtggctgctcctttcccccagctttccacactcgtacccgcgtttgtttttctttctttctttccatttttttctcttcctgtcttagctgcgtgttttcccagaattcttatgggaacggggtattttcctgcctcctcccccttccccttgtctgtcaggtttcctgttttacaaacttgctttgaatccaggcccggggctggtgggaagcagagcctcagaggtccctgcagcttccaaggcccttggtcactctgagccccctcccactcaccttccttatgcctggccctgggatggtgggtaggtgaatgagtgcaggtgcctagtcttgcagggacaaccctcaaaggaaggagacagaagtctcctgacaaggcttgtgcccttgaccttttccaagcttgctgagctggcctttgtctcaactcacttgggacacccttccctgtgcctcaccagggcccaccccaagtcccagtttctctagggggtctctcgggaccccttgaatcccttttctgatttgtgctgcctttagcagccggaatgggctggcagaccaccctacatcctcctgtgtgtgggacactgccaggctgtcctccctgcattagcctctgctgagttcctaccatgtgccaagcatggcgtccatagtcggagcataaaggactgagaatggcccagtcctcctgcttttctttagtgcccgctgtgccctgcttcactctggagaggtttgtgtaccctcgtgctcctctgggaaccagagaccaaggctgcatgcctctgtatgtccacagagcctggcatgctgtaggagctcaataattgtgtgccagtttgaaaagagcatccagatggcaaggccctctcatggacttctgaaagtaggagttgtggacctgtcaagcacatgggcctcagcaggcacatgagtcagtggctagttcaggttcagccaggaagcctatctgtgaccttacctgggagtcctcatgggatgccttggggccctggccacagattggcccccagaacctcagctctcttcctctgacccttggcctgagatggagtgagtgtgtcccagtgtttcctcccctgtgctctgggagggcagtgaccaggctggccttgactttgggcccttagcacagggcccgccccaggctaacgctctgtgaacctctgtgagaaaggaagaagggagccaggaaaacagtggatcaaaggtgaggctgagtcatgcagtgctggtgggcccttggatcaagggctggggctgctggggctcaggatggcaaagtttgcttttccaagaccttgtccatcccaggccctccccacatcagcctgggtttacttgctgagctttgggccttcctgcttggcccacaacccagtgctcaagttgtctgggctgagatagggacactgaggggctggctagctcctttgtgcctccagttcccttggagaggagggtggctcttggcaggggtgggctgtgggcttcctgaccttggggtagaggcaagagcctccagcttctggcagtgaccgggcagggctgtgtcctagatcaccatcccgaggggaaaggacggctttggcttcaccatctgctgcgactctccagttcgagtccaggccgtggattccggtaagttattgacagggggatgccaaccccacttgcccaccacacatgtgggctttgcaaacatagtctggaactaaaaggggagccccaaactggagcaaagtgtcctggcttttcaaaatgaaaagaataatatttttaagtgaccgtagatgaaactgccatttatgaaaatatgcccactttttttttgttgtttttatcaaaatgaaaataggtttttatattttgtttcccaatcagtttgaacaggaactaaacctatattttcagcaatggctgcaagggaaaatgagagtcatttgtgaactctatttgaagctgttttgtatcctatccagagcctgatcagcacttaaaaagagccatccttccctacttttcacaaatgaagatttctcttaatcacagagtgagcatctcaaagacagaagccagggctcagtggtcagggtgtttccagtgcctacacaagggtgggcatgaggttcgtgcacaatgattggcagagaaggaataaatgtagtgtgggagcctggccccagggaaggttctcaatggggtaggaggccctggggaggggtaagggcccgggtagaagggtggactgcagagaggtaagccagcagtaggggaggtaagccagcagtaggggaggcaagcagggagaagggaaggcaaagggatgccttctttcaaggctcttgagaggcaccaagttcagtccctcatttcacggatgaagaaacttagagaaaaagggaggtccttgtctgaggtcaccatggcagcaaaggactccagatcctttgaaggggtcttaggcttcaggggcccctgaatggcttttctttgtccctgcagggggtccggcggaacgggcagggctgcagcagctggacacggtgctgcagctgaatgagaggcctgtggagcactggaaatgtgtggagctggcccacgagatccggtgacaggggacagcgggtggcctggggcctcaggctgatggcacaccctccccacccctgggcacactgccttgcctggcccagctcttgctgctccctcttttgcctagctgtgagcaggcaattccttttgctcttcaaggaatctgtttcttggcctgagaatggaaggttcaggctcagagcacttttggattccagagcaaacagcagggaagatgctctcagactctgtggttcaggacggggcaccaggaggttgctttctgctttagctaatttttgttacctaagagctaagcccatttgttatttaagggcatgaagatgttgcaaatgtttcaattgcacaattaaaaaaatattcttgaaaacattggagtctcccaaattttgatcctctagggtaaaaccccgatggccccattttaggtctgcttctggaataaccagatgagggcttgcacttaggtgacctgctagctttacttgcttatatcttgcttttgataagcatcatggattgagtatggaactctttcctgttgaaactggcctggcctcagggtccttctcaaccactgcccgtcaataggaattgacctaggtgacccatttgctgtctcttctttaaatggcttcttgcatcccttcctgccctgacactgggggcttcccctctggtgtctgcctcctcttcccccattatcctctctgccctgtgggccctcactctggctgatactggctttccccaggctcaacctgtctgtgtgatcccccaccttccaggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccaggtacggacagctggtgtggggaaggtgaagggtactgggtccctgtgggaggccaggaagacttgaagacccaaagttgtgtgatgagcagcctgtgaggggctgcgatgttgggcaaggagatggggtatgtgctagctctgccttctgcaaggctgttcttggtagggaggacagatgggtctatgtggcctcagggcacagattcaagaccagggcatgcacaggctggaagatttcaactcacagaaggaagagctttctactagcctgtgcttttccccagtggaatgggctgccttggtaggtggtgagcccccatcataggaggtatgaaagcagacactgcatgattgcatggtgggatgatggagtgcgctccccaaaacattagtcccatgagatgctctgggaaaaaggtgttctgaggtcaaataagcttgcgacatatcccataccctcttcctcatctaggagattctcaatgcaaaggagcctagtagaggctctgctggcatcctgtactacagcaggtgtcaaccaaataacaccgcatttcccaaacttgcctaatgggggcacactttagggcgtggttggtaccgtcttaccattccagtgttccctagaatgcactttggaaccagctgctgtaaaggaagttggggacttgccaaggggttaggcttcatgacccataaagcctctttcaacttgaatattctgggattttgtgttctctcccagcctcctccctcagctggttaccagaactgctgtttttctcttgtgccctgaggtgctccacttcctctcccctggggcccccgtgtccagcagcctcctgggctgtcctgccctgttcctggggctgaggtggttttcctgtctttcccttgcagctgctccggcctgtgtaccaggaggataccatccccgaaggtgagtctcctgctgctgctgtgccctcctagctcagagaggcagcaggggtcagctgaggcctggcccagcctccgcccctgagttctgaggcctttccaatggagtcaggtcacttagcctatcgacacagactctctttccacgtggtaccttttctccctcacggaaccaatgtctttcttccttgaagccagaactgagaaggaggagaggggatcttaccagggcattttgagagaccgtgtgtccaggcctcaggcattcaattgagattcatccaattttacagagcaaccgatatatattaggtgccagaggcaatgtggttgggcttgcatggaagggagtcagggagcgtggaggtgggaggtcttgagttggagttctagctatatgactttgagcaaatcatgtctccttggtcgggcgtggtggctcattcctgtaatcccagcactttggcaggctgaggtgggtggatcacgaggtcaggagattgagaccatcctggctaacacagtgaaaccccgtctctactaaaaatacaaaatcactactgggcgtggtggtgtgcgccaatagtcccagctactcaggaggctgaggcaggagaatcacttgaacctgggaggcagaggttgcaatgagccgagatcatgccactgcactctagcctgggtgacagagcgagactctgtctaaaaaaaaaaaaaaatcctgtcccctcgctgagcctcagtttcttcatttataaaatggggtcaataattcctacctcagagggttgttggggggatcccatgagagaatggttatgagtagttgcctgtatactgagagaggctatacagagggtagctgtctttgaagtgcacagatgtctctgctgctggatggattcttcttctttggcttttaaaatcctgatcaggggtggaagctgagctcaaaaccactttcttctcccaggaaggctgagatattggtcttgaggctgaagctggctgggcattccttgagatccttcgcgtgcctgccagaaagctttgactcagaagtccatctggtgtctggaccgccttccttgacagtggcttttgcttagccactcacagacttgcttccttgctgttcccctctcagtggtgtgaaggcgatgcttctagggggtagttggaaaagtgcttgtgccttttgcgggtgtgaagcgctcccatcaggctcagggatgctgatggaagacatcttctttctctccggtctggggcatttgggcagttgagcctggtcagttggaaataaatctgtgttccttctggggagaagtccgacagcaattcaatgatgagttttatttttattttttatttttccatagattattggggtacaagtggtatttggttacgtaagatttttagtggtgatttgtgagattttggtgcacccataacccgagcagaatatactgcaccccattcgtagtcttttatctctcacccccctcccatccttcccccgaagtctgcaaagtccatggtatcattcttatgcctttgcgtcctcatagcttagctcccatgtatcgttgagaacatacaatgtttggttttccattcctgagttacttcacttagaaaaatagtctccaatctcatccaggtcgctgcaaatgccgttaattcattcccttttatggctgagtagtattccatcaatgatgagtttttaaaaagcttttggttggcacattaggttagagtggagatgctgcagctaagtagggacttcattagggtcaaggcctgggcctggcttatttctgtaggtccagtgcaggacccagggcctggcggatggcagatactcagtagaattttggttgtgtgactgactgaaggagaacgacttgggttgcctctgaggctttggagtctggtcgtggaggaggggggctggagaagtgtgctgcctggagtgggcccatgcacacaggctggtgtctggggttgattccttctcagttgagaggtacttctgtgtctcccttctgtgctcccagcctgtatccatgtttcattcccctctgagagtataatacatagtaagtcagcaagagcacagttatctaagccatggggaaagggacaagtgaggaaatgatgatgatattaataaccatgctagctctttgaatgcattgtattaagatcctgaccttactttatgtattcttcataataataaatcttcactctttaccagggatcaagtctttgtagctcacaattttaggattcagaggaaagggtgaaattcagggcacacaatttcccttaaacacacttgggattgtccagaggttaaggctgtcaccagggtgctggcttcttagtccccctcctctggctgggctgccaagagatagcccttcaggagtgttgggtcatcctgagttgaataggagggagagttaagccatcctgagttgaatagggtctggtgcccttccggagcccagagtgcctgcccggctgtggttggcatgtttcccagggctgctggtgcccttggcattgtccctgccctgtaaaggtgacctggcctcagattcgccactgccagggcagggtggctgccagggctcgcctcagaatctgggagcaaagccctgtaattactgtatttggtcggtgaagcaggtgttggaggagaaaagggtgatatgggggtttggaccagacatcggtagcaggtgggaagtaaatgagtttgccttcacagagctcagtaactgggttgcaagctgtactgttctaaaaaaaaaaaaaaatcagttttacagagccactcccactagccacatattatccaggggtgggtggagattgggcacaagggcatgactgctgcataggttgggttaatcctgccttgtataatttactagccaaatgaccagtcaccctaccattccagacctcagtttccttgtctacaaaatggggctgagccgacttttcctctctgaaggcagaattatgtgttgggtacttcaggtgaggcccttggtgaggattctgtgacagccctgggcccctgggctagagaagggaagaaatcaattttttaagaagtccgagactgggggcccaggacccagattttggcatttacagttggtacccatctttacttttggtctattttgttccagtcatctgcttgtcagtcctgcatggttttgccttctctgctgtaggcttaaccatgttaaattagactgtctagatccaggctggccatggggtttcattcacagcatggtttgagaccgagcagccctgcctatccttctactaaccctggtaggtggattacttggaggcttaggatttgtgataatcccctgactactcacactgtggtacaatccaccaagctcttttccatcaggtctcttgtgtgaacctcccactggccctggggcaagcgaggcagcaatcagtattatctccacttcaaagtggagaaaactttgattcagagaaggaaggaagctgttcagggttacacagactgtctctgacttgggaagtcagtgatcaagctcgggtgtcttatccaactcaaattcagtgatgatcttgagactgaggatggtgctttaaacaaagggtccagggcctggcagcacacatccctctgggactgatatgtagggccagatcagacaaggagctatgtgacatcttccttgtatctgttcctcctgtgcccatccagggctcatgctcattctactcctctctccgtgactcacagaagaggcaggaagtggtttgagttatcatggtttgagcgctgcccccagatttgtctatgatcagtggtcacttgtcaggggcacggggggagtcaacttgtttttcttaccttgcttggtgagaaggggctgggggtgggaggaggaagcaagtgtgaaaccttctgaggtgagttttatctccgaggctgtgggtgcgcgttggtggggagcttccctgaggtatagctggggtcaggccacctgttcccccctcgctgccagggctgctggcagcagaagacagcctgcacccaggacccaggctgggcacccaggtcagtgaggacctggtagttgcccatacagtagcaggaatgccttagaaggggcccaggagtgtgtggagcctgactgctttggagtttccctcccacctgcttggtccaggaacccctgactttttagcgactttgtgttttgtccctctgcctactagacggaatgtaacaaaaacctgtgcacaggctgggcatggtggctcatgcctgtaatcccagcactttgggaggctgaggcgggcggatcacctgaggttgggagttcgagaccagcctgaccaacatggagaaactgtgtctctactaaaaatacaaaattagccgggcgtggtggtgcatgcctgtaatcccagctacttgggggactgaggcaggagaatcacttgaacctgggaggtgggggttgtggtgagccgagatcggccactgcactccagcctgagcaataagagggaaactccgtctcaaacaaacaaacaaaaaaacaacaacaaaaacgtgtgcaccaccccttgttcagggtgaggggtgtgtgtccatcagtgtccccttaaagagggacccctccccccacaccgccgttgcagcctctgctgtccttcctgggggtggtcttgtttctctgtttctctctctctctccttatgattagaatgatttgtgagttggtggccaagccggagtacctcctgggtacagtgaagcctgggattcccagagtcctatggggcacctgactcccaaacttgcttttccaagtggagaaatcacaacaacgaaacaacactgagtttgcagctaacttttatcacacacttactaggtcccaggcactgttctaaagactctaagtgaacttagagtatttcatttaatcttcactgtaacccagtgagcttggcactattgttacagttgaggaaatcaagactctgagggtgaaataagttgcccaagctcactgagctggtaagcaggggagcaggatttgagcacagccacctggctttgaagcttgtgcgctttcctgtgacctggggcagcaagtgccactccttattctagactgactggagtgggccaggctgctctagctcccttggctacagagggaggactccagtacatcctgggaaagcctttggtctccgctgccactgctgcagagagtggatttttgtctgtggggcagggagggaggaaacagattgggctgggctgagcttgtgcagggagtagtgggaatggtgtgggggtctgttaaggagagcgcgtaccctgccacacaggctggtcaccactctgctccaactgattgttccacgtgggactgtgggctcagtgaggacagatcttctgatttttcaaatatgagcgatttcttgatttttaaaagactgaggccaaaatggaaattctgatccggggcctgggtcagcaggtggagtgtgctgcctccatcatagctggtggtgcccagcgctgtgctagccctggacttgcttgctcacgtgtcaacgtctctcactagagtgcgagggaattccttgaagcccgagcccatgtgaagcctccctgtgtttcagcatcgtgcgcagggcctggcacaaagtagctgctcagaaagtggttgttgacggaatgagtccgtgtcccctgtttctacagaggggacacctttgcaggagtgacggaaatgtctcatagtcccccatctctgtttcacagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcaggtgagcccgtggctggtcttaaaggttccctcaggaggaacggagaaagaggagggcccttgccccaggactcagggatgatgacttatcccaggactgagggccctgttttgggaaagataagtagctttagatgcataggattctaggggcttatactgagggagcagagatttccagggagatacacaggaaaaagtgaggccgggatagcccagtaaggaaagggtcctctccttcccccacctcgcctcccctttctctggggaaagggcaggtgcaccccagctgcttgttgccatgtcacagggactgtttgccaaagctcccgctccctggctcacccagtggttttttatttgaaaataactgagggagacccttggggtctgtgccttatctgctctccctggtctctgcaaacaagtttggcctgtattcactggtggcctgcgattcactagatcgctcttattctccaacgtcaaacaaagtgcttgaagaaagataatgaaacaaacagcaagctgggcctgaaatcccagctacttgggaggctgagatggaaggatcgtttgaggccaggagttcgaggttacaatgagctgtgatcataaccctgcactccagcctcttcttcttcccccttttcctccccatttatctctccttctctttaaaaataacctttattgggccaggtgtggtggctcacgcctgtaatcccagcactttgggaggcctaggtggtggatcacttgaggtcaggagttcaagaccagcctggtcaagataaaaaccccatctctactaaaaatacaaaaaaattagctgggtgcggtggcaggcgcctgtaatcccagctattcgggaggctgaggcaggagaatcgcttgaacctggggggtggaggttgcagtgagccgagatcacaccactgcactccagcctgggagacagagtgagactctgtctcaaaaaaaaaagaaacaaaacaaaaacctaaaaatctttatttattccatcacccagatatgatagtgtgaacatttcagcatcttttctgtgtgcatatgcacattaaaaaacagaccttattctatattttatatcatgttgcctttttaaaaggaaaattgtagcatgaacctttcccacaccactaaatgctctgtgttttacggtggttgcccactcttcttttatatgggtatactgtatttatttaaccagttctgtattcagatacttctgtctactcttttgctattgtaaataaccctgtgatgaaaatccttgcgcatggattgcctctctgattattttccttgggagagattgctgaaagggaaatgactgggtcatgggtcataaacattttaaaggctctttacacatattgacaaattgctttgcaggaagattctaatggtttatcgtcttatcagcagcatagacatgacttggccccacgggcttcatttctgcctgtgcctctctggtctccctggcatcccagtctgagcctgtcactgtccagtaggcacactttgttaggatgcaacacatctctgggagctcacacgcctccccttagacagctctgtcagcagggcctggccttagcctttctgtgggtctcttctctttcttagcatgtgacacaaagttcttggcatctacaatgtctaattttctttctttttctttttttttttttgagatggagtttcactctttttgcccaggccggagtgcaagggtgcgatctcggctcactgcaacctccacctcccaggttcaagcaattctcctgccttagcctcccaagtagctgggattacaggtgcccacgaccatgcctggctagttttttgtatttttagtagagacggggttttaccatgttggccaggctggtctcgaactcctgacctcaggtgatccacccgcctcggccttccaaagtgctgggattacaggcatgagccaccacatgcggcctgtgtctaattttcatgttcattttaatatttgtataagaaactacttctatttaagagacagtctctcgctgtgtcccccaggctggagtgcagtggtatgatcacagctcactgtaacctcaagctcctggcctcaaatgatccttccacctcagcctcccaagtagctgggatttcaggtccagcttgctatttgtttcatgatctttctttaagcaccttgcttgatgtcatgtacttagaagccatattagaaatatacagtcataaggacaagtcctgctgggtaatccagagcttagggagcttcctctgggctgggctgggcaaggtgagggagtagggtgagaggtttgggtgataattgacccttgggggattgcctgagaaggagacagttcaagtgtgctatgagtgcagagcagggactggcctggctttgaagggactcaagtgaccaaatctcttggcatgtggctctcaggatgcctcttggtcctgtgaggcatgaacaggatagatgggggatggcgggggctgggagggcccaggagcccagtgcagtggggggtgagagctggggctgaggactgcagagggcctaagcctgtggttagacttcctgtcaatgagtgtagctctcacggtgagggttgatggggaaggtggcagcaacagttccacaggacagcagcgtctctctttctgtttccatcttatgtatgagggggtgtgtgggttctcgggtcggtggcgggctgacagtcttctctgggtcagagggttctctgtggctggctttgacaagctgctgcttcctccccccgggtcctcacccagcctctttttgaactgcccactcagcctgctttatttccagcctctagatctctgtaatcctgcccggaccctcctgctgtcagaggagctgctgctgtatgaagggaggaacaaggctgccgaggtaagactttcacctgcattttttagggggctttctgggtgggcttcattggcattctccaggcccctcactttggtctcttcctgagtatcttagaattgtacattctcagggtaggggagacctgagaaggaccccgccactctccctagcaaaggctacccagctttttcttgtacatctcctttcaaaagctgtcgaatccttctttgatggttagaaagtttccccagcccctaaagacaccccattgtttatcccaccttcctctcaggagcagaagagatggcaatttaccctggctgtggggagtgactttggtggcaggaagagtaaagctattagccaaagtgaatttttagaccagcatcagtttacctgagttttctgggcctgttttaacccaaatcccatgtcctcttctgagagacgagtctatgatttcgcctgggttgtagctctgcctgtggggtgctgacatgggacctgtgtcacccttcctgggagctggcctgggatgcttttctctaattgggagaacttcattcatctacacaaccccagagctggtcagttcagtctctgagcttaaactacttgggtacagaagttggagccctgggctctgccctggctacctggggccatggggtgagggtagcaggctctttgcagatcaggccccaatgtagagctgccttggctgagtcgagtggcagcttggggtagtggaaagatcaggaaacttggagacaggaagtttgtatcgagacccaggtctgctgctggctcacatgtgatttcttccttcttcctcagtctttccatctgagcagtaggtatgtgtgtatttgaggcagtaagggcagggtcagaggttggtctgtaaggacgctttaaacctcagccttctgggacactatgtgtgactgtggctgaagcaggaggttggtttgttttttaagtaagcagactggactggaactcatctattccaaatgtacattatctttttcaagggagtgccctgggggactgcatgctcccttccaccgctcgctgttgcctactgtatttctggacctcctcttttccgaacctcctcttgggaactttgcaaactttgggaacttaacaatctttgcatatcttctgaattgtctcagtgggagtaaaacttcatctgttgggagggatttaagttttagggatgagaagtcacttagagctatgtttggtgaatgagagtgtggtggacctaagtctggcatccaagggtcagaaattgaggtgtggccataaattcacagactcataagaagccagttagagatggcagccaccctgaaacatatacataagtctaaattcactcttctgtttgtccacttacccttgaatctgcaaacattgagcacttattgtgtatcctcattgtgtatgcattttacatacttgaccccaattagctcttgcagcacccccatgaaaggcacgattgtccccactctgtagttaaggcaactgaggctccagtgagattcactgggacccaagagtctccaggctggtaaggaatggagccgggtcatttctggctcagtgatgctttccatgaccccacactgcttctggcatgtctgcataaagacaaactaaggaacacaagctgaagccagagccttgtgacagttgcaattcgtccagaaaaccctgccttatagatctctggagacttagaaccaagagacccctctcccttagccttgaagattgaaggaaacaatttgaagacaagtaaaataaatattaatgtattcctttttgttgaagtatgatggcaaccaaacatgtagatctgggcatcctgtcatattactcacaccaaaaaaaaaaaaaaaaaaaaattcaaagggatttggataaattcatgaaatctcagcattggttaggctttcaggagtcatccatgctaattgcttccttgtaactttccagttaaatggttttctgattggtgcttgaatcttctagggcagcccattagagcagtggtttttttttttactgggaagggctaaattgtagagcattctcccttacactcaacagaaatctttatttgtggaatgttcctccttggttctttgtcccatcacttctctgggcatgctcaagtttgctaacatctgtgagctgatccagtcccgcaccgtgaactaccctcatcacagccccttccagaagtaatagacttgattaatgtgccctgaggtctatggccctgtgcgaggttctgggaataccatgaagcacaagacagacacaccctccctttacacactgactcatggagtttaccattaactaaggcaccaaagtctttttggtaaactctgctcttaggtcagattcccaagaagaagcttagttagggccacttgggagaagccaccctccaagtggtaaggacccccttaccaagtgatccctcaactctgaccctttggaaaatcagatgtgtccttggagcaagtgtggggaagacactgggtgacccccgtggcctgtggaaggcgacaggtgattgggccatggagatgggcatcactctcccatgggctgccgtggcccctgctggtgctggtgagatgggggagtccacatgccctccccggcacgcttgcccctctgctctgcctccagctgtgtgccagctctggcctttccctgacccaacctttgggaaatttttcatttatgccttaatcacttcctgtctagaccatattctcagccctgggaatctgagccagagtggtggcctgggccttttctcaccttgctcatggttcttccccagttgctggtggctcctcctacttgccctacttccacccctctctgggcctgggctgttttttttttttttttttttttaaactttctaggctcctgacagattgtcggctccagcccttcccctgccagcctccctctgggtctggaggtgactaccagatttcccttgagtcagcgacacgttttgtgggaccctgagggtttgctttgtgtttctggctagtttagagccttctttccattgctcggactttgaagtcttctcagacaaccaattccttgactccttctgagctcttgagtcattttcttcacctcatctcttaacattattattatcattattattattaattattatttttgcctcatttgctccacctctttggtctctggattctttcacattcaggaactgcacagctgtaagcacattggtatctctctgtatagtgatagctttaggtcagctatacctgggtaatggtccctggctgtgtggccatggacaggtcacttaacctgtctgagctctagggtcctcatctgtaaatgagggcagtggtgttatttataagtgaggatccactgagcagaaaggaagcgttcaacacttgaagacttctcttgggctgcactgagacagggctgtggtgggaagggttagggtcactaccaagatgccttatagcccagggttctggagtcctcatgtttgggccccattggagaagccaaagcccctgagagctccttcaaggacgtctccctgttgtctctgcagcccagatttcctcaagcctctgtatttgtgctacactcaagaagccaagccatattttgatatatattctatatttttaaattacaaaagtaacagtgattgcaaatataatacacattaaatcaaaatgtatcaattaaaatcccactccctggagtgaggagtgtggcatcttaactattttaaaaatgtataactatagagaaatgtgttgttttgttttacaaaattggattctatgctagatatttttgcacattgtactattttgatttacgatagacagatttctatttctgcccacatagctctactttattttttaatagttgcataaaattctgccgtatgaagttagcacaattcattttattcatcttctcttgatgaatgtttgttattttcttaaattacaaaaatgctgctgagaacatcctcatatgttcatatttatacctccttgtaagtatttctgtaggatagagtctcagaagtgaggctgtggggtcatctttaacaggttgatagctgaatgtcaacctgttggctttttaaatgtcaccaacagtccaacacacactcacggtacccttcagtgcatgccaagcccttctggctggttcttcttcagaagagacaaggtgtcaggtgtttgatatctcaaagggaagttcacatacttaataacactttgttttctttggagaatctaaaattggattttattgcttttgactaaaggccactgcaggatttgcaaaacaaagaacagtgtaatctttagtggcattaaaggatcaagtggattttcttagcataaaaatatgctgagcgtgcctgttggtttacctataatgtctaagaatagcctctgcctttatttttggagcagctaatgcatgaaaaagataaaagtgatgtccatgtctgtactagagtgtgagtaactggctgtttcttaaactgatttctcattaatgcaattaaacttatccacaaggaatttgataatattagctcacattgtgtggcgctttactaggtctgcaaaaagctcttggaaggatcctgtaagaatgccaagcagggactcttctccctgtttgggctgttgagaaaactgaaggggttaaggggtttaagccaatatttttgtggctagttggtggcagagctgggataggagcctcctgacttctgactttcaagtccagtgctctttcagccagacacttagagcagaataaaagcaaatatggaaaatcttacagcttaaggattgctccaagccccaggtgctgggctggaggctccaggagcatttggtcagagatgtaggcttcggggatcaggctgtggagaggcttgcagagaccagctgccatggagggtgagggccacttttccccttctgtttgcttttttcctactttgaggagtggaagtataggaagctggagggtgatggggccatcttgactgcaggtcaggactgcccttggctgaggctgtactgagcactgctcctggttttgtgtgagatgatgaggatgcattatctggggaggctgtggctccccaccttctcggggaggttgtggctctcagcctccagaggacagcaaagtagccagttctgtttgctctctgtcaacccaggtgacactgtttgcctattcggacctgctgctcttcaccaaggaggacgagcctggccgctgcgacgtcctgaggaaccccctctacctccagagtgtgaagctgcaggaaggtaagcagatgccgtaggtgcccagagcccctctcaacttgccccagtcccactgctctgggcagccctctgggatctggctgccagtcatccgtagggcactggagtgtgtgctgctgggctctgtccatgggctagtaggtctcagacactggcattctttctaggctggtaagccttctgatatacctgaggttttcagggaagtttctattctagagactttccagagaggctgtggagtcgggtaggaagagctttggattcagacagacctgtgctcaaatcttggccctgtccctccatactgggatgactgtgggcactgtactcagcctctctgagactgtttcctcccgtgtaaatagggataaaaatagtaaccgagaaggttgctgtgaagattaagctaggtcataaatgcaaagtgcctggcccataacaggtgcccaataaatacttgttgccacccactcaccccacagatctgtggacagagaccgcaactcggctctactcagctgcatggccctgcggagcccaagccgctggggctcaggcacatgtgggagcgtggagggaatttctaacccaaactttccaccacgccctccactcgtgggaggggaagccagctgggagtatctgtcagtggtttggtttggcgcctgaggtctctgctgagaggggctcggtttcctctcccagatcatgaaaacaacagacccgtttgaggatgggtgacaggggcagagaggaaaatattacccagtgaaagaattctgttttggtggggtttgctcgggaaagcttcctggctgtttgcaaactgtcctgcctgcttagtgcctgagtgttcctcctcctcggaaacccattcagtatgagaaccgccactctcacttccccacaggaagccactgacaacttctccatctcgggctctggcctttcccctgtccatggaagggaaaagcaagtcacctcactgggtcagctcctccctccaggcgggctcagcctgaccacagggcggtgggaagaagccgcctgagcaactccagttccggcactggcattcccagagttccccatgcctgctggagggcattaggttggagttccagtggcctctgttcctgggctttcctgccatcctctccatacccccagcccctccctggctccctcacacccagcttcccatatgcccattctccagcctgcagtgtgcatattcacacatgcactcacaccgagtcccttcttctctgcttccccctccctgcccccagcccagacagtctaggaccccatcacatttgagggaggagcactggatgggccagggctcagtaatatgccctggttggtacatgaatggaaccctctctctgttgtgcacattacaaggctgaagctataacccaggaccctggtttgctcagcttcctgcgagaaggagggagggaagagaagcaaggctcacactggctacaatttgggtggaggtggaggttgcggggagaaggtagtagaggagctgagggcagtggctgggagtctgggatctgggcgtggtactgctgtgctgtgctgtgtggcttcagctggccctttccctttgccttcagtttctctgactgggaactaagggtggggccagcgctttgtgtccctcccagctctgatgccctcacacagaaccccagagcttgctgtgagcagctgctggaccatgcctatattatcctgcctctacccctctgggggcctggttggggaattggttgggatctccccttctggaggccccaggccccagacttgaagctaggggtggggtgtgctccatcctccactgggttgtgatggtcaaggtgggtggtgtggggccttggggtgtcacagagactctccaggtgctgagctgcttttgagctgcagccttgtgtaagcttggcactgtggcttcctctccctgcagatggagggcgagctgcacaagggctgaggatggccaaggcagtacttctcaggagagaccaccatggacggaagagccccttgggttggtgtgggagaggggcctgtgtgtgtgtgtgtgcatgtgtctgcctgccctggatttttttggatagatggtttggggccaaactccagggagcctgagagctgctgagagggatggaaatggctccatttctaggtgcacaatccaacgcttagatttctttccaggcaccgatagagcccttgccttcccccagctgcccccactcccctgagacaggcttgtgggcccagaggctcatggaagtttagtgaccccttctcctgcagtctaaattggagccgcaggacccagtgttctgagtcctggcgtccaatttcctgcctgcttcccctgtgccccaagagacctgctgcagcagcaagggcctgaggcttttaagggatgcatttgggacctcagctggagcctctgttggcagaatggtctctgattaatattgctcatgactcctaggtttcttatttgtctctttcaaaccaccatgtatgcagaattcaatttggggcaaagaagatggcaaacaaggaatgcacccaacctttctggctggttggggctggcaggggctgctccctggcaggggagaatcagccccatgctagggaccaaggtatccctgtgtaacttgtctgaagagtccttagctccattggccaagcatactcccagggcctagcctggggcatggaacactgtgggtgcctaatcaatgtttgttgtgtgaatgaatgactaaaaggagagcagaagtgttgcctcagttcgggagctgggggtgcacctctcccccagggctcctgggtggtagtcacttaaatcttgtctggccccgtcctgcccagcctcccctaggcttcagcagggctgaatggcagtgtaatgggaacaggcggagagctggcgctaacaattggaacatctccggtcagccggggcccattgtggtctcttcctgcctctgctgcccgctagctttgctactctttgtgttgctgcctcccaggtggccagcgtcatgcccatagtgtgtctttctggcctgctctggtgtctcagaagtggcctggaaatgttttgctgattattaggctctccagtcaccttagagccaggtaggcagttgcagaaagtcagttgctttggtctcagctgctggaatgtttggagttaactcttggttagtcctcattttctgagcatgtcctcagaacccacatcagtgatagcagtgctggggtggtagcagtggaagggacacgttgccacctctggggctcatagcctggtggaatgcagacgagtaaccgtggaggggtagaagtgtgacatggtggtcaggacgtaggctctggaggcaggcagtcctcacttcaaagctcggctttgccacttactcaatgtatgccctattcatgttgttctccctccctgggcctcagtctctatatctggagaatggggacaataccccttctgcttgcctcagacagcgaagggggtttgcttaatggttgagttttggatctcagatcaggtgagagagggctctgggaaagtgacggaggggtcagacctgggccaggaagctatctctggggcccacccagcccgtgattggggatccctcctgcatggtccatgtattccttgcgggaagcgaggtccactctggaacccaatggctccttgttgcatttcaaaatgccaaggcagttggaatgtttaaaggaaaacccagatgcgtgctgcccttctcctccctcctagcccccagttctaatgttctagaaggggcagaatttctctcctgggtcagccccttgcagcctgttttctacagctgcagctcctctccggcacccttggcttcctcagtttgttgttcttttatgaggctctgaaccatgctgagtgctgcccccattccgtcctcctctcaaagtactgccagcacaaggctgtgacgtggaacagatttcagagaaagtttgcagtaatgcagggaggttggggaaggaggcaagggtgtcacagcacagaaaagttgtcaaggcaatccatccaccattccctgccataggaaatatgtctcagggagtgttcccccaacctcagcctcctatttccctgcagctctcatctcctggactttcctctcccttctagaaccttctcttttcttgccgccagcttctaacccccaagtttctgttattttcttacatagatccttttgactcttacttggcactaggatctgcttctggaaggccaaagaaatgtcccagtgtgttctcttaaacaaaagaaaccacctcctcttgtctccaccctcagcaacacaaggaaccagcagaagctttgaaattacagttttcttaaacatgatggacttcttaggcaggactccctccctccccagtccatcgctaggtgggaagaagtagaaagatttattctccctaagtccgaagtgaaccctcatttacataagggagattttttaatctggctgtgcctggcagcccttggccctagggatagctttgtctcagaactgcccatataccttgcttcgagggggcctggccttcacccacaccagggccctcattcactgcttttcttaggaattgacttgacccacagtctctatttttatcttgctgtcttctctttgcaactaattttgctgtctttgacaatttctttacttcaagtatgtgttaagggttctaccttgagcccagcactggcctggtgctttgagaggacagaggagctggatagggcatatgtggtgggcatttgagaggtgggctgtgtagtggtaggagtgtgggctctggatccaggctacctgggtctaaatcttgattctcttccttactcctgggcaagttactcaattcatctgtgcctcagttttctcaagagtcttgggtgaaaagagccctgtcttccaggggttgttgtgagggtcaagcatatccatgggaagcataaggaacagtggttggcatggagcactgtggtgcgctaaggtcctgtggccctttaagcatttactgttttacgtgctgcgtggttgcttccctcaacaatgacagtttgcctagtgagacccattgcacggtcacagggagtaaccatcccaggaccgtgcccagacaagtgacctaagcgggagtgctgccaggccctgaggagtggctgcagtgggcagggcaggtgtcctggagggagggaccaggctgcttctctgcacttgctcttccttgaacacaatttgtgcttctcttggaatgtcctttcttcccaccttgagtccaaactcaacagggccctccttcaggaagcttttcccagaagctgggtgtcatctcctggtcctcctgcttctgaagcgctctgagcaatcaccttccctcggcgttgacattggaccttagctcctctgctgaaggaggcagttgctgacagccctcccagatgcctcccaggtggaggggagttagtgaatggttgcaactgggatcctggactaggggttaggaggctataggaaaacatacagagaggtgaagcctgggcctggaagctgtctctgggctccacccagtctatgacagggtatccacctgcacagcccaccattccttggcggaaaacaagcctccctattgaatttcaaaatggcaaaggcagttggagcatttaaaggaaaatccagatgtgtgctgcctccaggtctctcactgcagaaatcatggaagggaggaggcctcctgggatggatgagggctccccccagtacctgatgcccagagggtgctgctggctacctctcctggggatgaggtttcagcattccttgggccaggctgacccgcaggcaaatgccttagagctgtacattaccctggttagttacgtagccaattttcctccagagacttccctgcctcccatgcctgcctctctcttttcccaggaggtgccacacacagccttctgggcaagacagctgactgtgctggagcaaactgctgaggctctttatccagttctaatgcaaatcttactttttgttccctcaaaggttcttcagaagacctgaaattctgcgtgctctatctagcagaggtgagtcctttcctctggatttgaggagagagatcttcgacctggtgcttgaggggagacactgggctgggatctagaccagtgttctgatgccagcctccatacccactcatgccgaagtcctgggcaaggccagagtagcggttttttgctaggtagaatgggactagccattcctgcccctgcctctctcacctctgtgttaaagagcagtggacaggaaagtgcttagaacagacccttgagattttctgtgcaggacctcctgaactgcaggaatctcagtgggggtgtggccgggcaactgtgcatcaccctgtttactggttaatagcccttcctctagagatcgccctgattcctgtacctgcctcttgcttccacgttttccaggaagtaccaccaacgaccccttgtacagggtcttgtcagtgtttcaaaaggcctgaaggtatttgtacctttacctgggccagataatacaggctaaaacaaacatccagtgtctgggtttcaggctggaatgatacccactcagtgtggttgagattcctggttatctcagtctgatcagaagcttagataggcagtgctgtgcctttgctgagcaacatctggcaagtaacttattacttgatttggtttggtagataaaatatcattaaggctggggtttaacccaagagatccttgaagatgaaaaagttgagagccactgagctatacaaatacttttcaattttcggtgaattttctattcactgcagggcggtgtctgttcaagcaaggatgcattagacacattcctgcctctgccttcgcttaagtttgtctcatgcaacagtccagggaacctgttttgtgggaggtgggacatggtctatattggctggccaagaggaacacacccctttgagaaggaactgtacacagtttgtgattgaaaatcattctttcagttcctggctaagaagtgcaaggcctagagagagtttttgaacagccccctggaggagaagacagttgatgagaagttagctttagcggagggcagagagttccaaagaggcagtggacattgctggggctcagctggggaactgggctgcctgaaatacagacctgagggccaagagggcattggatgtcctcccctgtgtcaggcacattcccccggagcacaggaagtggctgatggaatcacttcagtgctggagggtgtttagttccacagagccaagcaagcagagaggagaagccatgaccaggctaggctcttcctccagcctcaccacactgggttctgattctctggggcagttcctgaaaggaggctccaggttctttaatgccaatagagcttccttccaggttgggttagttttttcccagagaaaaggacttctgctccattagtttcctgggatctgtgacgtgctggcttccagagattgtgaagggatattgatttgcggctttttgtttcagtaaagtgccaggtgatctgatctccaggggctgtgggattgagcttacaggcagctagaagcctctctcttctcttaatgggttgctatttagaagaagtactataattcagggaagacaagatgccttcttgctctgtagcctggaccactcttaacatgggtggttttggatcctatcaagagcctgaaactcacatcttagttggaacttctgacaagtgatttctcttcattgcctgacatgcaggtggcatccagagaagaaaaagagagtcaggatttggagaagttttttgactctgtattgagaaaggcccaattgcctgggtgatggcagctctgattgttctctagctgcaagatcctgggtggtgttatccgaaagtagtcctgggctctgggtctctattgcctggacaggtgtgtttctcagttcctgcaaatacactggacagatgcagcccacaattggcttcagaacacagaaggctctgaagtcagttgggtccatgggcacattggtcagggactattctctaacctagaatctgatgttggctccattaatttaagagtcttggagttaggaaaacctagatttgaatcttggctctgccattttctgagtgatctggggccagttacaaactcatctctgaaatggggctggttctaccctgcagggttgtggtaatgattaaatgagattcaataagacttgcatccaaagcacttagcacagagcctggcacacagtgagcgctcaataaatggtagctattgttattgtcagtttcaaaacaaggggaagggctcttcatattcatttactctccattagagaaatcacaaatgatttattggtcttttaagaagaaagctaagaggaatagctcatattctttgtaatgtgcatatacagttatacaaatatggtaagatcacagactctggaggaggcagaagacaaacagtgaatctctcctctcccgagacctcctggggccagtgacataacctctctgagccttagttttctcatctgaaaaatggtagcagctgctttccttcctacctatgtcatagggtcattaggagaactgaattaaatgacagaatttttatcaaagcaaatgaaccaacttaatttatggctgaagaggttttgttttttacaaagatacagttaattcaggagcaaggaggtaaggcaagagcgggattttaaagaggccaagaggagctgggtgtctggttggatttcaggatgcccatgtttaaatgcacaggtctgtgcccagtgcttctgggccagggccagtgcatctgaaaggtctgtgcttggctgaccaccccatagtcaggaggcaccgtctgagtgagttatgtgaggaagccttcagggtggcttatggccttgaccacagagcctgctattgagggcacagtgggcatcagtgttgggactgacgagttggatcacaccctggattaaaagagatggtttacctgtgagggaagccaggaaggtaatgagtgtccccaatttagacagatttaggcagatgggaattcagcctccctggagggagctggcttagtgctctctctcttggcttggccaagagagagagagaccaaagcttaggtctcccgaaaatgtttgcccatctaagccagccagctctgccccctgccttggaagccttctgggtcctctagtattacagcttcaagctctgagagccagagacccagccctacactctgctgttgagacaggcaatacggtcaccatctcaggtgaagaaataatggctttccaaaggagattcccatggggcagggcagcagagggtggttcttgtggtgtcagcaaaacaggcataatcatggctattaccttgcagtgtcgttggaagaaatgtcgaggtatcactggtaaggggcttagcactgtgcagggcatgggatttgagggggctgcctcagtattgagggtaggtggctctctcactgtgagaggccctcccaggatggggggagctctttcatacttttgtagggagggggacaccatcctggagcttagagcagtggacagttatacaaaaagctgccagcgaactctgcagctgctctgagacccagctacctacagaatttctcctggaggctttgcattctggtcgcctcttggtccagtctgcaagagggagcattcctgccagccacaggtgtggcagcctgaccaggtgatgagacctccccaggtgttggagatgagatcccagcatgtggttctccaaggctttgagctggagctctgctcctcattggcgatgagactcagggaggtccttagctgctctgaaccttggccattcccttccataaaatggggacaacaatccatgcccttcctgcctcttcactgcattgccaagatcagcatgagatcgtgggtgggaaaattctgtttttttttttttttgagacagagtctcactctgttacgcaggctgaagtgcaatggtgcgatctcagctcactgcaacatccgcctcctgggttcaagcgattctcctgccccagcctcccaagtagctgggattacaggtgcacaccaccatgcctggctaatttttgtgtttttagtagagacggggtttcatcgttttggccaggatggtctcaaacttctgacctcaggtgatctgcctgcctcagcctttcagagtgctgggattgcaggcatgagccaccgtgcccagctggaaagttctttttaaaattgataatcagacaaaaggaattattagtaaggcagaattcctgcttcagaacagaaagaaaagaggacatggaggcccagggagattaaggaatctgctgaagcccacccaactgggtagaagcagggctgggaggctcgggccagggccagggccagcttcatggagtgatggcctttccaagctggaagggaccacagttcctgcctcaccccccacctttacatgggaacactggagacagggagcagagggccttctggtcagcatctgcctcacccggcttctccctgggaaatcttggggtcttttgctggccatatccttcccctgccatgggctagaggactctgggcagcggagggaagctgttgttaagtagaagctccaggagtgcctcagcgcaccacccagttccctgaaaccagcaggcagggctttctttcctctttccccagatgctcttaggaagatcaacttctgagcacttttgggcctgagaggaatggctggcactcagcatgggaagtgcccccactctgaagggtggcattcctgagggttgggttggatgcagggtagaagaagtccctagatattatcagctgatgtgatagtccaccccagctcaaggcctgctttcgctgcttctggaacagcttctcccaaacattgtttttgctggccccttcttaccgttcatgccttagcttgtgtgttgccctttctaagaggccttttctgatcacctcaagtatgacctctccctttatgaccttggtgacattttcacaagttgtaattacagttgtccctcagtatccaccaaggatttgttccaggaccccacagataccaaagtccaaagatgctcaagtccttgacacaaaatggggtagtatttaatataacctatacacatccttccatgtactttaaatcatctttagattacttataatatctaatacaatgtaagttctgtataaatagttgttaaactgtattgtttagggaataatggcaggaaaagaaatctgtacatatgtagtacagatgaattttttttttttttttttttgagacaaggtctgccctgtcgcccaggctggagtgcagtggcacaatcattgcttactgtagcctcaagctcctgggcttcagcaatcctcccaccttatcctcccaagtagctgggactacaagcgcacaccaccacacccaattaatttttttttaaaacttttggtagagactgggtctcactgtgtttcccaggcttgtctggaactcctgggcgcaaatgatcctcctgccttggcctcccaaaatgctggtttacagatgggagccactgtgaccagcctaaaatattttttcaaatattttccatcctctgttggtggactccatggttgtagaaaccatggatagggagggctgtatattatttctttaattgtttatttgtataaataacaaatattattgtctttgcccctaacctgagagcatgggcttagtctgtctcatttacctctttatttccaatgcctaggactgtctctgacacagagcaggtgctcaataaatagttattttattttgtttttttttcgaggctgagtcttgctttgtcacccaggctgagtctggctttgtcacccaggctggggtacagtggtgcgatcctggctcactgcaacctctgcctgccaggttcaagtgattctcctgcctcggcctcctgagcagctgggattacaggcacatgccaccacgctggctaatttttgtatttttagtagagatggggtttcagcatgttggccaggctgttctcgaacacctgacctcatgatccacccgcctcggcctcccaaagtgctgggattataggcataagccactgcgcccagtcaataaatagttattaaacaaatgaattactgaatagtaatactagtgactgtttgttgaggcctgattgttgtcctccttgcttgccctcctagtagctctgaaagccaggtgatgccattatatccccatttcacaggcagcttggtactttcctgaggttgacagctgggaagtggcacagctgggattcaaaccaggcctgtccaactgcaaaatgagaaagggctggatagaaacactgtcttttttttttctgttccaagggatcagctgatgctcttagctccctggctgagttcatctaatcgcagccctttggggttataatcaaattctagtggaggcagacagagcttgtactcccctgatgagagtacccggttgtgggtggcaaccctgggcatgtaccaccatccctaccccgcccctagcacactctgctttaggggtggctctctgggtccttgaagctccctggtgcttgtgccaaagctgacctggatttgaccttatcccagaagtccttcctggcaaccagagcttaccaaggccattgcttgctaagcactatatgaggcctagatgaaaaaggcctttctaggaggggtttgtagtttagttggggagacgagactgtagtacttaacaaggttgaatagcgaagcgggacctaaatgtcagcagtgcctgggatgttgctgccctcgagtgagctgaacagtcacagattagaccaagatcatgtgctgggcagtggggctgcagagggccacatgactctgcccgtcaaagactttccaaaggaccctgagttgctgtttgggttctgttggtatgcccgtccaaccacccgttcagccttggccttgggatcagagaagagcgctgtgaggaagatgggttctgtgagccaggggaggtggggagggttcctggctccacagagaatcagcctgaggccctggccctctgggcttcccacgtgctccctcagctgctgctttgtgctgcctgcccctgggggtgacctcatcggctctgtcctgctctccacaggcctctgctgtgttgggagccactgccttcctcccctcccccaacctgtgggcccacagctcgccagctggcccttgaacccacttccctgcgcctctggctgcctcaatgtcactggggattagtgtgcatttgcggcttttggcggacactcccctcctggctgcagcctcaccctctggagcccagggatgggcttgggcctgggagccccctgaaccagggagcagccctgaccgtccgtttctctattttccctgacgtcagaaggcagagtgcttattcactttggaagcgcactcgcaggagcagaagaagagagtgtgctggtgcctgtcggagaacatcgccaagcagcaacagctggcagcatcacccccggacagcaaggtaagggccttgacagtggctgtggcctggctgcctcgtttcccctcagccagcctagacccttgagcctctgcattgagctgggggccagcctgagcttccaacttggctctgggcaatgagctcttggcaagcggggacctgtgcccgaatgtctctcccccttggcatgtcattgggtctgctgagtgggtctgacagtgctcgtgtagagcgacagagccaaattaagcgtggcccatcagttctgcactctgttcttcggtttgcctatggcaaggtttaattcgggctggcctccctgatgctgcctggcatgcgttcacctctgccattgggtagcctgtgcctgggggcagcacactggtgtttaacattggccccaggcggatgcgatagaggggatgtttgcggcagaagctgttgtatgctgtatagttccatgtgggccagagccaagtagagctgagtgtggactgctggggtctggggactggctggcaggagcaccggggaagattagagactcccaggggaggctgttctgggctgggcactgctcagcccatccagtgcctggggagaggggatgggataggagctggaccacacagccttcccctttgacactccgatgccagccacaaagtacagttatattaccccatttgtgagtcattcaggtcccttcttttgctaaaagtgctggccatttgggaattgggtctggttggctgcaaaagttgctgaggtggttgctctgctggatctgggcgaagaggagagatgaaagaaagctgcagcctgtaacttgctggccttttcacttctccctggtgcagtcagtcccctatgccatgggcagcaggcctatgcagggggcagttggggggcaggcctgctgaagcaggaggtagggaagaggcagttggcagcctcttctgagggccagaggtggacagcagctccccagctattcccgaaaggagtgaggatctgagaattacatcatcttagctgtgaacgttctcttgttttacactagctagtggcaagaataacttggatgagggaagacagtaggaaaagcacggacttctgagccaccctctaccaccaactggcagtgggaacttgggcaagtcactttgctgctctgtactttgatgtccccatcagtaacctgggacaatagtccttccctcaaagggttgttgtgagaatgaaatgagagggtgcatatacgggctatagcacagtgcctggtatgcagtaggcactcactcaaccatagctgtggggaatgcattgccccctgcccagccccaggtggtttgttgcagcactggctggttgccactgtcaggttcttctactgagcagagacctgtccccatgcctataggctgccctgccccactgatcctgggttggtcacagtcagaatccaggccgcttcctcttcattggggtggcctctgggacgtcgaatggctgaacctatgccccagttttttttcctttgggcttgtgcctccttttctgggggaaagagctctttgtgcctcgctctcagagtttgctgactctggagtgtgttagcagcagccttctcaataccttggagaatctctccatcttcaggtttgggaggccagagggtgactgaaggcaggctgtttctgaggcaggttgtggtccctgtagggctttgggcttggctggctgaccctggaacggcccaagggtttgaggcctggcttcagggccacactagaatgtatgggaatcctgagcagagcagtttggacacctcttcaaatccaaactcttcaaacgcgtgttccatggagaagctgtgtgctggacaggagaaggatgaaggagggggcccaagtgctgggacagcctcagaattacctcccgggcctaagaactgggcctggagccacactggcataccccacttgggccaccctcctaagaaggccatgatgtagctgtcttttgtcaggctggccctagaggtctcactgctcaaaattccccatccctatcaccaccatgcacatgcaaagagtcttagcaacttactccttctagacacttatggaatgctccctgagaggaattccagtaaatagattctctccagccctaggtagttctagcaatgctttagcaacctcactgacagggcccgcctggctttccagctggtccacagcattgtccacttgcgctcagttccgtcagttcctggcagcctcggggtgaccaggaacctctttaccaagggctggccactaaggtctccatctctagggcagaagaggaagggccaaacggagcccggaggctggctgcttgctcttcaggtataagggtcctgctggaccgatttgctctgagatggagtgtcgctctgtcacccaggctggggtgcagtggtgcgatctcagctcgctgcagcctctgcctcctgggttcaagcgattctcatggctcagcctcccgagtagctggtaccacaggcacatgccaccatgcctggctaatttttttatttttagtagagatggggtttcaccatgttggccaggctggtctcgaactcctgacctcaagagtagcacacctttgaatgccttttctgtgttctttctgtggatgctccaccttctgctgaacaaaggaaaacactgcctagacccccaccccacccctgcaccacccaaatgcctctctgggaaaagggggtttgtaaggcaactccccaaactcccatgctcttttcaagagtgtctgctgacacccagatgtgggggattctttaaatgtcttaaggaatgtaaagctcttcccaaattcacaaaacgtaataagtgcaatttaccttgaagatgaaatatatgcttgttgggaaggtagagggagtcaggggaagatggacttaaagaacagttgggaggtcactcccttgctgtgggaccttcagcagccgctggctgctgtggtgtcagtagtcccatctgggcactgggcccgtggctctttctatctctccaagctttgtgattttcgtgaaagctgagggccgggggccatctagtatccattttttgtagaaataaatgaactactttctctcttgtctcaacttcctactcctgttcatcacccgctccttccttttcagagctctgcccctctgttgcttcattatctgtagctggggggcgcctacctttcttcttctgcctgggaatccttgtactaaactccctgcatggggactgctgcgaggcttctaatctagaataactcagagctgggcccacctgtggccattcaggttctaagctagaagggagagacaattatatattcttttgattattcaagcaaatatacataataaatgccttctcagtgccagatactggtttagatcctttgggatcacagagatgaatgagacctggtccctgtcgctatggaattctcctaataggagagagatgaggagggcactggagtggtgatctaagcatgaaagccatgcttgcgggtcctaagaaggatccagtggggtcctggctatccaagcatcatccgtgccgtgagcctcctgctcagtacccttcatgtgcctggtgctgggctgggctccaggaagccttctgagaagcatggaaaccaagcctttaggatgagaagggcagacacagtgcagtggggcctggccccattctcagggcaggtcctgtgctccacggggagggacgcacagagcaatccatcaccccctttcctcgggagatcacagtctggtggcagagacagacatgacagatagttcaaagtaacacagtaagcaatgtgacctcaggtgagccagttagcctctctgagactcagtttttgcatcagtaaagtggatggattaagaggcttcttgtgaggattgaactcaggatgtgctttgcaaagtggcatgcaagaggagctctgaactagccgctatcgttctcactgtcatggttttaaagtgctgtccatatgggaagattcatcgggggccttgttcattgaagctgctgctggtgctcggagcacatatgacaactgctccatgtcacttcctggtagacatctgccatattccaggggcccaggcagggaaactgaggcctccttgtctgctctggctctaagacttctcccagatgtgacggtgaggtgcgtgccaccttgtcatctccactggggccactagagacagccctggagatgccagggtgtgtgagtgccttagaaaggaacagaggcaggtcctgcagtcaggcagcccggcctgagtagacagcgagctaattccagttctgtctggttccacagaaactccaccctttcggctctctccagcaggagatggggccggtcaactcaaccaatgccacccaggatagaagctttacctcaccaggacagactctgattggctgagcaaacccaagggcgggactctgcttctggcaacttaaccctttcttgggcatcccctaccacacagtaacctcacctcaactggacctgaaacagaggaccaagatggtgggtctagggtcatctgaagggagtggtcccaagggtgcatgtggatgtcaacagaaggaccacaatggtgtgagaggccttgtgggcatgcagagactggcagcagaaagtcccaagaggagaggactcagaggcttcttccttccaaggaggaggaggaggaggacattccacatctgggcttccagtggtggctcccggacctgccttgggggcagcaggagaggttgggagaggtcaccctgatgaagaacaatgccatgatctgctgctgccagaggacatctccgcccatccactcattttccacctgtacacattggctcattcattcgatggatatttcgggtgcatctactttatgccaggctctatgctaggagctggggatactgtggagaaaaagtcggatatggtctcgctctcatcaagatttcagtctagctgggagtgagcgttaaataagtcaataccaacacacacacgtgcacacacgtgatggcaagctgtgatcatctatgaaagaaaaaacacagatttctttaagagggaattgtacttagagtgctgtgtgtgggggtggggatggggaaggacataacttttaaaccgagacttgtgggctggagaggaaggagccagtcctggacttggggaagagtgttcgcggtggatggaatagcacgtggagagtccctgagatgggaaggagctcagtgggctggaggaatggcgagcaggccagtgtggctggagcttagtgaggtgcaagacacagtgggtgaggtagttgatgtcttgttgatttcattctagatacactggagagccattgaaggcttttgaggaagggagttgcaagtacatttttacaagatccgtttacacataggaggggcccaagtgggtgtgagatcagttagggggctcgttcagttctctaggtgaggactgtcctggtggcttgtcctggatggtggctggggaagtggatgcctgaatgccaggctctggagaagagatgactccctgccccatccccctgcctaccctcctcctcaatggcccctctctcagtggatgtgagtgaggattaggaccttccccacagagccaccttttggccaggcctcgtgggggatagtgggggcagtgctgagttctaggagtgttcctggaagttgggggcagtgagtgctcagcctggcccaggtgggagagttcactgctgcccaggccttagcaggggctgctgtgctgtctttctgtcccatgctgagcattgtgataggaagctgccacacagtgccctggaaactgacttcgcatgctttccatggggcttccgagggccagggactgggctgggggtggcctagcagctctagtggagactgtgctgccgcagggctgaaggaagaccaaccaaggggacagccgtttgagcccagcccactcactgcctgctgcacctccagctggagcccagggttgggcagctctcatactcttatctaactgccagacctagagggagggaagcccaaggctgcaggtctgagggacacggctcatgggcaaaagggtatcaagaggattagagtcacttgcataggaaaagagggtcagagaggctgagggctggctgaggccagagaggttccctgaccttggacattctttgtgttgtgtaagacctcggcatctttagagaaaggttcttgtgcccctgtgagcttgctcagctgctatggccacttgaaccccaaaaatggtggcctagaagagaatacaccccttacttcccacttatcctcctctcaacctaggaaagatcagacatattgactcaacagtctaacaggggatgggctggatctgcccgtgaccagaccaatgccccccacccagcaagggagtaaacgctgcctgaagtgggaccagtgatacacagcatctctgtctgccagggctcagcccgcgggggggatttgtgagaggctgagcagctgggtctgcacagacagcaagctgcactttgatttcatttgattcccttacaaaatgacattaaggggaatgtgaggcacaggagactcgcctgtctgggaaggcagcaagctcatctctcctggacctggtgacctacctctgtctaccagacaggtgcagaggacaggagctctggccacaaagaaatggacagtctgaatgcagcacacagccctggggacaggacttttcacccagcctgtcctgacaagctgctgagtcgagcagatgctcacatcagggtcccaggtccggctgttagggaagtggacatcagttcctggtgggccctgggcagtgactgtggtgagccacagcaccattgctgctctgcctctcaaatcgatcgaacaattaatttggctccacaggctcgagaagatgaaacatgacctgatggccactgctgtccagcatcccagtccatcctagctgtccaggatgatgaacaagctatggaaattgcacttgagagctataatcacgggaagcattgccgagcccctccctgctacataaatcatgctaagaagcacacaatggcctctttcctgatgggctaattgtcttggtttggtgtctcaggcccaggagctgggaagatgggagcacaaccatttattgttggaaagaccatctgtgcaacttgaatacaaagtgattcttttagttccccacacacccccgaccctctgatcccattttcatgttttttttttttttttctttttatgtctcaggctctggttcttttaaaactcttcatctatcctgtaagccatcaggcctggatctctgctggcctgggtcttttggctatttgggggttgggacattgcagaccttttggaaataatgacatttatttatatatgtcttatatttttattctttatttttccccataaattctattaccaaagtcctcatttgtcacacatggcaccaaggcaccaagagggtttttgcaaagtgaaaatgcaggcaattttgcaacgtggaagggctccccacagcgaaagtcccacagtgagagcctaaactttggagatggcaactggggtccccaggcatgatctccccccagcctcccagcagccttgttttatggatgaaagacaccaaggctctgagaagttaagtgttttatcctaggtcacacagctggtaagggccaagcttgccctcaagccaaggcctttgaacctaatctaccactcatttctgataaaaaggtttgtcttttagggatagaagtaagagaaatcaataatctccaggaagaggcaagagagggatatccggcatgtcagaagctgtggcccatcaagctgtagagggaatgcttttaggataaataaaatgagatgccttattttccacccagtggagaataaacttccagaatgcattttcctgagggtggcacaggctgaaaagatcaatagcttcccacaagatttgaaaaaagcctaaaatgagagatcagtttgagctccttaagacaggttctcagggagctctggaatggttaggttacaccccttccccttttgaatttggcatcaaaaggatcagcagacagagtcatggagtgcttggcagtgatggaatattagccaaaggcagagaggtatagcttcaggctcaggctggcttgtgcccagcgtaagtactggaaggaggcctttgacctgagaccagctgagggcacagagagggcctgcccatgtggaacctgccaggttttgtgcgcagattttgctaattgactgatttagtatctcagccctgaataaaggggaatcaaatggatctgatttcagccatctcccctaagagatgcagactcttctccctaaaaactgtttccaggcagccaccagctctcctccccattccttgctgctgtcctatcagtggacagactgccttcttcgctgtcttgctcttggtctcagccatcttgctattgttttttttagcccctgaagaagacagtgcaaccttaccctctatcctgtcttcgccttctcttcctcgaagactttctctgaatagggccatccatcctccaaactgttcccagatccttggttttaaaggtagaatgataacataaggtaacctggtgggcacttacaagatgagccaggcacagggtcaagctttttacctaccctgtctcatctaatcctcatgcagacttacaaggtgtgttacccctgttatacatttactctcattatgcccaatttagatatgaagacgctgagtctcagagaagttaagaaacgtgcccaaggtcacacagctagtgggtagctaggattgaaacttggacagcccagctccagggtacctgcttttgattattttgctatatggctttcctgtaactgcagaccatccaagctggaagggccagggagactggactgtcacactcctgcttaaagaccattgtgggaggccactgtcttcagagtaaagcttggctttccaggctctccttggtagcactacactcctgctttgcacctggagcccggccacaccataaattttccccttctctaaactcactgtgcacattcacagttagggtgtttgatctgcctgacgttgactgccctccttggctgtccctgctggatgcaatcctcaaccttcaaggcttagtggctcctctgagaacacctttctcaggcatgcatcaggagtcctgacttcccccttcgtggttcccagagtactttttcccccttagcacaattcatccttagcatctggatgactgtgagcttcttcggagcaagtagatgttatattttatttgtctttgattctattgttgtccggtccgtagtaggtgctcagtagaggttgtaggattgaattaggctgtccagttcaactctcctatattctagaatttagacaaggaaacaggtgcaaaaagagaagtgacctggccagggtcatgggaaaagttagtgtcagagccaggactagagctcaggtctcctgattctttggattcagagctttttctgttgcacctcagctttgtggagaccagagcatggatctgcacttggtttatgaaggtctgaccaggttcacttcagggtcatggataccactgtgttcccatgctgacactggggaattcccagagggaaaggaagcccagctggagctgctgctgtaggttgcggggctcacctctcaccgagccccttgcttacagagaaaaccagcgagtgattctgaaaatcttgcctcgagtcctcattttgctggtattcaccgtgtgaccttgagcaaattgcttcacatctctgatcttctgttcctttaccaagaaaaatgagggagttgaattcagatggtctccaggagtcatctgattccagaatatcaggatataacaataaagatgaggataaagtagctactcccctcagaaaaggtggagatccagatctagggggagaattggctaggttcttcatcacagtcactgtcttgagacacataggtggtccatggaaacatttccatgagggatttcagaggggagaatgggcagactgcaaagcctcggtactctaataccaggcaaaaagaagaaagggaacaggcattttagttttcacattgaaacagagtgtatgtgtatggccctatgcaaatgttgttcctggtgaatattcatcaatgtactcatcacacataggtatatttagacagaaaggggtcctcatcacagacacccaaattatgagcacattactgcctcctctcccctagaggtgcttcttccagcctcccccattggaggccagcacaagacgggctctccaacccaatatcttccccttccctccttcctttctgctcaggtggctgagtatacacattgaactcttttgtttcaacttcacgtgtatataggttggtgcaaaagtaactgtggtgttttccattaaaagcaatgtcaagaaccgcaattactttggcaccaacctaatatgtatgcaagtacattctttaacctttccaactcccagtccaagccatcaggctaatttccgcgtggaatttgtggtcactggtttgcagtcctttcatttctggtgtggtcagaagtctccttcagactcttcccgataagttgccattggctttttcatcacctttagtacctacccacttttgctgggataacactacccaagataaattcaaaaaaattgtcctaagtgttagtgtgtttctgttttggttgaagtctattattgctatatggttttctactgtttctacttgatggaagactattaagggttaagtaggctggcctaggaagctgaccaccatttataacatacttttgagtgggaaaatgcattcagaggcctgtaatcaatacttaggtggactttgggaatatagtatttattttatgagtgactagaatattggtagaaccatagaaactttgaatgtggagctggaaagcctcctccttcccccactgagatcaattgattaacaagctaggttgtagaaaccaagtgaaagaggcaaaaacttggccaagggcatgtagtcggggacttctgaagattctgctgggctgggggcaggaaaggggtcacagacggtcttagggttgtctcactcagcaactcactgtgttggccttgggaaatgtaagtcactgtgttgggctgtaatggaaatattgagaaagcagctcagctagtggcgtggggagaggttgtctagtcctctggcttatctgtaaattcctggcatgtgcttgttggagcagaatgaatggggctgctgtgttttacctgcagctaggagcatggctggagtggtggagacactccctgtggtctgttctaaaaatagcagtgggaacagagctgaggggaagaggagggggctccttcgggagctgggtggggaggcctcacccccttcctcttcctgccaggcccgatgtgaggaagtcccatggagtcacataattccatctgggagagtcctggagccatcagccctcacaccccctcctcatacaggcgaggaggccctggaggcccggagagcagaaagcactggctggtgtcaagcaagcccagagagaagggcccagttggcaggctgtttttccctggctgtttcagcacagtggctgcaggccttgtgctgaggtttgctgtcactgcctttgggcgcacagagactgggaactcctgggaccggatgtggtcaggcttcctgagagtcgcctggcaggcgaggagtccccagctggcccaccctgagccctgacctcagccagccggctgtccagtgccacacctcctcttgctggtgtcccctcccttgctgacttgtcctcctttctttggactgtctgcagggagggaggacaagggccagcctagatctggcctgcaggacagaggcctcagtggctcaggacctttccctgcccctccccaggaacaagcagaggcagctgaggtagtagcagcctcctgcaggtttagagacagacaggccagggttcaaatcctagctcttcctctcactagccatgggattactgatgggtcacagagcatctgtaaaatgagacaagaacgctgatttcactggggtcttgtgaagatcaaaggggatctgttgtaatgcctggcatgcagtaggtacttaatagtagctcttgttgcaaaaccaagcagtgaacatgtatctgactttctataacccccttccttggggcctccactcatgaggcatgggaaggtgttttttttctttgtttgtttgtttgtttgaatgcagttgactttttttttgttgtattgttgcaaaagtaatccatgtgattgatgtttattatgaagaaaacatttaatacagatgaaccaggagaagaaaatgaagttcatccttaatcccagcacccagagataaaccactgttaacattttggaatgtgtcctgtcaggcattcgtttatacacacatatatcttatttgcaaattggggttactggtgcaatttttctaacctgctttttctcccccatttaacagcgtagtgtatccatgtttccatttcaataaatattcttctacaacatcattttcagtgcctgtggagtatttcattgtgtagatgaaacgtgctttatttaagtaatcttcagttgtttatcattcaggttgcttgcaatttttctttgttacaaaaatttcagataaaaatccttgtacaggaggctgagatgggagatggcttgagcctgagtttgaggttacagtgagctatgattgcaccactgcactccagcagtgagaccctgtctctgaatgaaaaaaaaatcctcttaggtgtatcttggcatgcccagcatccagttcaacacctagtacgcattcgactctaaataaatatttgttgggcgcggtggctcatgcctgtaatcccaccactttgggaggccaaggtgggtggatcgctgaggtcaggagttcgagaccagtctagccaacatggtgaaaccctgtctctaccaaaaaatacaaaattagccaggcatggtggcgcatgcctgtagtcccagctactggggaggctgaggtgggagaatcgcttgaacttgggacgtggaggttgcagtgagctgagattgtgtcaactgcattccagcctgggcaacagagtgaaacttcatctcaaaaaggaactaaataaacaaatatttgttgaatgaatgaatgttttgttagaataaatgcctgttagtagagtttctgggtcaaaggttatatatttataaaatggattattgatcctattgccaaattaccctgcagaatggttgtactgatttctaatctcatctgaattgactagctcatcctactttgcctgggacttttccctttttagcattgaaaatcttgcttgccaggaaactcctcaatcaaatcaagtaaaccgagatagtctggataagaaaatgtttattcctcctcatcattaccaacatggtatattgttacatttttaaataggttctttttttcgttattagagatgttgaatatttatttatatgccttctggtcacttgtgttgcctcttttgggaatagcctgttcaagtcttttgctcatttttctattgggatttttatagtttaattattaattcacaaagagctctttatataataaggatatttgtgtgttagccttttatttttattatttctttaaactacagatgtttctgacttattagtcatatctatcatttgttttagagtagttttattgagatttaattcaaatatcatacaattcacccatttaaagtacacaattcagtaatttttagtgtattcacacacttgtgtaaccatcaccacaatcaattttagaatattttcattatctcaaaaagaaatcatactacttagctatcatccattatttcccccatctcctccaaccctaagcgaccactagttcatacttttcatctctgtagatttgcctatattggacatttcatataaagggaattatataatatttggacttttgtgactggcttctttcatttagtctaatgttttcaggatcatccatgttgtagcatgtatcagcaactaattccttttcatggctgaataatattctgttgtatggaatatcacattttgtttaaccgttcatcagttaatggacatttgggttgtttacaccttttggctattctgtgtaatgctgctatacatatatgtgtgcaagttttttgtatggacatatatttttctcttaggtgtacacctaggagtggaatagctgggccaaatggtaactcatgtttaactttttgagaaactaccagactgttgtccaaagtggatgtactgctgggcgtggtggctcatgtctgtaatcccagaactttgggaggctgaggtgggccgattgcttgagtccagagttcaagaccagcctgggcaacatggtgaaaacctgtctctactaacaacaacaacaacaacaaaaattagctgggtgtggtggcaggcacttgtagtaccagttactcaggaggctgaggcaggagaattgcttgaacctgggaggtggaggttgcacggagctaagatcatgccactgcactccagtctgggcaacagagtgagactctgtctcaaaaaataaaataaataaataaacaaagtggctgtagcattctactttcctaccatcagtatatgagggttccaatttctttaaatcctcactaactctattttttcattttaaaaaattatagccattctagtgggagtgaagtagtatctcattatggtttttattgcattttcttaatgactataaatcttgaaaaatattattgcctttggcgtatgatattcactctaggattatataatattcacttttttcccttttaattttatggtttattttttaactcttaatattttaatcaattgggaatttacttttgcatatagtatgaggcagattacttttcatttttcccaaatagttatttgctccaattcttatgcattatattaggacaagtaccctcttattagttttctttaaaaattatttcccccctcttctcatacatttatttatttatttatttttttgagacggagtctcactctgtcgcccaggctggagtgcagtggagtgatctcggctcattgcaagacccgcctcccgggttcacgccattctcctgcctcagcctccagagtagctgggactacaggtgcccaccaccacgcccggctaattttttgtatttttttagtagagacggggtttcaatgtgttagccaggatggtctccatctcctgacctcgtaatccgtccgactcggcctcccaaagtatttattcttttaaatgaaattcagtgtactttttaattgtagctttataattcagtccttatcttctccctgcccctcccaaaaatatcgttgagacttttattgtaattatatttcaaactatacatttaaaaggggagtattaaaatctatacaatacggtcttctcatttgagaacaggatgtgtctcctcatttatgcaaattttaagatttcccaaagttttagaaagaatttcatataggtcttgcacattttttgttaaatttatttgagggaatttaaagttttaatttatattacaaatgaaaatatttatttggcattatatttggttttttaactggtaatatacatgcacaaaacttgtaccaaaaaattctaaacattactaaactgaataaaataaaacccccattccccaagcccatttccaatcaataattactaatatatgtttgatgtggttcctccaaattttcccccatgcacatatgtagacatatgctatgttttgttttactaaataatatcatattatacatacatttttgtaactcatctataaagatataggccaggaatggtggctcacacctgtaatcacagcactttgggaggctgaggtgggatgatcacttgagtccaggagttgaagacaagcctaggcaatatagtgagaccccatcgctacaaaaaataaaaaaaattatccaggcatggtggcatgtgcctggagtcccagctacttgggaagctgaggtgggaggatcgcttgagcctgagaggccaaggctgcagtgagctgtgatcacaccactgcactccagcctgggcaacagagggaaactctgtttaaaaaaaaaaaaaaaaaaatatatatatatatatatatatatatatatatgtatatataatattatatataaatatattatagaaatatatattatataattatagaaatattttcgtggctgggcgctatggctcccacctgtaatcccagcactttgggaggccgaggtgggcagatcacctgaggtcaggagttcgagaccagcctggccaacatggcgaaagcccatctctactaaaaaatacaaaaattagccaggtgtggtgctgggtgcctgtaatcccagctactggggagcctgaggcaggagaatcacttgaaccctggagacggaggttgcaatgagccgagattgtgccgttgcactccagcctgggcgacaagagagaaactccgtctccaaaaaaaagaaagaaatattttccatcagcacctaaacttctccctctattttgaatagccagtggaccataatgtatttaatttattgatgcatgattagattgtttctaatgttttgatattctgaacaatgttgcaataaacatcttgccgcacttttctgttaggagagagtgtggcacacactaccgaagtgctctaaaaaagctttccttctgtttacacatgtcatctccccaacactattgttcttatcctattttatagttgagaaaccaaaggaacagaggttaagtacatgtacaatttgcattcctactcacagtgaatgagagtgcctgcttccctacaccctgcataaaatggaatgttattgcttttaattctttgttggtacaagaagtgaaaaattatatttaatcttaattgacatttatttcattattagtgaggttgagattcattttgttttatttttggagatggagtcttgctctgtcacaaggctggagtgcggtggcgccatcttggctcactgcaacctccaccttctgagttcaagctattctcctgcctcagcctcctgagtaactgggactacaggcacacgccatcatacccagctacatttttgtatttttagtagagatggggtttcaccatgttggccaggctggtcttgaacttctgacctcaagtgatccactcacctcagcctcccaaagtgctgggattacaggcgtgagccactgcgtccagcctcattttatgttgatcagtcacctatatttctgctttggcttgtcagttcattcatgtcatttgcccagttttttactgaggcgttatctcatttgtaagagctctttatgtggttagactattaaccatttgcttattatatgggttataattatttttctagtttgtcatttgccttctaactttatagtatcttttatcatttagaagttaactttttttataatcaagtttttttggggggttgagagcacctatattttctaaggtctttcctacccctagattatgagaaatattcatctaaattttattcagctacttttattcttttattttttgcatttacattttaaattcatctgcaattaatttaatgcctggtgtcagatggaactcttattaattttttcccccaaatggtttgaccagtttttccaacccgatttttttgaattgtctttcctttcttcacttatcatagaccaaatttccacatatggatggtttggtttctaagctctctcatctccctctttgatctgtctattcctacatcaggttagacttaatgactttagcttcagaatatggtttagtagtaaacatcccaaggccaacccctattattctgcaaaatttcctttggagttatacaccctaattctagtctgctagtggctttacccttacctttgtcacaaacatatttcaacatcaggaatgacaccagatccatagtagcctgtcctcgtggcctctaacccataatgatcatgtcggctggaccatacttctctgctttcctccatacctcctaggtattgttataattgtctggaatttcggtttccggttgtgactattttttttttttaaagacagagtctcgctctgtcgcccaggctggagtgtagtggtgcaatctcggctcctgcaacctccatctcccaggttcaagcgattctcctacctcagccttctgagtagttgggattacaggcgcccgccaccacgcccagctaatttttgtatttttagtagagacagagtttcaccctgttggtcagggtggtctcgaactcctgacctcgtggtctgcctgccttggcctcccaaagtgctgggattacaggcgtgagccaccctggccggttgtgactatttttaaacattagcactattctgttttaagaattatttacttaaaattgcacttaactttcagttatcagtagttaaggctctaaatgtttccgttttcatggcttgcctctgtctctcacataccacgtcatctcattcttgacttctcgattttaattcacttttgtctgtagagctttcttgagtaatttttccagaaagggtctgtgggtggtatcctttcttatccttgtaagcctgaaaacatttgccctcatgtttgagtcatagtttgcttgagtagaaaattctaagtgaatcgtccttctctcccagaagcctgagagcagtgttctgtggtttccccagtatttagtgttttaagagcagtttttccttgattctctaaaatttatttatggaaacaaccaggattcctctttccaatctttggaattcagaaatttccccagatgatttctagttgtttgttttcttttggtaatttttcctggtcctaactaggtaagtcctttcagtctgaagacccaagtcttcctttcgttcagggaaattttctattaatttaggaatggtttctattctgtgtgttcaatctcctctttctggacttcctactacaaataataataataataataatggtgcctaacattaaagcgtgctttctttctgtgataatatataatcttcccagcactattgttattatcctcatttcatagatgagaaaacaaaggaaaagagagattgagcagattatacaaggtcgcataattaggaggtgcaggccaggttctaatcccaagcacctggctccagagcccgtgtccttagctgctaaactatactccctgcctgtcgggtcccaaccccagagcccaccctgcccttccccccagcactctgtagtgacaatgttgagtgtcgacaggcagggactctgtaatcagtgggggaaagcttggggatgctaggatgatggatctgaaacagactgggctactgaggccagagaggggcagggattgtcagaggttctccagtgaatttagagttgggactcttccctccctcctcttcccttggtctcagccacctgcttcaggcctcctctttgtccctgggactgctgcattgcttcttgtgggtctccctcttcctactcctgtccatgtagtcacctctgtcaacagcagctgcgatgactcttcttatagaacacacgcagtcaccttcacactgctgagtgtttgttgaatgactgtatgagtgagcaaagaagtttacagtgcctaatgtgtgtcaaacactgtgctaagtactgttgatgcagtatgcattagtcagcaatctaccaattgcaagtgacaaatacccagcttccaggagtaaatggaatttactgggttagggagggtagccttcaggcctagttggattcagagccttgagcaatgtcactgagaaggcctcagcctcttcatttcttggttctatttacttaggtgttggctcactcccttagtggtagcagtgctgctgccagaagggccagggttatggccatggccttggagttggactccctcaatcatttcatcaatagtccctgggcctgatcctcattggcccaagtaggatcacgtgcccattccagccactgaggacagtgggatgggttaaactaatggactgaggcctgggccatatgcctctccctggagtgggagatgggttggttccttgtgaatcacctggcttgagaatgagagagggaaggctagttcctcaagtgaatggggtctggtcaggcagatctcagatgtcgtctacttctcggctcatcaaccagcatggtcctcaccccacagagctgacagtctaatgtggggtccagtgtggggcaaggacaccaatcatgaacagcatatgaaaaatcgatgacagttgtgccaaagggcctaatgagagcgcctactgggaggacctggggaaagtttctgaggcaggggaggcttgggatgtaaggattgttctaggtggggaccctaacgcaggccagcataggtgggaagacgaggaaggggaacagagcatgagatgaggctgaggtgtgttcaggatcagacagtgctggtcttgagaagctgtgggaagaagtgtgactttatcctgagtgcaggggttgatgggtgttgtagaaagctgatgctggcctcatagagaatggtgaggaggaaggcaagtcgagaggcagggagcagtgtggagctattggcctcggccagggagagccgatggttgcttggactagggctgaggcaccagggattgagagaggtgagagatccacaggatgtatagcaggaggggtctgcaaaattctgtgattaattgcacggggagtgtttgggagaagaatggtgctcaaaagtctagctcaggccaggcacagtggctcacgcctgtaatcccagcactttgggaggcctaggcggtggatcacttgaggtcaggagttcgagaccagcctggccaacatggtgaagccttgtctctactaaaaatacaaaaaattagccggacgtggtggtgggcgcctgtaatcccagctacttgggaggttgaggcaggagaattgcttgaacctgggaggcggaggttgcaatgagctgagattgtgccattgcactccagcctgggcaacaagagtgaaactccttcctaaagaaaaaaaaaagtctaggtcagggaaacagatggtgccattctctgagctgggagcagtggaggggagtggtttgggtggcaggatcgagtcccactgtatgtgtaagtatcatgatagggtccaagttagtgagttctcatgaaacaaagccatttaaatcagggctccttaagctacctgtggtgaggggctttgacattttgtagcatcacactgcatgtgatttattatgcaggcttgagaacacctgagctagcccatgccctattcagtgagaccagtccactcatctcatgcttagaggtggcaatgtcaagttgaagttctttaaacacaatcaatcttgctacctatctcactgcagactggtaacaagcagcctgtgaacccatatgattttgcagaccacattttgagtggactgatctagttcaaccccagtgcattttagagacagggaaactgaggcttggaggtggtgggggggattggccttgccccagggttcgcagaaggcagcagcaaagttagcatttcagtctttcccccactgaccctttgttttgatggcttgggctcaagcccaacagtccaaacagtgggtggacccaggggagtgtgtggagaactgtttccagcaaccaaggtcacaggcctggcctccccgtagctgagtcagtggctctgtgctgaacacttcccaggaacatgggctgacaggacacagcctggccctggagctggcacaagcacagtgggtcgaggattgctcccaaaagcccgaagtctccggccagcatgtggctggttggaccggagccaggaagggagacagtcatggctcccagccatcctgagctgctacagctgcccaaggtcagactgatactgctgaggtgactgcaaggcgtgccccaggatggaggcagaagccagccagcagcaggcctctgggctagctctgtagggggacatttggtctcctggcttttgctgcgtgtgggcttctccttgctgggttgggagccaccgtttccattagcaggttgggaatcatccattgcggtctcaagttgctgagaaagaggcagatagcaagggggagacatttggggaataagagattaagggcagaatatacagttaagagcatgggcctgggagccatgctgcctgctgggcttccgccttgtaacctttctgtacctcagtttcctgatctgtaagctgggcatgatgagaatagcctattcatcaacaaatggtaatgattctcagctattagtacacgccaggccctcatctgttagcccctcaacaggtgttatcacatttaattttaccatttacattaaccttctcaaggtgaattctgtcttttcacagatgatagcaacaatgacatcatagcaataacaatgatggctcttatttattgagcacttactgtgtaccaggcattccacatacaccacgtcgtctagtcctcctcagggtccgttgaggcccattttacagatgaggaaactgagactcagagatagtaaagggacttgcccaggataatttacactcagattttttagacttcaaagactgtgctctctctaaattccactgactgagctgattcctttagtgagagggcctgaaggggcatgggactgtccatgggaggggaggagtagggctggggccactggacaaccacttcctggtctcattttagagatggaggactgagatcaggaaggggaacgggcttaccctgggttctgcaggccacaaaccacagctccctgtgaacttgaacctgaggatacctgctctgtcttaccccaccccaccatttgtgtcaggtgccccagaacaaggcccgtgccaccaggaagagcaagacctacaccaagcaagcaataggagaatgtgtcccctgcccaggtgctagggtcctagaggccaaaacacagcatggcagcccccgtttgcagcatcagcggcttcatctgccatgaccccctccaagttccatcccatgggcgggctgctccggccagctctgtatccttagttcctagtaccggctccggcacagagcagggattcagtggttattgaaataactaattaacatttcttggccgactctgcagtggggagggcctttttgcatagagtctctagactcccaaaccagggctgtgagccccaggaagtaaaagctcagagctttctaagtgagttagcagattcaaagcttggactggggtggccatatacagacacttccatagagtttcaaagagcagcctggggtggtcactttcttctgcagtgagttgggacagtggcagggctctgcagaagttgaagccggtgtgtacccagcacagtcttggggtatctggggatgatgaaagctaagcagcttctggcaggggcaaggggctagtcttactctgaagtgctctggaattcctgggaccacatctttccctgacttctctctctctctttctctttttttctttttgaaatggagtcttgctctgttgcccaggctggagtgcagtgatgtgatctcggctcactgcaatcttcacctcccagattcaagcaattcttgtgcctcagcctcccaagtagctgggattagaggcacatgccaccatgcccagctacttttttgtatttttagtagagacgaggtttcaccatgttggccaggctggtctcaaactcctgacctcaagttatccccctgcctccacctcccaaagtgctgggattacaggtgtgagccactgtgcctggcctcttctcttcccttctcttcttttctttttctttctttcctttccttttcttttctttcttctccccctctttctgtctctctctctctctctgtctctctctttcacggggtcttgctctgtcacccagctgggagtgcagtggcacaattatcacggctcattgcagcctcaacctcctgggctcaagcgatcctcccacttcagcctcttgagtagctgggatcacaggcacacagcaccatgcccagctaatttttaattttttttttttttttgtagagatggagtcttcctatgttgcccaggctggtcttgacctcctgggctcaaatgatcctcccacctcagcctcccaaagtgctgaattacatgctcgtgatggggtcttgggagcataaacccatgaggtgcattggtcttcacgcaatggaagcagtaaaggaagacagcggaaatctcactgtggtgtgggctgtaggggagcagcctgtctctggcacctggctgcatcccaggctgttgctgcatcccccctggggcctgtctaaagacttgggctctgcttgggggtactgtattccaaaaataggaggtgggtccctgctgaacctcgctggtcctagccctgggagctgctgccaacctgtctgaacagtgtggagtttgcctgtgtggttgggctgtacagttctctgtgtaactgatgggctcatctgttccatgggctgccctgcgccatggtgcaggacacagtggaaagtgaagtgggcttcatctgtagccctgaacttactagagtgtgaccttagtctctctatgcctctgcttacacatccataaaatggggatattagaaatcatatctgaggctgggcacgtggctcttgcccgtaatcccagcactttgggaggctgagacgggcagattgcttgaggccaggagttcaagatcagcctggccaacatggtgaaaccccacctctactaaaaatgcaaaaaatcagctgggtgtggtggcgcacgcctgtagtcccagctactagggaggctgtggcatgagaattgcctgaatccaggaggcagaggttgcagtgagccaagatcgtgccactgcactccagcctgggtgacagagcaagactctgtctcaaaaaaaaaaaaaaaaaaagaaatcatatctgatagggctatgaggattcaatcaatcagtccatcaatcagtaatcagaaagtgcttagagcagtgctgtcatgtgtcagataagtgtttgttatgtatgaaatatgtggatcagtgattggggcccagttcctgagtacccgggtgctgacccctgggcctgtgggccacctagatcttaccactctctagatcccagtttctcctgtactgaacagcaccatcatttatgtacctctgagaagcactgggatgtggtgaacagagcactggactgggagttagcaatcccagccctgccactcagttgctgtgtttccttgggaaagttactttccctctctgggcctcagtttcactgactgtaaatgggaaacaacagtgaaagatctccaagggccctctggcttagaaagcctggctgccagtgactcccctatcctgccctaggctatacactgggaggccccccagccctgttgatttgtgtctggagctatgggaggcagagggcagtggctgccccagggctcctccagccatgggatgctctcctatcctggcctggcaggctctgggccttggggcactgagctgctctaccctttcctcaccatgctatggtccagagcattgatgaatgtattctggactcgttctggactcagcacactgggttggcagagctgctttgcccatcacagcatagggcgtaattttggagtcattagtctcactccatggctaatgtctgcctccctcactggactgtcagctttgtgaatgcagggccctgcctattggttctctgccaatccccagggcctaacacagagcctggcacagagtctatgctctgtaactgtttgttgattgaaagaaggtgacaactcagctgaagctcgagggcacctctgacgtgaaggaatcctatattcaggctccccaccctaagaaatcttatcccacacaccagaaattccatcctagaaaccagccagcctcattggtgattgtttagctccatcagaattggccatctcttgagactcacctccttagcttcccaggccaagggtgaatcctgcttttcaggagccagcaggatgacagccttccagtctagaaggttcctaggccctgcaaggactgccttggttctgcccccagggacaagatgaaacactggttggagtttgtaagtgaccaactcagaggagggctattctgagtcgacccgataaagaatgttttcttgtagcagtgtgcatgtatatgcttgtgtatgtgagagagtcaggaatacagagtcagagatagacaggggcagggatacaggcagaaacatcccgagaccctggggggtctctaccatagggagagaaagagacagagacaccgtgcttcagcctaggtggccaaggtgggtggggtgggcatgggaaaatagaggctccttctgtccattttttctgtgccatcatcccaggatgcctgctgctctggtgggagccagccacaagttgggcattcccaacttgggcctcagggacagcccagggtgcatttgtcaacatcatgacaaactgcagcaccagagaacagctctgtgctggcacagcagcatcttgcagttgtctggctgtatggtggttaagagcgggcatggtgagtaggagcaactagttttcagtcctggctatacagacaactggctatgtgactgtgggcaacttcctttgccattctgtactttggactcttcatctgtaactggggtaatcatagtcctcccctcctcacaagctgctggtgaggattcagtgaattaatgcaggcagagctctgggaacagggcctggcacggagttcatgctcaagaaagggtagccaagagccagctcagagaatcctctattcatcccacaggtgggcaggttaaggttagcagcctccttttacagatgaagaaaccgaggctcagagaggggaaggaacttgctcagtgacacccaattaaccagtgctggagctggaactggagctggggaccctctcctcccagtccagggcttgttccactgcccccgcagttcctccttggggatgtctctgtcattcagggctgtaactctcattatagccaatattactgtaacaggatgttacagtccaaactgccctcccagctggctgtctccgggggaggaagccccaggttctctttccacataggattctgcagagtttagcattcaaagattcagctgtgtgctgggaagggactgaagctgccaccccccaccctgggggcagtcgcattctggaagtcagcgtgtgctggctgcaggagcctgggttcagttgcagcctcccactgggacaggaacagcgtcggggtgggggtgtgacagggaagcctcggtgcctcggtgattggcttggtcttgcagggagcggctgccagcaggccggctggaggcggctttgcgctgccccagcctgggagccctcaggatgtgtgtggggtggagcctgctagggatcccagtgccagggggtgccgttgtgagggatggacgcctctcccccggagcagcactttggggccagcttgggccctggggatgagccacaggggacccacagcctatgcgtgtgagcatgtaacccgggagccagctgggcccctcgcggggtgggcagaaggacgggctggcccaggaccctcttctttgagacatcccggactccatctcggatgaaagtgctttgagaaaccacagagttttctgtttaatggaagaaagaaatccagcctctctccagagtggcggtggccggctagacagggtgtgtgtttgggaaaggcgctggaggaggaggaagaggaggaggacaagtaggaggaggaggaagaggaggagggacgggtgatgcaagggttttgaaagcgctacctagatgtgggaggtggaacctggtcatttggttctgcttttcctagcaggtatcgctcccctggggaacttgggtaagtccataaatagctctgctgacacaaaggagctctgtctggggaaggcagccgcttgacacggccgccaggagctgccacagccacggccgcccgcctgcgggaggagccgggtggaaacctgggcgggcgagctggcaggagcggcagccaggagtcgcctgggtccctgctggagtatgctgggtaggtaccttggtgacaggactgtgtgtgtggtgggcgggcatccaagccaccctgtgcccctgtttctattgtttcttccccagggcagccattgataggcatgttgcaaccaaaccatttgtgctctgttctgagatagctctgtgtgtgtgtgtgtgtgtgtgtgtgtgtgtgtgtgtgtgtctgtctgtctgtctgtctcaggggctgggagccctgcaagttttgggggatgcttcctctgttggctgctccccacttctaggctggacagccagcttttctttctcagagaaacaagaaatgtttggtggccaaaaagtcgggacactgcatgggaggggagcgctcagccagcagggttggctattgtatcaggggtgctggccgcacaccaggcaccagggatggaagctcgtgtctagtttcactggcaggggaagaggtggtctctggaactagtctcagcgggttgcctttggtccctgagacggcctctgctgaaacgtccactggaagcacaagcaaagatgctttgcctctgacctccaaccccatgggagagggcctgcacctgctcccttggctccagctgagacccatcaggcagggggtggtggtagagacaggctcacaccacagagctggccactgtgagcagacagaggctaattcttttcccagcctggagggtccacatctctattcttgttcccaggtgtccaggaagaacccttgaaccctaggactcagggcaggaggataaatctggacccagaaaggggaggagccttgtccaagtttgagcagcaggtctgtggctgagcagggaccaggatagagaacttctgcctcctagaacagcaagaacaggacatgtgggaaaccatttccctgacctgaactaagtattataattcagcttcaaatctgaccttcctgacctgagaggcttggtacaccaggccccacagcgatgcttgaaaactttccacatcctgctgccctcaggccttctggctgggtggctatctggcgtcctctcccagtgctagagtgggtacatctcctcaagggaaggagccgcagaggctgccctgctggtgcctgtgggatcccagccagggcactgcaggcatagtcaaagtttccaccaaggccccttgagtcctctgtgcccagccaaggggcacctcccctcttccccagccctagcacatggtgtggcttagcctagggcaggcccttcagggagccgagttccacaacagggctcactgcaagcccagactggcttctgagaagcaggcagattgtgaggatgaggcagttgaggcaagtgaccactcctcgtgagaagtctccagggctttgagccagaaattgttgatgggacttctgattataagtatgtggtatcagtgaaatcattgcacttccaggcttccttgcctttgcaaatgctgttccagctgcctggaaacccctcccctcccctcccctcccctccccctccatgtcttattttatccaaacttccacaactagagcaaatactccagccagaatgagtctgtccattggtggtggcacccatggatattgctttgtgtcctatgtatgcagaatctgggccttattcattccttagtcgcaaggacctggccaggggcctggggcatggttggagaggggcgttgcattgtcctggctagggcaggttttctttgaggacaaacagtgacatgcaagtcagctgtgtccgcccatctcctagctctgtgcctggcatagagggcctgtcggggagcccctttaggagaggcctaggctctgaatgtcaaagttgcatccatagggccaagggatggggctgggtttgataggaggtgaggcggggagaattttggcttcatcctggcggagaccatagggagaatccactcaggggtcatgctgggctaggtggaattcacagcatagcctgggccatggagggtggaggggatagccctggcttgttgaaatgcaatgctgaaggacctttgcacagactacaggggattggagctcagctccctggaccctcttgggatggtgccaaccagagtaggtctggggttattgatcctcaagccagtggtctgtgtggctccctcagaagaggcacagctgaagagagagtgcctatccccagctgggtccctgggggccttgagagctgcttcccattggcctcttaaggccctggagatggcagtctctttgccttctattaggttggtgtaaaagcaactgcggtttttgccattaagagtaatgtaaaaccgcaattacttttgcaccaaactatagatagatagatagagaactgaggcaggagaggaaggacacttgcctgaggtgacatgcgactcagcaggaaatcagggacaagaactcaggttcccctgcccaggcctctctgtactgcaccaactggatgtctcagagtatccaggtttcatcttggggctctctttctggactcaccagtgacatgtcccttttggaccttcgggctcactgactagagccctgctatcctctgggaaaagcagcatgtgcaatagacaaagccccttggtcggtgggctggagactgcggcaccttctcgtcccttcttactgatgatttcaggcaaatatgccttgtttctcacctcagtttctcctttgtagcaactagggactggaccaagtactgccaggtgccttccaaatatccagttctctgattctttgcaggccgtctcctcttcctggcttccaaaagtcaatggtcagggccagggcttggtgcagcagagaagcagcccccagcctgttccccaggcgcctctgggcaggagccttcgcatgcaagctgcagcccaagccgaagctgggaggtttgttgttgtttgtggagccaggcagtttccaagatgtcattgcttagggaaaaccatcattcctcccaggaataaacaaggctgcttatggctcagccccctaagcctggagaagctggagccactcacagcagaccagccaggctcagcctcagggagtgctgcctgcccctgcacaaccagctgtaccctggcttccaggattggagtggggatgggggcaggatggtgggaggtgtgctagagccataagcctcttgggagatcagagcttccgggcacagatgagagggaagagggtcccaggacatgctcttccttctggcagtgggcctaagtcatcactcgagatgtgtggatagctgccaggtatgctccagatggcccagggcttctcccctctccctgccctccatgggccagcccgcttgcacctggtaccgtggctcaggctgctgccggagaactgtcagcggctcccaacttagaaaggggggtgtgtatttggaactgggcatgcttttcgccacatagccagggctctctgtggtgtcctcagttacctcttactggggttagccttgggcaaatagcagagctcggggactcagggaagggtggcagagggtaagggaacaaggagagaggcagagaaaggtcttggcagtgcctctggggaccacatggctggcaggaaccttgacagcaggccgaaggcagccaggagaaggactgtggaatgggaggtggcatggctatgccacccctcaagtcaagggttggaagcaatgttcagccaggccatgaaatcttcacttctcagacctcacttcctgcagttcccagttgattcaaatagcagcagctctgtactgtcctctctgcctgtctcccttccgtgtctttccttctttccttccttccttccttccttccttccttccttccttccttccttccttccttccttccttccctccttccttccatgtgtgttaagcacctactgtgtgccatgtacttacaaattactagtggcatagatctaaaaggcccaatctttaatctagtgccaggatgttcaggtaatggacagtaacaacacagctttaatggagaggcatggggtggggaggggggtgctgtgggactccccagggaagcactcagttcagcctgggagcctcagcaaagcttcctacaagaggtgaagctgcatgtgattgtacagatgcttgcccattgaagagcaggtctccatcccagtctatccacccctcagaggtgtagacatgtttcccgcctatccatggaaattgcttttgtgtgtccagccacatgctcctccttgtctagggaggttgtataggaatatgggctctggacttgagggaaggatctctcctaccttacagtcttgtgctcttggacaagaatggagcttctcctgccttcatgtcctcaagcagtggtctagcctcctcgagttaaatgagataatagctgtaaagcacttagacatgtttcatgtgaatggattctgtgtcctgatagcagtgggagtgccactagcgcccatctcataggtggctgttattaaatgcagcgatgtaggtgaggtgcttggcgtggatctgacactgagcaggcattcaggaggcagcgcggcagcgttttgctggagggaaacagttggaatgcgcaatcagagatgtgtacaaagcaaggagctcaccgagaagcagtgagcctcagcccagggagcagaagaggagacactgggatgaggggttttatttgtttttaaaataaaccttttaaattgaagtgcagcatacttccagaaaaattagaagaatacagccaatgaattttccacaaagcgtacccccatccaggtcaagaaatagaacattctggtaccctaggaatccccacaaataaccctcttttagttactatgacctcaaaggtaaccccgtcctgacttctttttttttttgaggcagagtctcgctctgttgcccaggctggggtgcagtgcactgcaacctccatctcccaggttcaagtgattctcctgcctcagcctcctgagtagctgggattaccggcgcgtgccaccatgcccggctaatttttgtatttttagtagagacaggtttcactatgttggcctggctggtctcgaactcctgacctcaggtgatccgccctcctcagcctcccaaagtgctgggattacaggcatgagtcactgcacccggcccttgtcctgacttctctcatcgatgagcgtagcctatccttgaattttgtgtaaatggaatcattgggtacatattatttcatgctgacttcttttgatcagcattttgatggcaagattcatcaataatattgtatcaagctttattttgtttattcttgttgctctgtggtatttccttgtatgaatataccgccacagtttatctaatctactgctgatgaacatttgtgttgtttacagtttgaggctataatgaatggtgctgctatgaatattcttgtacttatcttttgatatactatgtttgcttctgttaggtgaatacctaagttttgcaattgctgagtcatagagttgtagagagttagctttagtaaataccatgatattattttccaaagtgtgacaggaatatactccctttaagctgtacatgaaagagcctattattccatgtctgtaccaacattattggtattagatattgtgatatctaattgtggctttaatttgaatttccttgatgtctggtgaggtcgagtccctttttcatgtgttgattagccatttggatgacctcttttgaaaagtgcctgttcaagtctttcccccattttcctattggatttttttttctgattaacttgtaggagcttaaacgatattgtagatatgtgtttattgttggatgtgcacattccaaatatctcttcccactctgggatttgccttttcactctcttaagggtatatttgaagaacacaagttcttaattttaatgcagtccaatttgttaatcttttttcttttatggagagtgtttgttgagtcctgtttctctgcttattacaaggttatggacatatacttttatgtattcttttagatgttttatgtttcatatttagatctaaaatccacttgaaatagatttttatccatgtatgaagtagaggtcaagactcattttctctggataaatattcaatgtattcaaaatccatcctgtctcactatagggcaatgtcacctttgtcagaaattgaggggcaatacgtgggtgggtcacttgaattttgaagaatgagtagagcttcagcaggtggacaggggaggggaaggtgctctaggcaggacgtacagtgtgagcataggtttagaggggcctgagggtagagtgtagcagactggctggagggaaaagaggagaaacggtgtggtggagaggttggcgggggcagaacacacagggttagaggatgggactttatcctagagggatgaaggcattttgagcaggagaccaatataggcaagttggtgcagggccaagggagataagagaaagtctcatgacagagggaggcaggagggtgggtttggagaagactgtaaattcagccaaacctagccctgacatcacccccaagcagagatagggtgtgcctgcctcaggaggcagcggtgaggctgagtgtgcctgaggctcgggagggtgaccttcggccacagggttgtggcttagtctcatgtccacatgtccactccagtgtcctcgagtgaaaaagcctcttttttttactggatgggcaccccaccaccacccagtgcccccagcgctgcaggccctgaaggaggagggcagtggggcagactggggcagacagataaggcaagggtgtgtatctggaaagggggacctttctgttcctcctgcccttgatgcccccacaaggagacctggctatgccttgggccctgaactctgatctttctaggctagctgagattcagaactggacagacatgctgggaagagcaagacccagtgaggggagtgatttggcccaggccatgcagtgagccagactgacccagcctaggggcaggctgagcacagactcatctgccttctcagcttccaagtttccccccctgaaacctgcaactaacaggactcctgtcctaggctgctgtaagggtcagaatacgtcaagtgccctgtcccggaattggatgcaggagagggagctgatgatgtcgatgatcgtcatgagagtaacaattatgattacagaaattgcagatgcttattgagcacttactaggtgccaggccctatgctaagccctccccacagagctgtgatgtgggtactcagtattcacattgccattttacagatgaggaaatcgagcctgaataggttaagcagcctgtgcaggtaccttgacgtaggaggtggcagagccagggtttgaagcttgatttgcctatctccaagccccagttgttcatcagcaataggcttccctccttccacctctggctttcagtcctccctattctcagagctgttgcttggagtaaaaccttagtttttgggttggtccctggtgcccactcatgagagagtcaagctgtggagaggaaggcaaggagcagaggggcaccaccatgggctactgtgtgccaggcactgcctccatatgccccgtagcagccgtgaggaagcggcacactggctgtgagggaggcggcacatggataggaattgggattcacccccaggccctcctgcttccaaaggctgacctcatgactgcagtgctatttgtgtccttccctgaggtcatcctggcatggcagagcttctttgattaacctagcagaaaacatcacagagaagccacacgcttctagctctccccacctggaaggggaccctgggagggagaggatttgggagggtcactgggtgtacagaattctgcactgcccctcccaacaccaggtgtcagtctcctgcccctcagtctccaaccatgtggagtccgagcggggcccctgcgtctggtattgctctccactgcctagcacagagccaggcccaggtttgtcctcaggaagcatcctttgaaggaagggaaggaggaagtgaagacggcaggaaaggagatcacagaggagtagaaagagcagggctttggagtcaggcagaccatggtttcaattctgactcttccactgacttgctttttgatcttgtgtaagttacttaatgtctctaactcctagttttcttattaaaaatgatactgatctcataggattgttggaagtagagcctaaagtataaaacaactgtcacagtgtgtggcatgcagtagatgctcagttaatgatctctctctctcccctatctttgtcatcattatctgttttgaacacctctagcttcaccttccttacctctgcagcgctaagtaaacattgctttcagggtaacgttggaattccttaaaatatccatgctcctgcctcatccaaccacctccacttccttgaatgttccctgctggctctggctcagcctggaatatcctgtcccatcttttcccccctattacctcctcccagagccatcctagttgtccctgctgcctctacttccacagcctcctagcatggtagcaggtgggtgagagatggacctggcatctccaaggcagagaacatggcttgttgctgtttggcagcaatagccaacacaggccctggcgcatggctgcagctctgtaggtatttgctgagtaagtcttgggggaaatggtgtgaataagccagacatgatcctgatgagccaaacaggacctgcccggggccatgacagcagggcaggctgggtcttggcaggggagcagagagccttctagccagggcatccgaggcagattgaaccagtgctcacagggatgggcaggaagtagacttgagggatagagagcttagggaaatgagaggtcccagtacacacacacggagcaggcagaaaagcagggtgccgggtgggaaggggagtgaggatggatcccacaggcagactggttcctcagcagagccccagggggcctggagttccccttctcacaaggcatcagtcaccactagctcaggaagaagctaggaacccccctgctctcaactctcaactccctgcttttcagagaagagagctggaggagtagaaggggtgtttggggtggtgggtggggacaaagactacgagtccacccatgttgaagcagtggtgtcagaaatggaggcgagaggagaagggacctggtgagggggtgacagggcagcaccgtgctgaaacccagaccccgggagccgcctccccgccctgggagaagctgggcatccaggcaggtggtggtgggtctccagcaggctgcaagcggcatgtccttctggcttggtcaggcgatagccaagagtaggaaggttttctgagggggccctcgtgtctcctctttcctcagggattccctttctgtgagtgttggctttgtcctgagagtccctgcgcgggggtgagctaaccttctgtgcctcagtattgctttctgtagagtgggtgcactccctgctgtggtgtgccgccctcctgagcctctgacagaggagcttcagtctgtggtcgaattcttcctttgcccctctctcctcctgcagtggggcctctgtttagggaacgtgaatgggcagctgcctccagggaacttgccacctcccccgtcctgctccaaggtcatgcctcttctgcacaggctccccactatagagagggttctatgtgttggaactggtcctgggcgaggttctgggctggattttagtgctgattctgttgtatgaccttggccttatcacttcccttctctgggcctcacgtaacagacagtcaccttgcctgttacctgacgccactctccagaattgtctcgtcagtcagaaagaagtaaaaaggcctgggccttactcctagggactgtgatgcagtaggtcttagattgggtccagacaggcatttttaagatactcctcaggtgattctaaagtgtacttctccgttaagaaccaatagtctaggtcggtgtttttcaaactttaatgtgcaaatgaatctcctgggatcctattaaagtgcaggttccgatccagtgggtgtgaattgaggtttacgaatgtgtattttatgaggtcaggagatcgagaccatcctggctaacatggtgaaaccccgtctctactaaaaatacaaaaaattagccgggcgtggtggcaggtgcctgtagtcccagctacttggggggctgaggcaggagaatggcgtgaacccgggaggcggagcttgcaatgagctgagatcacgccactgcactccagcctgggcgacagagcgagactccatctcaaaaaaaacaaaaacaaaaacaaaaaaatgagtgtgtattttatataagctcctgggtgatgctgctgctggctcttgggctgcactttgaggctaagagtctagatggtcctgtgaagttcactggattgttctttctttttttttttttgagacagagtcttgctctgtcaccaggctggagtgcagtgacgtgatcttggctcactgcaacctccgcctctggggttcaagccattctcctgcctcagcctcccgagtagctaggattacaggcgcccaccaccacgtccagctaatttttgtatttttggtagagacggggtttcaccatgttggccagtatggtctcgatctcctgaccttgtgatctgcccttcttggcctcccaaagtgctgggattacaggcgtgagccaccgcacccagcgattgttctttcattcatttattcattcaaacacttcaggtggggagtggtcagacgtgaggctacagggagacagagcccagggtcttccagggctacagaatttggactttatctgagaggtattggggagccagccacagcaacgttttaagcagaggagtgacaagttgaggtttgcatggaggcagctcccctgacatagcacagagaatggccagtggggtctgcaccgccactgtgagccccacatcatcctggtgggggatgacagtggtctagagggaagtggcagcagtggacatggagagagtagaaacattctttttaaaaaagattaatcaactttttaattttttgattttttacttttgagacagagtctcactctattgcccaggctggagtgcagtggtgcaatctcggctcactgcaacctccgcttcctggattcaagcaattctcctgcctcagactcccaagtagctgggattacaggtgcgcgccatgttgcctggctaattctcgtatttttagtagagacagggttttaccatattggccaggctggtctcgaactcctgacctgaggtgatccacccgtcttgacctcccaaagtgctgggattacaggcttgagccaccgtgcctggcctcaacttttattttttagaaattagctttagaaattagtgcaaagtacagagagttccaatatactttgtcctacttattgccaacctccctagtaaaaagatccttgaagttgtataagtgatgatcaggatttgaggattgaccatgggggtggtcacgaaggaaaaggagaaaatgatggccaattccctggtttgggcaactggtggtggcttcattgatacagggaccattagaggaggaatgatggacttgcggggagatcacacattcagtgtagggcttgtagagttgggggtactgatgggatatgcagaaggaggtctccatccatgtccctgggatgcagccacacagctgtcctctgtgtcagcagcatgctaaggctcttcctggcccggggctttggcctatgctgcttcctcccctagtgagccccgccctgccccttgagcagatttcggtctccagccattccacagggcggccttcccaacactcccctggactctctcacagcacccgagggttttccttcacactgcagatcttggtttctgtttatcctgtgtttatggcagtgatgacttggtcaatatccctccttcctctctagttcgtaggctccacaaggacaaggatcatgtctttcttattccttcctttatgcacagagcctagaacagtgtctggatgcagaactattccatgaggatttgttgaatacttgcctgtggcatctcaactcaggaaagcggtcagggctggcagagtggactgcgagtcatcagtggccagatggtgcagatagcgattgtggcctggggagtgggtgggttcccaagggagtggacaggactgtgatgagaggggccctgcagcaggtcctgatggacaggcagacaggcccatgagagggtggagaaggggtgaaattcagggagggagatgttaaggccacgctgtgctggagtgaccatggctatcgtttattgagtgctcatgggtgccctcatggtgctgagctctggatactcattagctcatttattcctctaacaacattgtgaggagattctagaaatcctatgttatggctaaggaaactgaggcacagaaaggttaagccaaaggtcacccagcaagtaagtgtgaagttagtatctggagctccccctaatgtaagtaccgcctccatcctcctgaattttgccaaacctgctgtgttggagacagtggaggtagaggggagaggagtatggcctggagggtctctgagctggtggcggaggaaggactgggggtgtcagcctctgggtggtcaagaggccagacctggaggagctgggctgacgctgagccaggagagctaagtgttagctgagccatcaaggttcctggaagctagcattgagtcagggacctgaggctagggatccagagcatgccaagcttgaaggaacagcccatcttgaaagcctgggggtccaaggcagggcaggaattctaacagcctctccctttctcaaaggactttacagttcacagagtgccttcctgccctttctcacttggtccccttaggtctctggcacaggaagcagcaggcatcctcacccactttcatggcagagaaaaccaagcttggagtggggtagcttgggatcacacagctagcaaatgatggagtgaagattccagtccaggtcttctggctgcatgtccagtgctctgtcagtaaaatcctggctgttaagggccaccctgagacagaggcaaaccccagtttacacccccccagtgcaggaagtggttttcgagggcagatgcagagcccggcatccgtggtggctgtgatgaatcatcggagtgagagctgcaggttgtccctgggtcagcaaacctggctgctcagtgagtagctgtgtgatgttggacaagtcactttcagcagcccaccactaccctcaacccaacatccggtgggcatctggggcccaggagccaaagctggtatgagtgtgaactctgggtgtcatagctgccatccctccttagcctattctgagctctggattggatttgggagaggatttgattaggtcctaaacagtgactccatttagagggcctggttcatttcctgtgtgcttacagcagatgagacatgggcagaattaacctggtccagccaagccaaagaagtgatggatgggaaagacacagacccccaccttgggagggtggggcagtggcttccagcactctagacccaaggccctgggtgagcaagctggtcttcctggggcgccctggctggattcttgttacttcagctgttgcaacagctgtctcactgggtccccagctgcctgtacttcctctatcagagcagtccccatgctccttcaaactagttgtctaacctctgttttttctacttaactgagggcagagattgtgtctgacttgttccctgccgtcctcctagtacctacctcagtgcttggagaatgcatgaatgtatgcgtgccccagtcctccctgccatccacacatcctgcccacattccccagagcagctttgacacagcacagctctgcctgtggcatttcgttgctcacagggcaaatcccatgcccaccatgtgttctgcaacctccccctcatctttgcctcccctcctgccctaattttctcctacacttgccaccctcccacccctgggtttctcgggtttcctataattgctccggagctcccgtcaaaccacttcccaccccagctctcccaagaacaggggccttaccaaacctgcacgcagtccctgttcatacagacctgcctgggagcacagaaagaaccatgagctctgggccctgttcgccagcatctgctgatgtgggatgcacccaggtgcggggcctcaggcagcactccaggctgttcctcctccttctacagccctctgaggtccccaaacacttgtgtgtaaggctccaaggaaacagggagagaccctgggcaggagatatgagttctaatcctgcatcagcctctcattcttaggtaattcctttaccctctgggaccccaggtttcttatctctaaaataagaccactgatagctcccattgtatcaaaagcttttccagggccaggcactgtgaggagactcaaatagtcctgtgagtccagtatgatatcactgggctcaattccagatgaggaaacggaggctctgaggtgttgagaggcttggccagagttgcacagctaaaaagtggccccattgggatcaaaatcagcctggctcgggtatctgagcacataaccactgggccctctgagaacccttccatcttggttagtttctcggctgatctctctgggtaggtgccctctgggggcagtacccctgcctgagtggcacttcccctcctggctttgtttggtttggcctcgatttagaacagggttggcagaggcaggctgacttgcatttctggttttgggtttgttgctgcactttccccaaggggtgggcgggctctgactgacagtcaccactgggacaggcctgggccccaccctcaccacccaggaaaggggaaatgcggcccgctccccactcagtgccactctgtgccactccgtgccaggccctgagggcacccggttgctgcttccttccgtctttccccaaggactatcagaggcaggtggctgggccagggggtgggtcggggggaggtctggccatgtggtagggtgataggactgaggggccccagggagctggctgcagggcagtttgtttctcctgatggagaatgctccctggtgggtggggcgatgggctggggactggtttgttcatggggacagagatcagaagtgggcttgagaagaacagggccagaaggcctggactctggccccagcctagcccctaatttgtgcagggtggctttgggcaagtcactaagtcactgtctagactgggccctcagccttcctgtctacccaatggagggtctttctgtccacctgggaacagcctgataggactgaagcacagcccttagtttccagatgagaattctggactggaggccctgacattacaattgccaacactgactctggtgtttggcaaaatttggtgtatgtgggaaacacgtgcctctggttgaggtccttaacttcagaatttccctctagatcaatgctttttaaagcactaactccaacaccaccatcttctgtaggagctttcgagctttccagcttttccagcatacgctcctgatctgttactcaggcatgctggttatcccatttcatacgtggacaccttgaggcctaaaggttggtgactggctctacctgacacctctgtgtgattctaggttgccccttgctcctctctgggcctcagcctttctgtctatgcagtggggatttcggatcgctgttgtttcagagtctgaggctatgaggtctgagagggcccttgtgtggagtcacctctgagctgcaggcaggatttccagggcaagaaggccacagcatcagcaggcacctgtctttggcctgtgagccatagcctaaggcgtgcccttcccgaccttggccagatcacgctagagtcctccaaggcctcccctcccttgcccagccaccttctctgctctgcagggctccactttcactttcacactcccaggctgtggctcttacccgtgccgagctttcacatccgctcacatctgtgctcccagatgccagcgtgacccctgacacgtgtgtgcagcagcctgcagctgccccaagccatggctgaacactgactcccagctgtggggcttcaccattacagactccccagggcttcaaagacttctcagcttcgagcatggcttttggctgtcagggcagctgtacaatagtgggtaagtcaccggcctttgggctcagttttctcatccatcaaatggacattaatgatttctacaatgagagctcttaacccatgttctgggggtacttacccctgaagttttctgccagtgtgcgcgtgtgcccgcaggtgcacacattcccaagcatctgttcagttcccgagtatgggtgaggtctttccctttcattagttctcagcagctatggcttcttgaagacagaacctgggctctaaataaatagttccagctccggcattcctggtccttgactgggaggggcccaccccagacttgagaactgcctccctgtgtggttgtggcaccatggacactcctgactttctcggggccccaatcttctggtgacatagctgctattcagactttcattaagagaaatgtttttctctttgcacatgaaatctactgtcgaaactcagcaaaaccccctaggatcccgagggttgtgtgtgaggcaggagatgctgtgttttttgaggaatccctgagcttcctccaagcagtttaaaaatccctgggtgggtgattcttcagggaggttccgtgtgtctgcgacatctggtgagtccaggtgtggacaatattttaaagttccggtttcattccagtttaatagtttcaaaaagatacttaagcgttcagagcacattcttgtttgaatgactcattaggattttttaaacttgagttcaggtagaagacaccctgggctgggttcagtgactgccctggcttggttctggtccataagcagagactgcctggttctcctttatccccagaggcaactttgaccctgtttccttttctgtaaaatggggacagtgatgcttcttttatagggttgtcgggaaggccacataagagagtggggtcaagctggcctggcacctgccaaagcaggagctagatagatagtggttatctctccctcttctcctataaatgaccagctgtgtttttgatggagcagaaagttcaagcaagaagacagggtgagaattgttacccagctaagtcaaaggggctttgggggttccatctggcacctcagctttcagactgggggcccggggttcaggccactgcctgatttcatgtcagctcatgcatggtgtctggcatcttggagcctcctcttctgaactgttcttgttttctttttgtttcccagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaaggtgagaaagctaaagggggagggagaaggatacatgcaatgtggggagggctggcccaggggctgcagggaatgagaagtcaccatgttccacccccactatcctggcagcctcccagcgaactttccacctgttggacagaagataaaactgaggcccaatgggaccaagaaggcagagcatggacttaaacacatgactttaggattccagatgctgtgttcttatagctccactggtccccacagaaagcagagcaggtgtagcttagcccaggccattgtgtatttggatttaaaagatctgagatagtagctggagaaatagagttacagcctagccagactagaaatccatcagccagtcacaatgacaacacacatttattccgtgtccacattatcctaagcagtttacattaactcattaactctcacaacagccctttgaagtagatagtatttttgtgcccattttacagcagaggaaaccgaggcaaagagaggttatctaacttgctccaggttacacagtgtatcagtgtctgaactagaattagaatctggttccagggccagtgctcttaaccaaccaccacaccgtttgcctctcgtgaatatttatatgtagatgaataagtatttatggatttcctgctgtgtaccaggccctgcgctctgcaacatggcaggagccacagaagtgtgtgaggctggtctcaacctgagagaaataagttaactgtgtgagccttgaaagtggcctaacagtgaacagattgcgccatgatcttgaagcctaccagctagtttgggtctgggctctgtttcttactatgtggctttggttgagtcactcaactcctctgagccatagttttcttctctgaaaagtaggggttaatagcactcacatcccagaatggttgaggatgaatggaagaggctggtgcctgataacactagccgcttgagaggcggccctcagggaatgctgggccccactccttctcttgaaatgcaacagccagtgcaaggtgttggtgtgaggctaggtgagtaggggtgctcagtgcccatggagcacaactgactcagagatctagaacttcaggaggacagaccccagggcctaaagccatcagggaaagcttctggaggaagatacctctcagcttggccttgaaggatgaacaggattagaataaacagagaggtagaggcaagcattctttggctagagcagagcattcctaaagggcagatgcctggcacaggtgctgctattcctccctccaacccatggcagacatcattaatggattccagcatacttcctcaccaagttgggacatgtcctcagaagcctgcttagcttcttagccactagcaagaaggcagacttaccttctggggagatgccttctgctgaaagctagtcattctgacagggcaggctggggccctccagaaaagggtcttgaactttggccttggaactaaatctccgtttcctcatctgtaagcgtgtgtggttctcacactgtggtgtgctccggaatcaccaaggggaggtaattaatatgtgattcctagtccccatacccagaactctggaatcagaatctctaggggtggtgcccagaccctatattttaaacatgccccgagggatcatgatcttgccaaagtttgaatatcaccatcttaggccatttcttgatggtttctacaggagagagtccggaacgctgtccttccaaggcaaggcctcaggctcattcagatcaggcctggccactcctctttggagggcggttgaggcccacctgccttgggcttcccaatcctgattcccccactacacccttcccagttctattcccctcaccacacttgctccaataaaactatttatatacagataaattcacacacattcatatgtatgcatttatctaattccccagctcagttgacctcggctcctattttgggacacatactcctgcctgggagtctagcaggcctggaccagctctctcttgtctcagcttcctcctttgggtgcccaaggttcccactggcaccctcccctgtcccaccaacttttagccggtcacttcctttcttgggtttgagtggctgagctggcagagacatcagaggctgcccccagcctggtggtggccacccttccatgtggcttccacacaccagttcctgagccctttgccattcacatcctgccctcttccaccagtagcttcagtaggaaacttgtcaagaggagatgaagccccggatgggacaaacaccgtggtctagctccatctcttactggtactgggccttgggcaagtccctgcccctctgtgagccacagtttcctccttggtgaaatgggtatggtaataatgcctccttcctagggttgctgggaaaattaaatagcttaacacaggtaaaacatttagggcagtacctggcgctcagcacctggtgggtgctgcataaatggtaatcatgttatgtggagggggagggggagaagagcagtaaccagggtagtactggctgtgccgccattcgaagtaccaccagaccccatttctcaccttcctgacactgctgcaaagtggacaggcacttggcttacagtgggaggctgaggctagtgagagatattttgtccccagccacacagcagcaagtgatgatggcactggacaaggcctcaccattgtctagtcagtcctctgtggctctgccctagactctgagacctcatgctgatgaggggccgggggtgggggactggcagagggacagtggcaggttcccccatgacttctatcttcctggctttggcctggctcttctgggagggtcccctgatgctgatgggccactattcctaggcaatgccaggcaagaggtgaagaggggaggggtgaagtgttcaggctgtggagtcagacagacccaggttcaagtctcagctctgcctcctcctccctggctctgagaccttggccaagttgcttctttctctgagcttcggttttctcttattaatggaacacggagtcccccgggagttgtcccaagggttccagggcgcagtacgtagaaagcttgggctggtcatttgtgctgctgtgcggataagctgaggctgcccagagtacatgctgcctgccacagggtgacattcagtctcgacgttgtctccggtccacacccctgttatcctgccctcttatgtgctgagcaatttctactgtgagtaggaatgtcagaacaggcagacctcagagatagtctgctcgaccatggtgatctcacagatgggctgactgagtccagagagggagagccccctgcccccactccccgccatggttctccagctggccatcccctgggtgtggcgccctgtgctgagttgagtggtctcatggtgccccctgccgccagacccctgccttcctggctgctccctggaggccctgcagagcagatcacaggccttcttcctggggagtcaaggaagccccggagaataattgtgtttgggtccaggatgctgccattgaattctagtccagcctatctggctcagcacagagggtcatgggctattctttgacagtgaggagaccacaggctgcagcccttccctggccctgcttccttcctcccctgcaggggactggcctgggcagaggtggtccacagagggtgccagccctgtttcactaagctcccacgtaggtcagagatcagacgagaggaccccaaaaatgccttccagctccaagacgataataccttcaagcctcctatttttaaaaagcctaaagaattatttcggatgtgtaaacaagtaagtatagagtttaaatccactgtttccacgtggttccatggggcctgccagcctgggctggatcggagagggcagccatggatggccagggagccccagaagtccgaccaggaccaatagggaaaccagctgagccctgctcacagacgagcgctcagtcactagtgggctctggacccagaccacagttctctgctacttgttagttcagagagcccaggccagttatcaaactgccctgggcatctgtttcctcagctgcacactgaggggaaatatcagtaactagctcttagaatcgttgccaagattaaatgagataaagtatgttaaaacactttggcccggcacctgacatgtagtgaacgctcaataaataatggcaaaacccatgctagctgagagtacttgctcactgctgtgtgttgggcgctgtgctgagcacgtccccgtgttaacttacataatcctcaccacagccctttgagggaagtccggttattacccgcattttacaaataaggaaactgaggcacagagagggatgtaactgagctaaggtcaatgagctaataaatgattgagctaagcttcaaatccaggcaattaaaaatctacactcttaatcattactataattacagttataattacagtaagaattataattattgttccaagaggtggtgagctcctagtccctggaggtggctggatgaggctgggcagggcccagggattctgcctggagtgaaggaagggctgtatggtcctggactcacctccatctgcttttcagctggacaaggtcacatagtgagacagtggggagaagatggaaaggagaatccctttggagggcctttgcagactaggccctgggcaggcattgatgcagctgtgggaggggagggaagagtctgaggagccactctggccccctccaaggtcagaggccaaagcctccctgcagctatggtgagtccctagggctgggaatcagaacccgattttttcacctcaatttctccttggctcacaggctctttttggtgctggggtttccccagcagcccagggggctgactcctagggccagagctgcccagcccctctgtcaggctgctaggcttgggtcagtccctgctgaagacactctcctccccacagtggaaggaagagcccatttcccagcagcgcagaggctgaggatggcggctgggtgggagtggtccccaggcccattgtgtggagccgataaagtacggaagctgaggttagaatgggaggaagcccagggcccgagggctctttcccacgggtgggggccttgggcatggccttgccaggccagcatgagtgcagcctgtatgtgcactgaagggtgccctgaatggtgacagtggtaacactcactgggcaatgaccactggttactgaggttagcgtgggtgccaggactgggccttggggtccagagtttatcctggtgaaccttccatcagccctgtgaagtggctgtcactatgcctaagccatagctaaaaaaatggaagccgagaggctaggaaacttacccaaagttggtgaaagcaggatttatatccaggtctggttccaaacacttgctctgaaatcacacaccatacggtgtgtgcctctgtgtgcacgtacacacatgtatgtttacaactctggtggggcagcattctcaggaaggaggcagcacttcccgagtctttcacaggaaacattaaaatgtgttctgaccttgcatttttgagtagcagcatcctctggtggagaaacacaggccttgaattgaggcagattccagctctgtcacttacatgctgggtctccttggggaagtgacttaaattctctgagcctctatttactttataggtttattgtgaggtttaatgagatagtatctgaattatgccccatccagggtctggcctatagtatgagctaaatgaaggtgtaattcatccatccatccactcatccactccttcatccatccacccacccacccacccatccatctattcacccatgcattcatctaccatccacccacccacccacccatccatctattcacccatgcattcatatatccatccactcatccatccatccacccatccatccatctatccacccacccacccatatattcatccatccatccatccatccactcatctatccatccacctatccacatatccatccatccatccatccatccatccatccatccatccatccatgcaggtgggagactcacaaaagcatcccccgaggaaggaattgcacatggagatgaagaccttctgttggttggaaggcagagttgaggaggttgctgaagtaggggccaggctggagagataactgaaggaataactgaatggaactttctgccctgatcctaagatggtagatccagtcgtgttacggagtttgaatgttatcccgagggcactagggagccatggaaagctataaggcaagagaggtgcactcaggcctgtgtaatgatttattttatacactgctgaccatctcaggtctcctttgaacttcagaatcctgacttaatcattatgatcctgattttagaaattaaggaatagaggcttagagaggggcagggattggcctagtgacacagcagaagccctgccctctcacctgctcactgcctgcaatgaagcctctgtcctgagtgccagccgtctggcttctccccagtgagctggggacctgactgtcccaggaggagatccctgtggccggagagtctgccaggccgattccacttcatggccaggctgttcccagcagtggggtttccctccctcacctgtgtgccgcgggtgggggctttggggatggaaggggctggtggcagggaatgttgggtctctgagcctctgtttacttaggcaggagttcctgggtgcccagactgcatcgtgtctgtcttctctccgcagatgagcggggctgacaccgttggggatgatgacgaagcctcccggaagagaaagagcaaaaacctgtacgttgggaagatccctggcttctgcgctcctcttcctcccttgccccagggcttgtctctcctctaggggtccaggtggggagaagaggttgtgcctggtcccgcccacaaccccagacagacaccaaggaaaaactggatcttggaactttgcagtgaccccaaagtggggtcacctgggtcctgagcattctctccaagtgaggcaaagtgctgattcagtacccggaagccacagtgaaccagaagcaaccagcccgtttgccctggctttagcccagcttctgagccaagcagggaccaagtgacttcaacaactcctttgctccctctgggcccaagagtgacctgagaaggggtggaactgacagtcattggctcctctttctcttcctgagctcctgaatgctaatagtctcaggcattgccaggagggggcgctgctggcccagctgccgaatcccgcactcgccaagcctttctggccacactcaggccttcttatactatagggtgtttgttagaggtgtcaatgaaaaagatgtgtgtgtgggttctcaggtcttcttctacccccaggcctaagaccctggagactcgggggaggtatagggaggaggcagtggggtgcatgcacagtgacacctccagaggaagcccctccccaccaggtcctgtagcacccaccactaggcaggaattgggctatagggaggagcctcctgcaaccctcttctctggccttgaccgtgggtggggtccactaccctagaaagccttcctcaccccagctgccttgacctctccagctttctgcagcaactgttggcttctcttactccacagccaattgcattttcttagcaaggtgaaatgcataaaccaaaacagtcccttgcaccaaccatcttcacttaaccttttgtaggatgagagaggatccagggggtgccaggactgttgaatgtggtgctggaagtgggaggtgtagggaagcagtgtgtggcgcagagggcaggcatcccgggtgctggagcagccctgtctagcctcctttcaatgtaggtgctgccttttgaattgcctgaagcccacactttttttttttggagacagagtctccttctgtcacccaggctggagtgcgatcttggcttgctgcaacctccgcctcccaagttcaagcagttcttgtccctcagcctcccaagtagctgcgattacaggtgtgtgccatcacacccagcaaattttttttgtacttttagtagagatgggggttttgccatgttggccaggctgttctcaaactcctggcctcaagtgatcttcccgcctcggcctcccaaagtgctgggattacagacatgagccaccatgcctggcctctgaaggtcatactcttaaaagcttagacgaagagtcttagaacatctacggtaataataagaataaccattaatgtttattatgccccgcactgttctgtgtgtatttcatatgtaatctaatttaatctttaccactacttttattttccgttctgttctttcttattgaccttacccttattttacacgtgaataaactactgtgcaaagaggctaagttacatggcaagaaagtggtggggttgggacctggagacctggcctgctggcttctgtttgaggaaacagcttgacagagaaaaaaccttgataggaaacttgagagatcaggaaacgtgtcaaagggcacacagctggtaactgctggagctgggatttgaacccaagactagctccagagcctgggatcagcctcccctgcaggactctccttcattagacagggtgtctaggtcttagtgccattttaagcttgaatagcatcagaagtataaatgcttcaaacttaccaaacccccttgaaagtttaattattaaatttcttttgcacgtctttagttatgtgatttttgaataatcaatttttcattttcatttttggtttgagtcagcattttccatctttgggaggatggagaccaaaacttaaagtgaaacatttattattcgaaaatcacaaaaccatgcacacaacattaaataattaaactttaaaatggtgtttttgtaagtttataggacttgtacttctgaagttattcaggcttaaaactactaagatgttggggtcctgctgtatattcatgactggatgtcgccaatgcaggtgactgaggctgagaggccggctggcaggagccattctctgggaggtgccctgtacagggggtctagggaaaagaggggcgaacatgagcaagaggcatttaactcctttcttgccagcagtttcacccagtgctgaattctgctgcctccttggggaccggcaaggctaaaaatggttcttggctaaaaatagccagtcctgccaccccggtggtgggcagtgcctcccctggctccctccttccctttcagcaatttgctgacttgtcccccaccccccaccactgtctccctgctgccatggtaacgaggaggccagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctgtctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctacagaccaatctgcggccccaaggtggggggccctacagagatgctccgaggcatgtacctcactcgcaacgggaacctgcagaggcgacacacgatgaaggagtaggtgccctcgacccagctctcccgactctggatttgcaggggcgagtgggccaggctgagcaaccctcttttctgcttctgtccccagagccaaggacatgaagaacaagctggggatcttcagacggcggaatgagtcccctggagcccctcccgcgggcaaggcagacaaaatgatgaagtcattcaagtaggtcctccctggcaccctgggaccctttggggaactcactggctccccggggagtaggactgagtggtagggttgaggggaaggggcttgccggcttgatccagctctgggggagacaggctttcacagagggagctgggtacctggcaagcagctaccctcacagggagcagctgccctagggggaaggctaggtggggtggagatgggggctggaagggaccctggccccgggaaagagggtgggcctccttcctgggcgccccagctgggctcagctgcagactgggcccagggcagtaaacaaaggccgcctggcccagcttcccccaaggttcccaagcctctcagtgccctcactgtgtttcctccctcacccctcaggcccacctcagaggaagccctcaagtggggcgagtccttggagaagctgctggttcacaaatgtaagttgggcctgcctgcccactccctgtgccctctctccctctccccttcgcccccatccagaccctgtgtagctggtgctagagaggccgccttccctctcctcggccgtcagggtgtccttgctgttgcggaggggctgagcccaagctgaggcccttggtctggccttggagccagcttctgccagcccctccccgtccatgtgagctggcactgcctgccggaggcccgtgggacctgtgtgctcagatccatattcccagaataagaataaacatttctacgtactgagggctttcacggcgccaaatgtgcctgccatctcatgggcagggtcccatcggctcctcccagggctccgggagacagaatcgatagtccccatttcacagatgaagacactgaggcatagagagggggagaccccactgagaccctgaaagaggcagtggcagggctggggccacatcccagggctcctggctgtcggggacgggcattgtactcagctcccagcacgcccatctttaaagtcctgtaggggtaagctgaggcatcttaagggcaggagaggctgagtttgcctcttaccccaggatccgttctcctcacagacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtaggacctcagggcagaccctccgctcctccaatccccagggcccagtggcccttcagctgcaaggtggcagccagcagcacaggaaggggagaggccagaatgactccatgagcccaggtacccagcagggaagatgcaagctaggatcaggggaagaacagaatcccagttagtaataaaaatggccaccaccaaggcactgccgcatgccaggcatgtgctgagccctttatgtatgcgttctcatgtttaatccacacaacaacctgtgaaacgaagagacaggctgggcacagtggctcatgcctgtaatcccagcactttgggaagccgagccaggcggatcacttgaggtcaggagttcgagaccagcctggccaacagggcgaaaccccatctctactaaaattacaaaattagccaggtgtggtgatgggcgcctgtggtcccagctactcgggaggctgaggcaggataatcgcttgaacccgggaggcggaggttgcagtgagccgagatcgcaccactgcactccagcctgagtgacagagacaaatcataattgctcccatctattgagtgcctactgtgtgccaggcactatgcgcaaagcacattatatggatgatcttgcttggttttcacgctttgaggaatgtactattattcctagctggtagataagacaactgaagctcaccgcacttaagtaatttgcttcaagtcacacacccaggtgtggcactgctaggatttgaacccaggaagcctaaccctcagggtggtattttcagccttataaatgctgccagccctacaggaaatgactgagccaggacttgaatcctctggtctgagggtctctacttcagatgaaccttaagatgtggggcaaaggggcttggaggtgagaggctggatgggtcccttccaggcacatgggccctagggtcagtccccagcaggcagccctgaccatgtccccctctgcctccccaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 36491 - DNA, 10228 bp, Homo sapiens
gtaaggtctcggaagtacgaggcggaggggacgaaaaacggggggccagactgttgtggctgtggtggagacgagaaaccaggaagaagaggctcgcctcccactcggcgacagtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggtaagaccctccatcccgcatcccactcttgcccccagatcccccattctcacctgggcaggtcacctctaggctcgcttcttccctacccgacccacctctccgctcgccatcgtctcccgccccaccccccaatccccattcccccgctgctcccgatctcttccagttctgaggagttccttcttcccgcctgcccttctccggtgctaactcgtttttctatttcaggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaagggacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaaggtaagtcgacagcggccttccggaggggagtggggtttccagcaccctggaagcttgggtgtgggtgggtatcccgtcactagatgcccgtgagcactggggactttaaaacaaacttcagttttttcctcaggccctattaggcctctttactcttgttttgttaatcgtgttttcatcctgtcacctgtttactctgagtgtcctctgctactgcattaggagccaagttaggacattattaggatctgacctgacttggaatctcctcccataactttgcacttaggtccttcacagcctcagaggacctgagtacttgacagttaaagcacgtaccttccatcctatttcccttcttgagacgatatgtcatttctagcttcctttcccaacattctctcttccatcagcagtggcacaaagaatggtttcaattactgcgtcttcgataccaggaccaaagagcccagggacttctgcaattaataataattagaagaaagcccagaaattgcacagacacgtacacctgttactttttcatcagggtttggtctgtttattagcaaccactctaatgacaaaatgattgcatttcatattgagcccccaacatttagaagctagtttctgtaacctgcttaaaattggagagtccaattctggccataaggcctatggctataaagaataaaggggaagacctttagtaaaaatgtgcattcctggcccggtgcagtggctcctgcctctaatcccagcactttgggaggccgaggcaggaggatcgcttgagcccaggagtccgagaccagcctggccaacatagcaagacctcgtctctacatataataaaaaaattagccagatgtggtggtggacgtgtgtggtcccagctactcaggaggctgaagtgggaggatggcttgactgtgggaggtcgaggcttcagtgagccatgatcacgccattgcactccagcccgggtgacagagtgagaccttgcctctaagaaaaaaaaaaagtgtatttcttattctatgtccaagtgtccattatgcagggtaaccttagtcatgaaatgagattgataaagaatgtagttgatgtagcatcgtggggtgaaaaagtacatttgtagataggaaattctgattatgactttttttaaaggaatgtcctatatcctagatatctctaggaaggagttgatagatctttgactgtgtacctttgaataaatcaaacagacttcctcccacacgctagagctcagacagccttctatttgttatttcctattaagcaatacaaaggattctgatgtaattaggctctgtctttcttaaaatggttatagtttaaatagacctctgtgagtgtactgctctttctacagtcagggtcattaacaaatatgctaccaggtgactgcctctgagttcagagactgaactatgtcattacagagccacctgttaatcattttctttttcctttcctcagatcattgcttttgtcctggaaggaaaaagatctaaagtcacccggcggccaaaggccagtgactaccaacgtttggaccagaaggtaaggaaggaggagccaggtccatgggagggataggagggataggcaacgtcagatggacccagtagtgggcttgcatttgccatgaagcagcagtggctgattctggggatgcggttgctgttgctgttgcattcgccctttttagacaacaaactagaaacatctagatacacatatctgtgacgttagagctagcagagaccttggaatactctacagcagctacctcccttcacagatgaggaaataggcccacgcagaaacactcttttttttttttttccgctaagtttctactgcaagttagtggcaaactcaggacctgatagcaactccctagtctcccagtcctgagctttctgcattctgccagcgctccataaactttaataggcatttgaatcaccttggggaattttgataaaaagcattatctgattcattagatgtggggtggagcctatatttctacattcttttttttttttttggagatggagttttgctcttgttgcccaggctggagtacaatggtgcaatctcggctcactacaacctctgctgcctgggttcaagcgattcttctgcctcagcctcccgagtagctaggattacaggcgccaccaccacgtccagctaattttgtatttttagtagagatgggtttctccatgttggtcaggctggtctcgaactcccaacctcaggtgatccgcccgcctcgacctcccaaagtgctgagattacaggcataagccaccgtgcctggcctgtgtctacattcttaggaagttcccaggtgaaaccaaatgccactggatccacactttgtgtggtaaagtgctagactgtgctccctggaaacacgagcctggaagcacataggcctccaactccccacatcagcctggcttaagcaccgtaggctggagttcctgagtacagccaatccattcctctgtcagacagataagccctccttccaccccatggcagcagagctaagcaagggtctctctaaagacaacctgtctaagcaggaagactgtactctcactgcgttgctaccagcatgcacccttccttctgctttcagcatagcaacagccaggacattggcaaagaaccattggtggcccaactatgaattgttcccagacttcctgcagggaacacgattctcttgcacaactcaatattagctacagaacgagccactgagctcagaatatctttgctaactagtccagtaggctagctttacaatttagctctggactactgccttttcagataattgactttaagggttttcccccttttatgatttttgtttgtttgtttttgagacggagtcttgctgtgtcgtccaggctggagtgcagtggcacaatcttggctcactgcaacctccaccacccgggttcaagcagttctccctcttcagcctcccgagtaggtgggattacaggcgcccaccaccacgcccagctaatttttagatttttagtagagatggggtttcacccttttggccaggctggtcttgaactgctgacctcaaatgatccacccacctcagcctcccagagtgctgggattacaggcgtgagccaccacacatggcttatgatttttaaaaaaatacacatgtggctgggcatagtggttcacgcctgtaatcccaacagtttgggaggcagatcacctgaggtcaggagttctagatcagtctggccaacatggtgaaataccatctctactaaaaatacaaaaattagctgggcatggtaatcccagctactactgaggaagccgaggtgggagaatcgcttgaacttcggaggcagaggttgcagtgagccaagatcatgccactgcactccagcctgggcaacagagcaagactccgtctcaaaaaagaagaaaaccaccaccaacaaaaaacacatgtaaataattcacaacagtacagaacagtatgaagcagaagccaggattcctctctctccatcaagtgtatatctttctagtgttaggtttcatttcaaactttaaaaatcattttgtgtgctattttaattaattgctgtttctgtggtggtgggtcagtatgtcttaattctgaatgttttccctgcacctcctaaaagatcttttttcccctaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatcttttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgacttttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgatcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtggatgagggtgagctggctgaggcatcgctcaagctggggggtggtgtgtaagaagcacgtggagccacaagaggcacctcctatagtcagctaagggcttccctttctgcgcccagcttttgggtgaagggtgatttctattagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaatgg

SEQ ID NO: 36492 - DNA, 4693 bp, Homo sapiens
gcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctggtgagtccgcgccccgcccctgccccgcccacgtgagacccgcgtcctccaggcagggtcctggggagacgggagtgggtggcccggcaagcctttccgccctggcccttgacgcttccgactttggggggcacatttgtgtgggggagaaggggcaagtgcaggaagctgaggtgcagccaggggacctggtgatacagcagaaggtgtctgcgctctcggccttcttttttgctccatttattttcccttgatggagtgtgcgtgcaggtgggaacttgggggaggcagggggagaaatgggagggttttagggccatcccatgggctccagcaggcccagctcctacaaccctagacggccaagctggggaaaggacccaaatgttgttctcagcttccacttggagaaaaggggaggggaaccccagactctgaaattctgcacacactgagaaatgactcctttcctcctaataccggtgttcgaagcacctaaacaggaggcgtctagaaccgaagaggccccaaatccagggttgtattagacttgagtagggactgagggcaggctagggcgtaggttaggggagaggggagaaagagtaggggaaagagggaatctgccaaatcagggttatgatttaaacctgctcagaatcgttcacccatcctaccccaccctgctccagggaggagagcagaagctgagtcactgggtgggtgggacagaagtgaatcagccgtgaaaacatggggggcagcggggagatggggagggcaggaaatgcaaactgcgcatcccagaggctctgggttccttccacgggaggggatggagaattcacttggagtttctttcagttccaaatgcccgagtgcaggcttctgggcgtcctcctaaaaggtggtctgggtggatgagaggaggcagtttggaactaaatggttgggtgctaaatgtagggaatgaaggagaaggtctggggaggggtgggcatcctgaggaagaaggatcagactcaggattgcaggggaaatgtctcctgggttgtgagtggtagttagctgggagcttgtctttaggcacagaggaagaggatcccttcaggggttctgatatctgattagatgttaggcaaattccaagcagtcagtacatgctcccctttctgccttttcctgtccctgacttatttcctcaccccttcccagtcctgagctctccccggaccctccggaaactttctccagagccaggagcaacctgcaggttggaagcccctcattccttgcaccttcttaatctgccctcagcctatcttggttaagggttgaatccatgtgctcctgggaccactggggttgagctggcctgggtcacagggtaccagaagggagaggttcccactgcagtgccccagaagtaaccacatctcaggcctgggaggggtgggttgagtcatagcaaggtcacagcagggacacacattccttttgggtccctgttggcccccctcctacatccgttgctcttctgccccagctctccggcttcgtgcgcccccttctggcctctggtggaacagccaggtcttttcacccaaagcccaaagccccaaatagtcctttgaatttgttctccattttttcatttattttattatttattgtaattaattgattgatttttaaattagttaattttttaaaattaagtaattagttaattttttaaaattaagtaattaattaattttttaaaattaagtagttaattttttttaattaagtaattaattaattttaaaaagtatttatttattttgagacaaagtctcactctgttgcccaggctggagtacagtggtccagcgtctcactgcaacctccgcccccccgagttcaagcgattctcctgtctcagcctccggagtagctgggactacaggagcctgataccatgccaggctaatttttgtatttttagtggagacggggtttcaccatgttggccaggctggtctcgaacgcctgacctcaagtgatctgcccaccttggcctcccaaagtgctgggatgacaggcatgagccactgcgcccagccaataatttatttatttttgagacagggtctcactcggttgtccaggctgaagtgcagtagcacaatcatggctcactgcagtcttgacttctggggctcaagcagtcctcctgcctcagcctctcaagtagctgggactgcaggtgcacgccaccacacctcggtaattttataaattatttgtagagatgaggttctcattatgttgcccaggctggtctcaaactcctgggctcgagcaatcctcccacctctgcttctcaaagttctgggattacaggcgtgagccattgcacccatcctcattttccatttttgctttccaaaattcatctcctttataagccttaaaaatcagtatgggaaatactggggaatattgtcaggaaaagtaatataactatttgtcagagaaagaaactagggccagcatcatgcaacagcggggcataaggccctcccttccttacttcagcaggtgatgtgggcaaggcccttctccacatggctctgcctgatttctgacctctccttctcctattcctcctccagttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatggtgcgtttggagctggtagggagcaggaggggtgggaagccctggagacttccatctgagactgctcccttgggcttggagacgtctccattgtctgtcctgggtgcttgcctggtgggccagaaggttggaatggggagctgggctggagcggttctaagctgcctactctcccttccccagggcccatgccgtagacatctggactcagtgctgcagcaactccagactgaggtctaccgaggggctcaaacactctacgtgcccaattgtgaccatcgaggcttctaccggaagcggcaggtgagactatttttcttctcctcctgctccagcagaaggctcctgccagggagtgggggcggtgctgcttacaaagctgcataaataagacactgccccatctttaaggatcttccaactttaggagaacatagagaatataatttattaaacaaacttagagaataatcaaccacacactgtgagagaaaacccacttaaggaatgccctaactcagtggctcttgaacttgaggcatcagaatcctccggagggcttatgccacacagatagctgagccccaccggcagccttcctgattcaggaggtgtggggtggggcctgacaatatgcatttctaacatgttccctcgtgatccggatttgggaacgtcactttgaaaactactgttccaggctagcagaatgcacacaatttattggttgaagagggggaactaaagagagggaacactgggccgggtgcggtgtctcatgcctgtaatcccagcactttgggaggccaaggctggtggatcacgaggtcaggagttcaagatcagcctgaacaacctggtgaaaccccatctgttttaaaaattacaaaaattagccagatgtggtggcatgcacctgtaatcccagctactcaggaggctgaggcaagagaattgcttgaacctgggaggtggaggttgcagtgagcagagatcatgccaatgcattccagccagggcgacagagcgagactccatctcaaaaaaaaaaaaaaaaaaaaaaaaaagagagggaacccccgaggagacgctcaggtgtttttacatcctcagactcagatgtcccctctcattctcctgctggaagcctctggcctcactcctgacctgtgtgcctctctctccagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtcgctg

SEQ ID NO: 36493 - DNA, 202425 bp, Homo sapiens
atgagcggcggcggcgacgtggtgtgcaccggctggctgaggaaatcgcctcccgagaagaagttgaggcgctatgtgagtgcgggcgcggccgcccaggggcgggcggggggcgctccggggcctgcggaggggcgggggactcccggaggggcggcaggctggggagctcgggcccggagccgcggggggccgggggcgaggagcggccgggggcgtgtggggcacctgcacacctgtcacaggtgggccgccgaggggcggggcgggcggcaggttgaggctgcggctcctgctccgccaggcgggtgcggctgcggcgcctcccaagccggtctgctcgtgaactaaatacagtgtcgaagttttgtattgatggcttctggagaccgagagagttgactctcggggctggggctccgcggcagccccgagcagcttcagcccgcagggtcggggagagggcgggaaaggggggcgtaggctgtggggccgcgcggacggccccacaaagggcgagcgcctcacgccctctccttccctttctccgcctgcccctcccggccgccggcctccctccgtccgcggctgcatcaccggcagcgtcagcggcatgtgcagcccttgtattaagtgactcatttgtttgtcccccttctttccctttattccgttcgtctctcacaggcgcctccccccgaccccggtgtgacactgcagtttggtccccgtggctggcccgggtttgggaccgggcagctcccgggtgtctggggtcgggagagatcgaggctctccgcggccaggtgttgccaaccgacagtgtttactgagatcgctggaacagccttttccctctaggtggggaactggcagcctgggggaggtggaacagcgtggcgctgagccgtggagttctggctttttttttttttttttttaacccctctccccagaggatgccttgcctggtgaggtcaaagtacaagatggtgccagttactgagatttggccgaaatggtcttggggtagtcgcgggagtttggaagtgggggtaaggttgctggaaggtttcaaggtctctcatctgctccctctccgtttcccatgaaatgcccttgtttaacgggctgtggtgccgaactccgggatcactcccacagcctggaagggagccgttgcctccagctgcagtgcatcaagggagctcggaatagaccctgccctctgtcagctgcaccagtggctgtccatggggggagaggcagaagcctaccagaatttcctgtcttggctccccagatcagaatcaagggacttctggcctctggactgaggaagtgacattctgtttttcaaaggaagtgttgttgttgcggagtacaagtgtgtgtcaatgaaatcaggctcttaggtagatgtttgctgggggaaaaaaatctaaggatttagcacatgagttttgaaagtggacgtggatttataggaggaatgaagcagtgaattgttcatctcagttcggaagctcatttttaggagtgtctatgtagccaaagtataattattaagaaataaacttttttcctcttcagggttgtatcagttcgttaggaaggttgaatattttaattaggattaaggagcagtgatttactattaacaattttataaataatttaaaaactttgtcccgaagagcttccaaaaattatctatacaaatagatttccatacaagctagtggaatacagtgtccacagtaaaaaaaaaaaaaaaaaaagtgacccttaattttcaagtttgaacactatacactaaagaaccttgaaagttgtttttgaaacaatttgcaaacagtatgacactgtatctacatttgacttatcgctccttgaactctcacccagactctatgacccatttcttgggtgtttttgttcccaaacaactttagttcaaaataaccaggtttggaggcatttgggtcaagcacctttttcactgatttgaacgaatctagtcgtatgatggccttagcctctctttcccatcttccatgtaccttcagcccatcaggtgtcagaccttaacagctttaagtaacagcttttcttaggttaggatgtgatgtgttcacttacatgactggaagcctctgccccttcggaagttcagtttccccctaactgaaactggtgatatgtgtaaccttaagcctctggggaacagtatgcctttacatctacttttcttttggggtattcagaatttttgcatcctgttgtaagttaaaactctgctagtttgcttatttcagtagaggcccgagttcattagaaccaagcttggaaagtatttcccagccccatggctgtatatttaccccaaagtagctgctgcttctggtatacatcataggcgtgttatattgtagattgagaaatcctcattataagaatacatcgagcatatgtgataaggggaaaaagtagttgaactaggttataactatttaaaacgattttttaaaaaactgacttaatttgaagtctgggcgcagtggcttatgcctgtaatcccagcactttgggaggctgaggcgggtggatcactggaggtcagaagttcgagaccagcctggccaatgtggtgaaaccccgtctctaccataaatataaaaattagctgggcgtcatggagggcatctgtagtcccagctactcaggaggctgagacatgagaatcgcgtgagcccgggaggctgaggttgcagtgagccgagatcgtaccactgcactccagcctgggtgacaaaacgagactccatttcaaagaaaaacaaaaaaacttacttaattcggaaagacgggaaggtgtagaggggaaaaacatcttagaagaagcaaaggcaaatgtttgagcaattagttttcagggatttttttcatcagccttttctagttaattaagtataagtataagagacctatctgctatttactgagtgccctggagaaattgcaaaaagtgtctctggaaaatgctgactattgcctctggggcatcctgatatggctgcagtgggaggccggcagaagtaacaaccctcccatcgtgcctcagtgtatttgtgtgtgtatgcgcgtgcatgcaaatgcatacacacgtacatgtatataattattaaacagaattttcttgaggaaaaacattttattaatatgacctacactgcattgtagttttctatcaatttcactggattaaaagattgagggaataagattggcagactaccccctagtggctaacttgaagaaagttgtgcacaaattgtaaagaactactgcattaaggtaacagtaattgtttatttccattatatttattaaatatacttattaaatctatgtcccaggcactggatcaggtgcttggaataaaaatccagtaaacagaaaaaaaaattaatccagtctttcagtcttagcaatggctttgccttctccttcaaaggaaaattgaaatgatgagggagtagttgtctgtacgtacgatgaatggccacattttcaaatttacttgtatctgcatagttcctttctttcttccttttttttttttttttttttgagacagagtttcacttttgttgcctaggctggagtgcaatgcacgatctgggctcactgcaacctttgcctcctgggttcaagcgattctcctgcctcagcctcccaagtagctgggattacaggcatgcatcaccacacctggctaattttgtatttttagtagagatgaggcttgaccacgttggtgaggctggtcttgaactcctgacctcaggtgatccacccgcctcggcctcccacagtgctgggattacagacagacatgagccaccgcgcccagcctgcatggttcctttcttgtttccttttcttagagtagatgaagtgccacttctatctgagctaatcctgctacttatactttgaatcatatcttctcctccctactcaaataattcttatcctgtaacacatcttcaacttctttccctctctgtactacctactttttttcagggataaacttggtggtggtttatgcagtcttcctttctcccaccttcttctcagtcggctccagtggaaacctactttgttattcaccaaagctattctgacaaaggcaccagcgatacccaggtcactaaactcagaggatgattttttactcctcattttaattaatctcttcactgcttggtcatagttgaccactcttttttaaaacaccttcctcttatcttggctgacactataaatgcctgttatttctccttttctggctactctatatttcctttgctagactgacccttttatccagtccttaaaggttgaagctcctttatagtcatagtggctgtgtggtttctcccctttggcaaccttgtccattctactggcttcagttatcatttgcatggtggtcatcaagttaaatttccatctcagagttgtgttctgaacttcagacttacatatccaactgttaactgggcatctctatttgaatgtttcccagtcaacacaaactcaccacttccaaaactaaactcttctttgttcatctcttcactccacatctgctcagtaaacagtgccactaagcacctacttgctcagatgagaaacttgggcatcatctttgactccccgtcacccactatcccacatctaatctgtcaccaaaacccattagtggtatcatctaaatatcttgttatacgcttcttcatccccactgccatgacttttaggattattttagtagccatctgttgagcacttactttgtaccaggcactatgcttagaccattgatcttttaatgtagtaatttagccctataataagggaagcaacttacccaaagtcatctagctttgtcctaaagcctgggctttttaaaaaaattaaacatttcattttgaggtaattctacatgcacatctagttgtaagaaatagtaaacaaagatttatgtagccattatccagttttccttaatggtaacatcttgcaaaattatagtacagtatcacaacagtatattgacaatgatacagtcaagatacagagcatttccatcatgataggattttttatgttgcccttttataatcgtattcactaccatcccacccctaccacatccttaatctgtgacaactactaatctgttctctgatatttcatgtgtgttatttaaatggattcatgcagtacttaagattttgaacttttttttattcagcataattctctggagattcatcctcatttcatgcatcaatagttattgttttttattgctaagtagtatttcatggtatggatgtaccacacagtctgtttatttaaccattcacccgttagttctcatttacatttcccttatggctaatgatgttgaacatcttttcatatgattatttgccatctgtatatcctctttggtcaaatgtcttcaagaatttgagtattttatatataggttttttttttttgagatggagttttgctcttgttacccaggctggagtgcaatggcatgatctcggctccccaggttcaagtgattctctttgttgttgttgttgttgttgttgttgtttttagacagattctcactctgtcacccaggctggagtgcggtggcacagtcttggctcactgcaacctctgcctcccaggttcaagcgattctcctgcctcagcctcctgagtagctgggactacaggtgtgcgccaccatgcccagctcatttttgtatttttagtagagacagggtttcaccatgttggccaggatggtctcaatctcttgacctcgtgatccgcccaccttggcctcccaaagtgctgggattacaggcgtgagccactgcgccggctttcctggtttttttttttctacacattttacaggtttatgtttttcctttaagtccgtgatccactgtgagttaattttcatgtaagatgtgagacttagattgaggttcttttgttgttgtcattgttgttgacaaagccatcctacttccattgaattgcttttccgtctttgtcaaaaatcagttggacgtatttgtgtgggtctgtttctgttgtctctgttttggtccatttttccatgtgtctgtccctctgcaaataccatagaatcttgccaactctagctatattgtaagtcttgaaatctggtagcctgattcctctactttattcttatttttcaaagtgttttagctattctattatctttacctttcaatacaaattttagaataatcttgtttatgcaaaaaaaagaaagtcttgctgagattttaataggaagtgcattaatcctgtgtaccaatttgggaagaaattacagctttactatattaaatcttccagtccatgaatttattttacatttatttatatatgtctttcttccttcgtttattttcttctccttccaccatccccccccccaaccacccccaccagaatcttgctgtgtcacacaggctggcgacagtggcacaatcatggctcactgcagcctcaaattcctgggctcaggtgatcctactgtctcagcctcccaagtaattgggacgacagctgcgtactgctgtgcctggctaatttttttttttattatttgtagagacagggtctccctgcgttgcccaggctggtctcacactccggagcttaagcagtcctcccaccttggcttcccagagtgctgcgattataggtgtgaaccaccatgtctagccttctggaagagatggtgtagaactggtataattctttaaacctttggtagaattctccagattaaaccatctggatctggaaatgtctttgttaggaattttttacatttttaatccaatttctttaatagatacggggttcttcaaattatctacttcatattggctgaattatagaagtttacatttttcaacaaattggtccattttgtctaagttgttacatacatgtgagtggagttacagtatcctgtattatgctttcagtgtctgcagggtctgtagtgggtccactgctttatttttttaacccttattcttgcatactgacattgcttcattattattttttgtttgttttttgagacagcatgtcactctgtcacctggggtggagtgcaatggcacgatctcagctcactacaacctccacctcccaggttccagcagttctcctgcctcagcctcccgagcagctgggattgcaggcatgtgccacaatgcccagctgatttttgtatttttagtagagacagggtttcaccatattggccaggctggtctcaaactcctgaccttaagtgatctgcctgctttggcctcccaaagtgctgcaattacaggcatgagccgctgcacctggcctctgatttttttatatagtagtttattcatttgagacttttcctcttatttaatgtattcatttactgctatgaatttccctctcagcactgctttagctgtgtcccactaattttgataaattgcattttcaatttttatttgctcagtatatatatattttttttactttccttgagactttcctctttgaccatggattatttacaagtacattgtttagtttccaaatgtttggagattttcccattatttttctgtttctgtcttttagttggaattcattgtgggagtagagtaagttctatttgatttcaattatttttaacttgtcaaggtttattttattgctgaaaatgtggtctatcttgctttaggttccatgggtactttgaaaagaatgtttattctgctattattgggtaaagtattccataaatgtcaattatatctttttgattgatagtgatatatataattcttttatatccttgctgatttttctatctagttcttctgtcgattgttgagagacaggggttgaagtttccaactataattgtgaatatttctgtttctcatttcacttatatctgtttttgtttcacatattttattttttttattatttttttggagatggagttccgctgttgttgcccaggctggaggtgcaatagcatgatctcagctctccgcaacctccacctcctgggtgcaagcaattctcctgcctcagcctcccaagtagttgggattacaggcatgcgccaccacacccggctaattttgtatttttaatagagacagggtttctccatgttggccagactggtctcgaactcctgacctcaggtcatccgcctgcctcggcctcccaaagtgctgggattacagacatgagccaccgcacccagccctgttgttcaatatatacacatttagaattgcaacatcttcttggtggcatgacccttttatctttatataatacctgctgagtctctggtaatttcttttgctctgaggtctacttgttatctgatatattatacaagtatctgagggctacttgatatattatagcctatatctgatgatatagttattcttgctttccttttattgatattcacatgatacatcttttccatcaatttactttcaacctacccatatcattgtatttgaagtgatatcttataggtggcatattgttggggtgtattaatccgttctcgcactgctgtaaagaactacctgagactgggtaatttatcaagaaaagaggtttaattggcccacagttccacaagctgtacaggaagcatggctggggaggcctcaggaaacttacagtcatggcggaaggtgagggagaagcaggcacatcttacatggctggagcaggaggaagagagtgaggggagaggtactacacacttctaaataaccagatctcacaataactcactcactatcatgagaacagcaccaaaggggaactccacctccataatccaatcatttcccatcaggccccacctccaatatttggggatgacaatttgacctcagatttgggcagggacacatacccaaaccatatcatggggcatgtttttaatccactgtgctgatttatgtcttaattggtatatttaaatttacacttaatataatttctaatatgctagagcttagttctgccactttattttttgtttgtgttctgtttttgttttcttcttgccttcctgtgagtttcttgaatattttttagaattccattttgatttatctatatagtgtttttgagtgtatctctctatacagcttttttagtggttgctctaggtattatactgtacatacaacagtcagttggtgtcgtcttataatctaaatgaagtctgtatcatcattttacaagtttaagtaaagtatagtaaccttacctccctttatgtccttttgccatcctccatatataattgtcttaaatattttttttatatcagacagtgctataatttttgcttcagtcattaaacctaatttagaaaactcagaaggaaagactatttaattacatttttgtttactatgtgctttcttctttgctgatgttttcaggttcctctttttttcatttcctttctgtttagagaacttcctttagccattctttagggtagattggccagtgataaattgtctttattttccttcacctgagaaggtctcattttccccttcattctgatattttcactggatattgaattatttagttgacacttcttttctttgagcacctgtaaaatactgcatcctttccttctggcctgcatggtttctaatgaaaaatccatggtctttccaattgctttccctcaggaggtaaaatgccctctttttctttcttttcttttctttctttctttctctctctttctttctttctttctttttctttctttctttctttctttctttttgggacggaaaatgccatctctttctttctttctttctttctttctttctttctttctttcttactttctttctttctttctttctttgagaaggagtttcactcttgtcacccaggctggaatgcaatggcactatctgggctcactgcaatgtctgcgtcccaggttcaatagattctcctgcctcagcctccctagtagctgagattacaggcgctcaccaccacgcccagctaatttttttgtatttttggtagagacagggtttcactatgttggccaggctggtcttgaactcctgacctcaggtgatccacccaactcagcctcccaaagtgctgggattacaggagtgagccaccacgaccagctcccatctttttctctggatgcgttcaatgattttttttctctttattttcagaattttgctatgtgtcttggtgtggaattttcttgagtttatcctgtttggaactcactaaacctactgaatctttcttactacatttgagaagttttcacccattatttcaagtactttctcagtcctaccctctttcttctcttcttccaagaatccaatgacaaaactgttagatcttttgttgtagttccatagcttctgtagactctggtcattttttttcagtctgttttctctgtgttgttcatattaggttatttctactgtcctgttttcccattcactgattctatttctctgtcctcactattctgccattgaactcactgatgaacttttttattttggtggttatatttttcagttctaaaattccatttggtttttctttacatcttctatttttttactgagactttgtttctttttggaggctttccaattttccatttgttccaagcatgtttgtacctgcatttttatgatgactctttaaaatctttgaaagataattctaacagctctgttatctcagtgttggcatctgtcgattgtctttttcattccatttgagagcttcctcattctttgtataatgagtcgttttctattaaaacctggacatttttggctcacacatgtaatcctagcactttgggaggccaaggcaggtgagtcacctgaggtcaggagctcaagaccagcctggccaacatggcgaaaccctgtctctactgaaaatacaaaaattacccaggcatggtggcaggtgactgtaatcccagctacttcggaggctgaggtgagagaattgcttcaacccagggggcagaggttgctctgagccaagatcatgccattgcactccaacctgggcaacagagcaagattctgtctcaaaaaaaaaaaaaattaaacgtggacatttttgtattgtgttgtgatactctggatctaatttaaaccttgtgttttatctggatttctctgaccctgctgcaatcatcggaaggggacactgccttagtactttcaagtagaagttgaagtccaggtttttcattccacctccattgacactcccgataggaaggtagtcctcattactcctgtgaatggtttaaggttccaacttcccatgtggtctccagtgactctacagggatgggtgccttattaccagtttttgggtatgcatatcatagctttctacttggctttctttgacaccaccctagcaggtgtcacctggcctcatgacaacctctgaagggtagaagtctaggttgtcagtcagtttttgctgctgtgggtgagggttggaccacagtttgctctgcggtgtttggctggagtagagcagttattgtttagcagtttcgtctcttgctaggctgctcctttcccagtcctttggctagagagagcagactttctttgggaattttttggtctacacaggttggtgtttctgccatgctgactgcttcagctccaagtctgagatatatgaggcataaagaaaactcatggaatttatcactgtgtcattccttgggttccagggtccctagcaaatctgccgcctactcttcaccttttagattcttcttaagcttgttttatatgtaatatctaaggattttagttgtacttagtggtgggaatagggaaaagtatgtctattccatttacccactgtgtatggtcttgaatgttgcttatacaaaagcacttgttaccagtaaacatatagtatagtagtggcaattactagatattttattcccatgttaccagaggagaaactgagcacagagcttaagtgccacacatatagtaagtagcagacccaggactacaaaccaagtcttctcattaaaatccatgtgcttggccaggcgtggtggctcacgcctataatcccagcactttgggaggccgaggcaggtagatcacagaggtcaggagatcgagaccatcctggctaacacagcgaaaccccatctctactaaaaatacaaaaaattagccgggtgtggtggcaggcacctgtagttccagctcctcaggagtctgaggcaggagaatggcgtgaaccggggaggtggagcttgcagtgagccgagattgcgccactgcattccagcctgggcgacagagctagactccatctcaaaaaaaaaaaaaaaaaaaaaaaaatccatgttttttccccacattctgtggattaggattctgcctttatttttttaatttttactttttacggatacataatagttgtaaatatttatggagatgtgaaattttgatacaagcatataatgtgtgcttaggatactcatcacctcaaacgtttatcatttctttttgttaggaacattccaattccagtcttgttattttgaagtatacaataaattattgttaactatacttgctctatcttgctaccaaatattagatcttagttcttctaactgtatttttatacccactaaccatcccttctttatacttctcttcccactgtcctttccagtatctgataatcgttattgtttctctatctccatgagttcagtttttttagcttccacatatgagtaagaacatgcagtgtttaaatttctgttcctggcttattttgcttaacataatgtcctccagtaccaaccgtgttgccacgaatggcaggatttcattatttgtatggccgaatagtattccattgttattgttgttttcaagacggagtcttgctctgttaccaagaggtgtagtggtacaatcttggctcactgcagcctcaacctcctaggctcaagcgatcctgccacctcatcctcctgagtagctgggactacagacatgcgccacccggcctggctaattttttgttttattttttgcagaggtgagggctcactatgttgcccaggctcatctcgaactcctgagctcaagtgactttcctgccttggcctcctaaagtgctgggattaaaggcatgagccactgtgcccagccctgaataatattccattgtgtatatgtaccacattttttaaatgcattcatcgattgatggacacttaggttgattctgcatgttggctactataataagcatgggagtgcagatatctcttcaatacattgatttcctttcttttggatatatagccagcagtgggattgctagatcatatggtagttctatttttagttttttgaagaactatcatactgttctctatgggggctgtactaatttacattcctaccaacaatgtgtgagggcttccctttctccacatccttcccagcgtctgttatcacttgtctttttttctgtagatacttagcatattttacaaaaaaaaagaactgaatgccagcatatatgactttgagctccttatatattctagttattaatcccttgtcagatgagtagtttacacatattttctcgcattctgtgagttgtttcttcatgttgttaattgtttcctttgctgtgtcaaagcttttaagcttgatgtgatcccttctgtccgtttttgctttggttgcttgtgcttttgaggtcttgctcaagaaatctttgcccagaccaatgtcctggagcatttcctcaatattttctactaatagttttatagtttcaggtctcatatttaagtccttaatccattttgatttcatttttaaatattgagaaagataggggtctagtttcattcttctgcatatggatatcaagttttcctagaacatttattgaagaaactgcactttttccagtgtatgttcttggcacctttgtcaaaggtgacttctgtcctactttagcatagctagataatttctgtttactatagtccatttgcaaaaaggtagccatttacaaatgtttaaatgacgagattattttaaacttacatagtattgccataattatcctgcagtttaactctttaaaactcaagcaattattaattttctttttaagctatagggtaaccctagcagtttttaaaaatttaaacttcgtaaatatgtttaagtgatttgctatccttgattagtatcttagtccattcaggctgctataacaaagtagccttagctgggtggtttataagcaacagacatttacttctaaaagctctggaggctggcaagtccaagatcaaggcactgacacattcagcgtctggtgattgcccacttcctcatagacaatgtcttccattgtgtcctcacatggttgaagagggaaagaagctcctcagggtttcttttataatgtctctaattataatgtctctaatttatgagtactctgccctcatgacctgataacctcccaaaggacccacctcctaatacggtcactttagggattaggattccaacatgtgaattggggtggtggggcgggctggggcattgtgaggcagaagcatgcagttcattgtaataagatgattctttaaattttctaaaaggtgacttttaaaagtctgctcatggccgggcgcagtggctcatgtctgtaatcccagcactttgggtggccgaggcgggcaggtcacctgaggagtttgagaccagcctggccaacatggtgaaatcccatctctaccaaaaatacaaaaattagctgggcgtggtggtacgtgcctgtaatcccagctactggggcgattgggggtgggggtgggggggtgcggctgaggccggagaattgcttgaacctgggaggcggaggttgcattgggctgagattgtgccactgtactccagcctgggcgacaagagtgaaactctgtctcaaaaaaaaaaaaattttttttaaacaaaaatgaaaatgtatttagtataatttagttcagtaatttatcaaacaattagtatgtgccaagtgcccaagttctgggactgcaaagaaaaaaaagcaaaggcttcctagagaagaaaaagcaaaggcttccttacttctaggacctgactagatagaagtaatccaagagaagaaggtttttcaggtagagggaccactaagagagtagacaaggtggcaaggacatacacagtgtgtgcaaggacactaaaaacagttgggtgttgctggattatcagcaggatgattggaatagaaggctttgaagctggagaggtaagtaagagagaatacctgggctggtaagaacaggggaggggaagatcttcaaaaactggagtccattcaagacttgtttgtagaccatcctaggcagccagggcattattccaacagattatttgagtatttaaataaataattctatatggttcatataaccagatggaaattcattttagtaggtttctattgtggtcctaatcactggattatttcttcgattatattcacagcattaaggagactgttctaaccagttcaaggccagtctcctgagctttttatcattcacattggatcagaacttctcatttggaagcaactcaagtgtccaccaacagataattgaataaacaaaatgtgatatgtgtgtgttcatatatacacacatatacatatcacatatatgctatctggtatacatatatatacacacacgcacacacactggaatactgttcagccttaaaagggaagaaaactttaatacatggacatgctacaacagagatgaaccttgatgacattatgctaaataaaaggagccagacacacacacacacacacacacacacacacacacacacacacgaatactgttcagccttaaaagggaagaaaactttaatacatggacatgatacaacatagatgaaccttgatgacattatgctaaataaaatgagccagtcacaaaaggacaaatactgtatgattctacttatgtgaggtactagagtagtcaaattcagagagacagaaagtctagtgctagttgccaggggctaggggtaggggacaatgagcagctattgtttaatgggtacagagtttcagttttgcaagataaagggttctggacattggtggtaatggtggcaacagcaatgtgaatgtacttaatgccactgagctgtacacttaaaaatgataagatgataaattttgtattctgtacattttatgacagttttttttttttaaacctcacttggtaaaggttagtaattggtcttgctcatatttctaacccaagagaaaagacaggatggaatctccacagccatgaatgattatggaatattctctcagtgacatgtaaggacctgaggcaatgaagttgcacagagctggaagacatgcctgctgcttcgcttaatgaaacaaccttttttttttttttttttttttttttgagacagtctcactctgtcactcaggctggagtgcagtggcacagtcttggcttgctgcagtctccgcctcctaggcgtaagcaattcttgtgccttagcctccagagaagctgggattacaggctgcaccactatgcctggctaatttttttgtattttcaatagagatggggttttgctctgttgaccaggctggtctcgaactcctggcctcaagtgatctacctgcctcagcctcccaaagtgctgggattacagacatgagccactgcgcctggccttaatgaaacacctttgatgttgctttttatctctaggtagaaagggacaatgagatatagtaactttaagcttataagaaatgctgagaaatacaggttcctgagcaggctgttgtctacatccaaattaattttgacaggtgtttatagagcatatactgtatcctttcccttcccaaggtaataaatcagtactcatccctgccttcaaggcatttgcagactagaaagactagaagtctacatgtgaaacagaatgatgcccttatatggagttatccaggcaccaagttgcgtgaaggcaaatgctcttggtgtggaagaagttggaggggcttcctggaataggaggtggacatgtgagttggactcaagagataagggcctaggaaggaatatggtgttcaaaatgagaaagaggtggtgcacatggggtgtggggccagtaaaattccatccagagtggaggaatctgtagcagaaagcaggaagttttgaaagttcagagctggggggaatattttataattcccagtaaatgccttagatggtaggatgacatttactgataaagagcatcactaactcagtgagtctttccctcacagatggccacttcttcagtgtgaaatgtcagtgtatattgacaatgtttatgttcagaaaacctctcagtatttcaaaggccttagggtcattaagcaaatgacttaattcttttaattcactgaggccacttctttgtctgtaaaattagactaatgcttcttatttcactgggtttgcacatttatcagaataacatgtgaaaaaaatcttagcacagtgtctagtccagagtattaagtactgggggaggtggcatagggatgatgttgacttacatttattaacctattcataggaactctgaacatgagcatgggtgccttcacatccctttcaaatttgagccatacctggaatgtacaatgtcagaacataactgaaattctcaagctgggtagcacatcaaattttagggagttaatttttcctgaaaggaacagctcaaggatctgccagtctcatggaagggaaattaaaccacacagggatttgtctgaagctatgactttggccagtcgctgggaaataggtgtgtgctgggggatgtaaagatcaatatgtgagatcctggggccaatgtttgagaatggtttaaaatgcaaaaacttctcagtaagtggtaacccttcaaaggttagctcagattgcctaccctgcaggatcctccaaagggagccgccttctgggcttgcttccatgacacttttttcatctctaattcgccattctcacattgggctatcagtctccctttgctagattatgagccctttgcttgagactgtaagcagcttggtgcaggcttgatgccacttgtaaggcagcagctatcatcaaggtaatttcagaagtcgctgatattctttacaactaattacccctctaacccatttttatgctggcttcttatttatttacttgctgtcagagtagtgagtgagttccttaggatccttcaaagtgatcaattagggtattttttagtatcattataagctcacatgtttaaacatattccatgcatttgaatctgttagagttgttatccttattgaaagtcagattgtcctatctttaaccagcaggagcctattcgagttgatttctggatccttttgacttgaccctactagtctttgataatttctttgttctctggtatgacaagatgttccaagtttatcttgtacattttctgacccagacctggaattagctagccatttcctcagagtcctggtttcttctagtaaaagtggtatgccaaaatccatgatgggcactaagggtgctaattgctattgctgttattttggccacacgctcattttttacatggttataaccaacatcagttatcactttattttttttattataacattgtgaattttttcacttatatctacatagtattttttccaatttttaattatgaaaaatttcagtcatacacaaaagtaaagaatactgatgcacacaatttcaaatcttatcaagatttcatcacatttcatctatctgtttttctgtttctttgctggaatatttaaagcaaatactagacatgtacataagtcttataaatatcacgtaagtgaatgtaccacacctgtgtgcacattcccccagttaaacatttgttacttccagttattcactgttgtatacagtgcaggcctgtcatgtcatataggtggcatgtctgagagtttcacccatgttcatgagccataacatttaggtgtcattaactattaccacagttcactgcgaagattttctcgggtagacagcgtgtctttccttagtgtgcattggaagaacatgccaattggagttctgctgacttgcaagagcaggggaaagtgctaagttttacgtatagtatcatgaggattgttgaaatgagtttgttgatcttttcatataatttcctagaggaaaacattgagtataggccagggatgtgtgtgtgtgtgtgtgtgtagctattcacaggcaggaccatagcacactacagcctcaaactcctgagctcaagtgctcctctcacttagcctcctgaatagctgggactataggtgcaccactgtgcctggatttacttttttggataccaacagagactataacttattgaggctaaaacctgttagaggtccacttgaagatactgtcattaacagatagtaagtatctacagtgtacataagtatctacagtgtacatagtattcccctcaaagtttatagtcttggtggggaagcagcttgaatgtagaatgtactgccaggcagtacatactacacaaatgacaaagaccagtgccataggagtccggaagagattggtctagtgtggtcagtgaggttagtgtcataagacctatgtttagattttacttgtgggtaatctgccatttcacctctgtgccctcatttcctcatatgttcttaggactaatttcacttgccaccttgtggcagtctttcctgcaccatccacctcatcagaatgaattatgaagctccttcctctagttcacctgtgtcaccgtcaggccttagtaccactcagtaactgttggtttacgctgtgcttcccctaaaatggtagcttttccaatgcaccatgccctttgttcatgttcttgtagccttggtacctaaagcacagtaagttattggttcattagtgctttatatgcttttaagttttgaacaaatattactcaggattggttatattgccttggcgaaaaaaagagtttgaactggaattgaattgaaaatgtgatttggttttgggttttttttgtttgtttgttttgcaacaggttttgggaactttcatagtatacgctattaaacatggaatttttttgttaatacttgttttattcacaataaagtaattataaacacacatcacaaaaataatattaataaatagcacttgtaatactcctgtcaagcctaaacattaatattttagagtatttcctagtctctttttcctgtatttatatgtgctatgtatattttacaaaatgaaggtgaggctgtttcaccctttgtgtgctttaagttaatatattgaaaatatttccctggccgggtgcagtggctcacgcctgtgatctcagcactttgggaggctgaggtgggtggatcacctgaggtcaggagttggagagcagcctgaccaacacagagaaatcccatctctactaaaaatacaagattagtcgggcacagtggcacatgcctgtaatctcagctgctcgggtggctgaggcaggagaatcgcttgaacccgggaggcggaggttgcggtgacctgagagcactccagcctggacaacaagagtgaaactctgcctcaaaaaaaagaaaaaagaaaaaatatttccgcatcacaaaatagtcatctacaacataggtttttaatggccacagagtttctcaagcatgtgtaataaggacactttaaacatatatttgtactggttcttgctgttgaattaaattattttaattatttctttaccaaaatttgtataaacaaaaactgtgaggtgtaaacatgttcttatagctctcccacaattatatatgaaaacaaatttacaaattcaatttaaaacttcagaatccatataattcacgttaacaacagtagatattttgctgaaactaaattggtgattcagatgtgaatatagcacttctttgatgcctgtctgtcctgtgtcccatacttttttcctaccacatttctttgtttgaactacggtgaaactttgctttgtgtagcaaggcattggcttttaattggtatgaccacattatttataagctgtcacctctgtcctttctgattagtcattagtatatgaaaattaaggaacttactacttgatatctgtaagattttaaatgcaaatgctggcaatcaaggatcagcattcacctgcaagatgattcaggtagtcgatactatgcttatattttttaagaagataatgcttgagttgaaaactcaagattgaaaaaagaaatgtgtactggctttgcagatccctaaggatatgttggatgctattttgaaaaatcctcatgtaatcataaaaagcatgagctctgaggttagtcctggattggaatccaaactaaacctcccatatgctttgtgggtgtgggcaagtttcttaatctttctgagctttaatctcctagtctgtaaaatagagataatggcaaccttagcctgttaattgaatagttttcgcttagaggggtgcaaacatgaacaattgtgtttttctccagtcagaactcccaactgctctgtccaaatctcccttctcctctcaaggacagatgataccttaggcagagttcacaacctcctggtcacactgggttactgaaagttgaccatttgaaaagttcagtatatctaattgaaaggtttacttactcctgttactctaaccaggcttgtggctattgggatatgaagtgggaaaaggtagacttggttggtttgtttttgagatggagacttgctgttgcccgggctggaatgcagtggcatgatctgagctcactgcaacctctgccccctgggttcaagtgattcccctgcctcagccttctttgtagctgtgattacaggcatgtgccaccacacacagctaatttttgtacttttagtagagacacggtttcaccgtgttggccaggatggtctcgaacttctgacctgatgtgatccgcctgccttggcctcccaaagtgctgggattacaggcgtgagccgccgcgcctggcctggttgattttttttactcctcttccccattcttcaccttggagagtgtaggggtgggaggagatacagtctctctctgatatttcttccctggcccttctggtctccagtcattccagtgcccagttgcccagtgtgtaaaatgagcaagagggcgagggacaaggatacgagtctcttcactggctgctcttgagtcctcctagatggcatttacaggttgcctgtctagcactgtctgtgggtccactccccattgttgtgagttctttggagggtgggcttcctcaccgcatgatctccagacctggagaagaaactggtatttagttcttttcgtctctttcaggacatcctcactcttctctggtaccacctggccctggtccacttgcttattgggcagccgttttgggtggggaactggcaagagggcttaagaccagcaatttctatggactgtatgacccagggaagacatatctgtgccaaacagtggggtaacagcagtgctgctccttcttgctcagtttctccttcctctgtccagattggtgcaggccaaatctgtaagtcgactgcctgatcagatattcacaagacattacactttttaaaagttattaccccaaaccttttcttttcttttttcttttttggtacccctagtctctgtaactgatgatcttggagcccaccgtggggtagggagaggaccaccccaaaatacagcacattatagtaggtcagggaatccaagatttcccctcttatctctgctcttcttttgtggactgtggagggagagggacagtgcaggagcacatggttggggtagaagatctcatagtatagcttcttttttgttttttggtgttttttttgagatggagtcttgctctgtcacccaggctggaatgcagtggcacgatctcggctaactgcaacctccgcctcctgggttcacgccattctcctgcctcagcctcccaagtagctgggactagagatgcgtgccaccacgcccagcaaattttttatatttttagtagacatggggtttcaccatgttggccaagatggtcttgatctcttgacctcatgatctgcctgccacggcctcccaaagtgctgggattacgggcgtgagccaccacgcctggcccatagtatggcttcttaataaattctttaattagcctggcaccagttattgactgctgtctttaccttgtggggaactcacctcctctctgtctttagttgtgagttctatttaccaattgtggggcaactgaaaaagtcacattcaacattctcttacataactaccttatggatttctgtggtattaaatatgataatgccaggcacattgtaaacactctataaataagtggtaactgttacaattattgcagtgccaaatttatttgattcttctgttcttggatattttagtccttaactattttccgctattttataatagataatgctgtgatgatctttagagcaaagacttttatccttaggatgaatttctgcaaaagagggtctgattcaaagggtataattatttgtaaggctttttgatgcatcataccaaattggctctcagaaaggatagttttggcttccctgattcttctttgatattagacattttaattttttaatacttgataatttgataggtgaaaaaatagttgttttgatttggatttctttgattgctactgagtttgaatatattttcatgtattattggctcatattttaaatgacttgttcaaatgcaaggtgctttttgatacactttattcgtgtaattgggaaaactgtgtgacttcaggcattgtaataagggaacttggaataactagagcgggggaatctccagcagtagggagggaaaagattgacctgacctgatgttcctgttaactcagcagctcccttttgagacctttgcagttgtgattccatagatttcccccaggcagccttttgatctttactcagtttcaaggcctgcctcaaatgtcacatggtttgtgatacttcctgatatcctcctgaaggagatttatcttccctcaacatcctgcctctctgcagctcctatgatgttgcagcgtgactgtgtttttagtctcttctcttaattatggggacttctcaaggatagtcatctttcttttctaacctggtgtttggcacataggtacagaagcaagagataagacggtggaaagtgttgcaagaaagtagaatagggtgattaactccacttggagtggggcagtgtcagaggctgcagagaaaattataattgagctgggatgtgaagagtgaacaggagttcatctacagatggaaaagtaacatttcaaataatgagaacagtttaaaggcctaaagatgtgagctcatgaatgtcgaggtaaggtgtgtggatggagagggatgaagaacaaggttcaagtgagtctctctgttctccccagtacccccatcttcattacctttgcccaccgtggtctctgctctgtccagagtatcttctctctcccctgcctcctcagactctatcgatcattccacaaagttactgaatacctattatgtacttgcatcaagagaaagaggcaaaaatgggttcatggacaacttggaatggcatcataggaatgttagccccatcctgaaaagccaagcagagtagtgccttacccatattccttttcgactgcactgattgttcctaacaactgaaatgttttctattgtagcatctgtagataaaatagataacaatcaaaagagttacagtttatttagtcccttgtgatgggacagtggtttctttctaactaggcttaggcaaagaaaatacagttttcttcttcttcttcttttttttttttgttcgagaaggagtcttgctctgtcacccaggctatggtgcagtggcagaatctcagctcactgcaacctctgcctcctgggttcaagcaattctcctacctcagcctcctgagtagctgggattacaggtgcgcaccaccacgctcagctaattttttgtatttttagtagagacagggtttcaccatgttagccaggctggtctcactcctgacttcgtgatccgcccacctcggcctcctaaagtgctggaattacaggcatgagctactgcacccaggcagttttcatattttctatagctgtctgcttctctgtcagtttccatctttgttccagtttctttggcttcacgatacatctttggtcatgattaaagcatgcccaaaagttaatgccataaggtaaccattttattttactcacagattgtgtgggtcaggaattcagagagggcatggcaggaacttgattctgctccccaatatctggggccccaactgggaaggcttgaatggctcagagtgacttgactgctaggaactggaatcctccgaaagcatcacttacatacctgtcaccagggctgggatgactcaaaggctctgctcagctgcagttgttgatgagagcacctaccagtggcctttacatggagcccaggcttcctctcatggcagtctctaagcaatcagactgcttacatggtgcttaagggctccaagagtgaatgtcttagtggccaagatgaagatgtcatggccttttttagtgacctagccttagaagtcacatagtgttactttggccatacttcattgattgaaggagtcacaagtccactcagattcatggaaagggaacatagacttccaacctcttggtagatggagtatcaaagaatttgtggtcattttaatttttattttatttatttattttttaatttagagacagggtctctgtcacccaggctgttgtgcagtggtatgatctcgtctcattgcagcctcaacctcccgggctcaagcgattctcccaactcagcctcctggacagctgggaccacaggtgcatggcaccacatccagctaatttttctgtattttgtagagatggtgttgcactattttgcccaggctggccattttttaaaactgccacaataacatttatttttcaggataaagtctcctttgaatcttttcaaaggtcagcttcctaatcagggctctttgagtaaatacttccgctttcatagtaccgcccacttccctatttctgctggaaatcttacttggtcaaggcagggatttcatctgcgttattgatctccagatcctcatcaatctagaacagtgtctggcaaaccgttgatgtttaatacatatcacggattatgtaatgcttactatgtatctgtgtgagagagaagaggatatctacattggtatctgtggaattttctacttcagtgtctaatttctgatgtattcctgagtcacctgttgagacttattctgtctttcggagtgatgtgcatgaacccattattggaggagatcgcggtattggacatctgtctcaaagtctctatacactgagaactgcttgtcccaaccataggcctctataggtccaccagtctcttagcaatttctttatatatatctatatatgctggagtgcaatggcaccatcttgacttgctgcaacctccgcctccctggttcaagtgattcttgtgcatcagcctcccgagtagctaggattacaggcacctgccaccatactcagctaatttttattttcttttttgtagatacgggatctcactatgtttctcaggctggtctcaaactcctgggctcaagtgatcctcctgccttggcttcccaaaggaacaagtctttttatgagactgtttaaggcctctgtataagttgggttgacctagtgagaaatcctttgtttatagcttgctggtgtgggctataaagcaatagcctcgccaagcctggtttcatttatttcaaaccctttgtaaaccaagggaacagatgcaaattatctccttattttcatgaacttccatatcaaggttttttgttaactgaatttgtgattggtgagctttgagccagtgagtactattttcttttgttactgcacgtggcgtgtgtagtgttaacataaactgtactctaaagctgcctggtcctgaactactgaatttatgtggtggtagatacaaaaggatctatattatgctgaaaagaacaaagtattatcttatccatgtacaaaattattatgcaacaaatgcctaaaattcctgctgtgtgcaagaacttcagctaggcattgcgagagagaaaggtataacaaaagaatgatagtaaactgatgatattggtaacttgtggggatttgactggcaggggtggtaaaaggggcttcaactttatggtgtctcaattctgttttgaaaataacagctttgttgggatgtaattcacataccataaaagtcaccatttaaaagtgtacatattcagtgttttcagtatatttatgcagttgtacagccatcaccactattttcagaacattcttacctgaaaagaaaaccacggccgggcgcggtggctcacgcctgtaatccagcactttgggaagccgaggtgggtggatcacctgaggttgggagttcgagaccagtctgaccaacatggagaaaccctgtctctattaaaaatacaaaaaattagctgggtgtggtggcacatgcctgtaatcccagctacttgggaggctgaggcaaaagaatcacatcaacccgggaggcggaggttgcagtgagccgagattgtgccattgcactccttcctgggcaacgagcaaaactctgtctcaaaaaaaaaaaaaaggaaaaccacatgcttttctgtcattctctaaaagaaaaggtagaaaaggacatggagttgttcttcatgtcaatctcagatgtttctcccaaagtaaaatgtcatttttcctgttgtgatctcagaacatgttgattgagactctatcttggcacttaatacattctgccaagaaactaggagcatgaatacctctcctctgccagcttaggaggaccctgggagcaaagactaggtcttgtgctaattttaccacctgttgagtaaatgcttaatatgtactcattaaatatcagtttgaattctattgacatccttagacttttcaggtagatttctaggagaaagatcttttctgaccaatacatccctagttcatttctccgttgggtggagtttctcattcttctgtttctacccaaagaagtatgatttaaagtaaggtaagggttaactttctttctcgctctagttctcagtctctttctctctctttttaacaaaacaaaaataagcaggactgatggtgggaatagaatcattgcatttgcttattttgaagttatgttctctaaggatatccatagctctgagggcaaaaggttggtagagaacatttggataaagacaagagaaattatgttctgggactatattgtgagccccatctataaacaatatgatgccaggcacagtggctcacacctgtaatcccagctttttgggaggctgaggcaggaggatcacttgagcccacgagttcgagatcagcctagacaacatagcaagacactgtctctacaaaaaattcttaaaaatagctggatgtggtggcacatccctgtagtcccagctactcaggaggctgaggtaggaggattgcccaagcccaggaagttgaggctgcagtgacgtgtgatcatgccactgcactccaccctagacaacagagcgagaccctgtcgcaaaaaaacaatgtggaggccaggcacagtggctcatgtttgtgatcttagcacgttgggaggctgaggcagctggatctcttgaagtctggacttcaggaccagtctggccaacaaggcaaaaaaaccccgtctctactgaaaaatagaaaaattagcgggtgtggtggtgcatgcctatagtcccagctacttggaaggctgaggcacaagaatcgcttgaagccaggaaacagattgcagtgggccaagatcgtgccatgcactccagcctggactctgtctaaaaaaaaaaaaaatacggagtcataatttattatgcatattatatacatattgagcacttactatatagagtactgtcctgtgcatttcttatgtattagttaaccttcacttttattttctccattttgtggataagaaactaaaggacagggtatttaggaaaattgcaaaagatgtctccattagaaaataaaagaaccacattttgaccccaagcaatcttcctctagtgcctggttggtgtctccatataaaataaactgaatttgaatcctggctctactatttagtaggaatatagctttggataagtcatctaatctctttgagcctcactttctacatgaggtagttggcagattgtgagtaaagctccttagtccattgtgattcccttctgtcatttatttgtggatttttcttgctaactctgtacagtctgacagcaggatatgtgagtgatggcagatttcaactatttgttatgtaatgattaagcagttctacacatccttttctatcgtgttaacaaatttgtttctcaacccactgagagaccactgttactgtggacttaattctgacccattggtagagattttggtaatataaacttgatgagaacttgataacgtgatggtcagtttagcttgttagcagtgaagagcaagaacatcgtaccctagactttagaaatgcgtatttcagaaagtgtctgaaaaccttgaccaatgctagtacatctagagaagatgacagcccaagggatcatgtgggaagcatgccagataaggagtagttggagcctcagaggtcatacagtgtgaggaaaagaagagttttaaaaagaaagaaaagaaaaagaagatattccattgtggggggctcacacggaatctaaagtagaaggactgcttcagcctagcagctctaggctacagtgagctatgacctagccactgtactccagcctgggtgacaaagtgagtccccacctcattcattgattgattgattcattcattcattattttggtaacaacgttttgtttaatgtctaaatctaacaaaacatgtcattttgatttaaaagtacaattttatgaaataataaatatatagaaggcttggccaacatttataaaccagatgtaaatccgtgccttccaacttccttgacatcacattgtctcttcgtaagagatagtcactttggccagtagggaagacaggaaaaccaataacatgagtaaacaatttacatcttgcctggccctgactgcggtcattactctaagccacatgccttactttgctctgacacttcaggatgttccctcctggtattagctgtgcaccaaggctaagaggtcacagggccctccttgccattctcaataaatcagttttggaaaacctccaggccttcttgcagagtattcaggcatatagggttgtagctgatcagccataaggacaggcctccctttaggccctgcagcagtgtagcaccagtttgaaagcctccatccagtgcacataatgaaagtcagaaaaagaccttcattacttatgtgtactttctacaaagaaacagatacctggatgagggccaagactgcctccttcatcattccattttgtgttgtctgtgttgacagagtcagcaagagaagagatatcaagtgcttgcagggtccctaggtctgtccttgtagccagaccttcccttgctacttgtaattccttgacagaagacattgtggtagtgggtactcaggaaagaagcaactagaatggggcacttctcccagggcaaacactgaatcctctttctgttataaagttccctgagtcctgggtttgattgttcacatagatagaatgatagctattgaaactgtccctaacttagtaattctctctgaactcccttgagagggcccaggtactcttaccttccatctctcctgacaaagaataaagaatgagtctaagagtcttgaccatcatatatctcaggcactgactggggatggggaagctttgaataaccagatacatacgtatagatagacaggtaaagatatctcatagctacactttcatttttttattaataaaatactaattatgtatcagtcttgtgctaggcatgaaagatgcaatgctgaataagacaggttagataacttttgtgaagcataatatgtacccctcccaaatgttctgttgatgacagattcctatcattgggtgcctcataattttgtattctttcatcacatctaaaatcaatctctacatggtaactttcctcagtttggagacattggacatgcttcccatcttctgtggagtttctggtgtctaagaaggctcaactgcctactaaagtttctcctgcatatgctacaagtataaggctgctcacctgtgtgagttctctggtatttaataaggttggatttgtgaatgaatattttcccacattcatgacatttaaagggcttctctcctgtgtgaattctttggtgtgtttgtagatttgtgtcataactaatgcttttcccataccatgagcatctatatgggtttattccttgatgtgtcatgaagtgcttattaagacctgaactccatctaaacctcctgtcacattgttgacatttatagagtttctcttcagtgtgaattctctggtgcttaataagatctgagctaactctgaagattttcccacagtcctgacatttaaaaggtttctctcctgtgtggcctttcccgtgaagatccataagttttggaagctcttgtttacaagttgtaagtttcttttcttccttggaaaagcttgatgccatttctataccctgtgtgtatcaccatgattttccctgtcctttgttttctgggcaattttcattctggtcttttttgatactttgtatcctgctgtttgtatttcaggtgcagaaaccgatattataggatagtcatttccattgtcattttttagctttaaccctagagagatggcagtctcatagatatcctgcattacatcattgtagagagtcttctcaagaggacctaataattgccattcttcctcagagaagtacacagccatgtcttcaaatgtcaataaactctgggactcaggccagatgagcttaggtgccatcttccagtctttggtgcttttgtgctcagaaagggctaaaatctgttgaacatgcacagctctttcatatacaggctgggtttctttctgagtattccagcccagctgttcttgtagtaccctgtatgtgttccagtattctttctagaacagacccattggttcgagctctgctggcttccacttgaagcctggggccactgttgttcctctcaagagcactgcctcctctcccagctcatgggctgtgacctcattctttgttccaccaggttctctctgcaagcgttccaccaggaccagggcctgtttggcaagctgtggatgatgcttctgcacccagttctgggtcccctttggcaggatggtcaggaagtgctctagtaccagcatttccaaaatgtgcttttttgagtggatctctggcctcagccactgatggcacaatttctgaagttggttgatagcctcaagcggttcagttgcttcatgataatggaagctccggaagtgcctgcaagcactcccaggactgagacactcgatttgtgtgctgtatttcttactctgactggagttctctttcacagacctgttggtctcccacatagctcccatatgagagttcaagcatgcatctgccttcagctctctcattatcatttgctctaggaagagttttactcctgtgtgtgacattcacacccatctggtgccacctttgaggtgcatcaggtttggtacattttggtacaaaatgagagtgcaggtttggtacaaaatcaatgaatagatcttcccaagaacacttcagtcagctctggcttccctggaggcccctttcctctttctttgctcaactatgcctctgtcgccacgctgctgctctgggcagtgaagctctctgctcctgcaccactgaaaagcaatgtcaggaaagccagcaatgtcacgaaagcccgcaatgcctggcgagtaaagttccaagattttgggagccttggaaagggccttggaagatcatttctcccattcaatccctccacctcccagagaccttaccctgactcactactcctgggacgaggtctgtggccattcatttaattaattgagacacggtctggctctgttgcccagactggagtgcaggggcatgatctcagcttactgcaacctctgcctcctgggctgaagccatcctcccacctcagcctctcgagtagctggcattacaggcgcacaccaccacacctggctaatttttgtatttttttttttttttttttggagagacagggttttgccatgttgcccaggctggtctcaaactcctgggctcaaatgattttgtccacctcgcctcccaaagtattaggattacatacgtgagccaccacacacggctgagaccccacgtcttaaaaaaaaagaaaaagacattgtcgtagctatgccattccttgtgtttcagtgtttgaattaatgaattttttatcttatgcctacttttcatggaaatggtagtattctctacttgccagtcatgacttgcagccttttctggaagattatttcatttctgttttttcttttttgagacggagttttgctcttgttgcccagtctggagtgcaatggcatggtctcagctcactgcaacctctgcctcccaggttcaagcgattcttctgcctcagcctcccaagtagctgggactacaggcatgtgccaccatgcccagctaattttgtgttactggtagagacaaggttttgccatgttggtcaggctcgtcttgaattcctgacctcaggtgatccacctgccttggcctcccaaagtgccaggattacaggcgtgagccaccacacccggctggaagactgtttctaaagtcagacaaaggatagactaaatgtgttttctgagaaacgttagtctagggaatctgagaggccagaacctctatcatgagtaaaagaatcatggctcataatctctagttttcatctcatactgttgacttctaatcgagttccttgttttagtaacaaataaaataaatgttttctgctctcaaatctacagggactttattaaaattggaggaacaacatttgacagtcttttgaacgtttagaaaaataggatttattgtggctaagtctaaaaggtctcatgattacaattgactgaaaaggaaggaatgcattgctttccatgcgtggtgacttaattttatgtgcagtactatgcaatacacagagacttacctaactgctgttcttggagggtctattaggcattaaagtgtaagtatccctattgttatttacactaggaaaaaaagcatacctcaggtctttgagaatccaggaaagctttgttttagaatattgctccagcacttgcagtgagccgagatcccgccactgcactccagcctgggcgacagagcgagactctgtctcaaaaaaaaaaaaataataataaaaaaaagaatattgctccagcagaagggggggccaaggaattgtaggcttttattgagtgcctacaggatgcctctcactggggatgtaaatgatacagtccttggccttcaggagccaggtgtagaaggaaatcaatcaacggttaactgagagccactgagatgctgcaattccgacataaacaaagtgccatgagagcacagaggagggtacagctaattgattgggaatattcagagaaggcttcagggcttggttccatcagccaggtctggagggatcagtaaaacttggactagaagaagagaacaaaggtcttttagccaaagggaacaacttgtaaaacttgttactgacacgctggaatgatgagaatggagctgatatatgagaagtggtgggattagcatggccaagttatgaagattctcatatgctaaggagttagagctcttattctttaagcagcaaggaactgcgaagttaagtgtgtaggttttaatggcctgacctcacatatgtgatacagccacctctggttctctgattaaataatttgagaaacaatccatactatatttctttttcatggtgactctatatgtacataactacattggaggctctgaaatgataaactcatttaatgtgcttaacacagggtcaaatgtgctcaaacatggaacctttttttttttatctatttaccttttagtttttagtaacatgtttaggagatctgatatagggaaaggaggaagagggagaaacaggcttctagggaaataaaagaagaaccttttttaccagtctagcagtatttggctgtagcaggtgggaggaggaagagccatttcttaaatctaaagacagctctgtactgggagtgaggaggtctaagttcttactctgccttagctgttaaataagctgtgtgcccttggctagttcactacttttttgagactcatctctcaagacacagataaatactgcttgaccacaggttagttggagtctgtgttaagtgctttatatgtattagctcattaaatcctcaaatcaaacctaaagttagattcccatttcaaagataagaaaagtgaggaattgagagattaaagaagctattcaagaccaccttctagtaaatgagatggatgggagatgggacattttcagtggaagaaacaacttaaaggcacagaagtgaaaaggagcaggtgatcttcaaggaataatgtgtataatttggtattgtcaaccttaaatagtgagattcagaaaatacgattaagtagagtctatttgagtacaaagcttaagtatggccacctgggagacactgactccaaatgaatggggtcagagtttcaaagtagagaagataaggtttcacttacataggcagagacacagaaattttaacaggattacaacatttcccatacaagaccagtgcatacgttacagtgatttgactggttacagattcctacattccaaggaagattactccatgaggagggacaacgttctgagatggtcttatctctggcgccatttggtcttaattacggggtggggggtttgggggtggggaatgggggcagaagttgcagctgcatgacatgtgactcaggctgcatagccacattcctcccaaggctccgaataatttaaagttccaatagctttcagtttgaattatttaatttcacagtgtgtagtggacttggaagtgtgataggagacaagagtggaaaatgtagatttaggcaatgttatagaggcctttgaatgctgtgttttatttgcattttattctacagctattagggagtctttgtcatcccaattttcaaatgaggccttagaaatgttctcattcctgtaatcccagcactttgggaggccgaggcaggcggatcacgcggtcaagagattgagaccatcctggccaacgtggtgaaacccctgtctctactaaaaatacaaaaattagctgggcatggtggcacgcacctgtagtcccagctacttgggaggctgaggcagaatcacttgaacccgggaggcggaggttgcagtgagctgagatcacaccactgcatttcagcctggcgacagagcgagacttcgtctcaaaaaaaaaaaaagttctcattcaatgtcattcacaattattttatattccactaagcaggggaataaataccttattgaaagagtgcttgtagacttatgcggacatggatttatagtccggcactctcttgcatacacaaaaaagaaaagtataaatgaaacattggtaaagaaatttctaaaactacttcataatcaattctagctttcaatcactttttaattcattgtccatatttgcctacataataactgccctgcatgccatcaagagtattgatggtgcaacatttcttaaaaatgattcaacattgtcttcaaatttttctttcaggttactgacacgtattttgcaagtttcaactttggcactttcttggtcttactagaagatcttagcaaaaagtctcacaactactgaaattcatgtttctccttaaaatggcccttgatttatttgttcagggttgtatttgttcagtcacaatgacagacatgacaaccaagtacactcttgtgcaggcaatgacagctgtgtcctgactgcagcttaactgtaagacactctcaacagtaggaaacattctgattttgatgttaaaatagaactgaatttgaattaatgaaatatagtagcttgttgaaaatcataggatggtgaaggtatcaggacccatttgctcactgttatcagtccagccagtaggaaatctgtcttgtcggtcaactgtgtgagaaaaccctttcctaaaaagaagctttaccttatctatttccctgttattttgaatttacacttactaaggaggaaaccaaggcaagaaagacagccaaggacattttaattgactcaagagatacttacttttaaccaagtcttttatgttctggaaagtgccttgagatcttttaataatcttgccaaatcagcatttcaatttggtactcaggatgagtgattagaagtcatgacaaatcagctagcttctctgtggagaatagctgaagcctctggagaaccacagtcttaaattagtctgaagaagcgtgaggtcacaacaggaagtaatgtgaacaggaggagttactgatcagatggttcagagagctggatgatcttaataacttgattccaattttccttgtatgtaacgaacacttattgattgcttctcttaaattcatctcctttctccttccttgcaacaccttaatttgtgttcagacatctgtgtgattctggggaagctggctccatctatcctaagcttcaggtttggctagttagcacattgcattccctcagccaccatgattattttggattgggcatgtgatctaagcaggtatagtctgagtgtattctagttggtatggtaagtggatataaggcctctattctgccatatgatttggttaaatataagaagtgtctatggggcacagtggctcgtggttataatcccaactacttgggagatggaggcaggaggattgcttgaggccaggagttcaagacaagcctgagcattaagactcctgtttcaaagaaacaaaacaaaagaacaaaaagaaaaaagtgactatgaatcctgtactctgatcctaggcttacaaagaagttcacaccatcacagatatgcagtcagggtgaagggagaaagagagaaccaatgccttcacatcagggttgctatgagaattgaatgggatcttgactgtaaagcaccttgcagaaaagtctgacataaaatataaattcatgttttaaggacttttggaattgctaatgacaaaaaccaactcaggtaaatttaagcaagaaatagaaatgtaatggtatgataataaggaagctcagaaaatggaagaaaattttctagataccaggcgaccttgggcacacaatcatattttaatggcccaagggcgctcattgtatctcatactgcttgtctgtgtttggctttcttttttcctgtaggcaagctgtctataggtgataagaaaggagatcactggcaaccctcagtcctctcatctctgtaacctaaaaggcaaggtccttacttttagaactccaaatttaaaatcctagggaaggatactgacagttggggccataattctacccctggactgagccattatggccagggaattggaaactacggtagtcagactagagctacctgtgcctcacctgacactcacgtggtaggtgtggagagggatgagtgacagcttcgctcagaatcatgtttgcatctcgtggaaagcaatttcctccatgagaaagggaagcagtgctggatagtaaaacaagtatccagttattcagtacttgctttttgtctgaagcagattcatcctccttatctctggcagggtggagggaaaataagaaagtaggagagagagtgaagtgtaaattttattgtgtacttaactacgtagtaagtaaactttgcaggtatgagccgattgcatctcatttaatctttgctacaatactgtgcgatagataatattctcatgtcagccagaaacaagctcaagttaagaaactagcccaggaccatataaagctgagtccacttgtctccaaagcataataggcttttctgctgctaccacgttcttcaaaataaagtgagttaaacttgcctggtcaacatgccggtcccctgtactccctgctaccgactcaatgtttgtgtccccccaaaaccatgtattgaaattctgatccccagtgtgatagaatttggagatggggcctttgggaaaattgagtcatgagagtagagccctcatgatgggattagtgtctttataagaagtgaacacacacaagagaacttccatccagtcgcctttttctgccatgtgaggacacagcaagaaggcagccctctgtaaagctggaaaagggccgtcaccagacactggacctactagttccttcatcctggacttcccagcctccagaactgtgagaaatgtctgtgtattaggctgttcttgcagtgctagaaataaatacctgagactggataatttaaaatgaaaatagatttaattggtttacagttctgcaggctttaccagaagcatgttgctggcatctgctcagcttctggtgaagcctcagggagctttcagtcatggcaggagatgaaaggggaagaggcacatcacacagcgaaagcaggggcaagcttgagagagtcggggtggcaggaggtgccatacacttttaaatgaacagctcttacaagactcacagcaccaagccatgagggatccactcccatgatctaaacaccttccaccaagccccacctcccgtactaaggattacaattcagcatgagatttgggcggggacaaatatcccaactgtcagtctgttgtttaagtcacctagtctatggtaatttgttatagcagcccaggctgattaagacacttccctagtcacagtctcggtgcccccctccaactctccctcatcatgagcctagattagaacttgaaacctaggttgtccagacttttatggttattcttgccttatcctacagtaaacaaaggatgtattccccaacttttaatcagaacagaatgtgtgaaaacacatttccaagtttcacatatactgaacacaaccttttacttaaaagatgaaaaagctgtagcaagagctggctggtctgtatttgaatcccattacttactaactaggcaagtattctgtgtctcaattttttcatccttaaagtgaggctaatgatggaacctatctcatagggcttgttgtgaagattgagtgagttaatacataaagtgcttagaatagtatctggtacacagcaagtactgtctcagtgttagctctttattagaagtattgttattcatcattaatgggctcttcttattaatgccaaaacaggcagactttgcttagggaatcttcattttgctccttgagttcacatctgggatgtaggtacttagctctcaaagagagctgactacaatctaaggcaaaaataaactatttgtagtccaggaagttctaaggaagaaacagtctccctgcctatctggtcctgttcgtatacatatgattaacatttcccccatatttcccctctaattatacttacgttctgatcttttgcacatgcaagtttaaataaacttccctctgttagactatgggaaacagttaaatctggaatgcacagagctgctgtatccaaagtactgcaggtgatttggcagaagggtggtataaggagtaggatggtctgagcacatctggcaggcaccagaagccaatggagagtctgtgtatgaagcttctgaatgaaatggaatatagtttcctctgtgaggagctaggacaacgtggtccccaaggaaaatctgaagagcactctgtaacttattagtcagtgagtcaaagagggaaaatggaaggctatatcactgactatgtaagctttataaattttgaggtgttcgggccttttctctgcctctctagttcagctcagattactacctgattctagaatgggatctaaaactcagttgtaatgggtaaatctcaagatgtatccatttacttctatatcagtgggcatattgggaactatacctctagattgctgatcagttgatgtatctgtctctaattttaccatatatttgctgtaccaataaatgcctttttaatgttaaacattttccaacaaatatttccaccatgtctttgccactgaaaagacattttatatcaggaagagccttagatttttcaaactgtgtatggatcaaaaagtactttaattaagctgtgcccagactaaaaaaaatacaaacaaaaaaaccccatttcaaaatgaaagtgaatagttgtggcctttgattttaaaaaatctcacaagatagactgagactattttgtagtagtagtagtttaattcaaatacccaaatattagcagggcatagtggcatgcatctgtagtcccagctacttgggaggctgaggcgggaggattgcttgagcccaggagttctaggctgcagtgagctatgattgtgcaattgcactctagtgtgggtgacagagcaagaccctgcctctaaagaaaatacaaaataaataaacgaaatatacaaagattgcaaagtgtgcagtttgtggtcttccctttaccaatgtacctgtgtgtgaaatagaattttcgttacatgctacaattaaaataatatttcaatagacttgatgctgttcttgatttgaagatccaatttagcaactgcattctggcatttattcccctccttacccatccaccttgttttatgcatagaataaacccataaaatgttctttcttagttcttagtttcctggtgtgtctatccacccattagaataatgggtctgtcttttacatttctgtaaaactgtgtgccattatattacttactaaattgtattttaatttaatgtatataatttctgtccaactccaataaaatatcaaacccttaaagatagggatagtattcatctttgtatttttagcattcagcgtaatgaccagcatataatagacattctgcaaatatttgaatcattattttatacattaagaaatggatgatgagtaaggtgtaacaacttcactaacttatctagtcagtagcagaattggcactaggactagaccccgggacttcaggttcccccccgggtaacccccaagtctttcctttgttgtaggggtttgttgacatggacaataaggtcctacatagacatagttttataatgagttcagaaatggctcgacaaaagtgaaacctgtgacaaataccggattatttgtattgtagaccttggtcttaataattttgtttttcttcgagggttgatggcaggtcatgagatttgagagacacacacagtagtcaactgtatggaaaatactgaggaagtgtgttttcggattacaaaactaaactgggatcaacttggactttttcagtcaagctgttagaatgtgtgtctaaagttggcctgcttatcatgtgttataatataatattggtttggtcagaccctctgatttgtcaaatccttgccaaaaatgggtcccatagaaggcaacctgggattagaatgcttttcaatgtaaagtctcaggtttccagggtaaaccatcttcacttagcagaactaattcctttaacaagcatttgttgattccaactgtgtgtcgggtactgtgctagcctggagcagcaaagaaggataaaaagaaccttgttttagaggagctattaagtcagattctgtccccaaactgaacagctacacaaagaggtgatttctgtttgaggggtttgtgtgatcatctaacaacaaaggagctgggaaccaagaaagttgggtcaataataacaatgactacattaatccagtatcatgccaggttctattctaagcaatttacatgtattacttaagtatttgtttacatttgcggaagttttccttgtcccgggcccattcaatgtgttatttttatctctacgtttagaaactttgaccttttttgttttgtggcttgtcccttatttgatttaaaaagtcattatatggccaggcgtggtggctcacgcctgtaatcccagcactttgggaggccaaggtgggcagatcacctgaggtcagtagtccaagaccagcctgaccagcaaggagaaactcccatctctactaaaatacaaaattagccgggtgtggtgatgcatgcctgtaatcccagctactccagaggctgaggcaggagaatcgctttaaccctgaggcggaggttgcagtgagctgagattccgccattgcactccagcctgggcaacaaaagtgaaactccatctcaaaaaaaaaaaaaaaaaagtcattataatcacctagtagctttagatatgactctatatataatgtatagaacagagaagagttgtttgctccataaacatgtacaattatttgtcaaaagagaaatacaagttattcatattagtattcacagtcttccctttagtttctcaccgactcagtgtatctaccaagattcccttggtaatatctgtccctcaggtagtctgcttgcccagtggtaagtctttctagggtggaaggattctttcttactgggtcttcttccaggactctacttctttctaataggctgaatggagcgaaaatgtaaaaatagggaagacacgctgaatcttcttaataaagaatttttaagataaaggggaaaggggagaatgcaaatttgaaactggttttgaaggttgggagtggggtaggttggtgaatgagagacccttgagcaactatattatatgagagaattgattaagagataaaaagtgtgttacgattttgatttcttctcgtatccattgaggaaagcatgtaaagactggaattactgttttttcacttttgattgttggactttctacccaggacagccacttagattgctggggtttattcaggttatacataccatgcctctctattttaactggctttttgtccctttccttgctcagcagtttttctgcaagtagctgataaatcaggaattcttaaattcttttaaagggtttttcctgaaagataagtttttttagagaagtagagtgggcctagggaataataccaaccttagatgtggaacctctaggggctggtcaaatgtatttggcacacttactctttactatgtcatcaacaagacttggatgtctttcctatttactgcctttgtcgttggagctacgattcacatctgttccagaggtcatggaaactcttcatctctcagcatttctagtgggtatccttggcaggcttaaagcagagtcaggagggtgagagctcagagagaggctaaggtgaaagcactttgtaaacttatagaggatggtattttgtacaaagcctggcacacagcagacattcagtaaaaatgcatagaattaaaagaaaaggaaaaaaagcagataccttttactcatagcagtaatctctcttctgctccccctaccttggtcaggataagagtgccttgtgacatggattaacaccatacgagtaatagtttatattatttaatctcatttcttaaactagccctacaaaatatagtatgattttgattttatgtttatgggaatgaaggttttagagggtctatgtcacttgcccaaatattacccttgtaataagagatggaactgggattggaatgtaaatgtgtctagcttcaaaaccttttatttattttttttctacctttctggccggtacagctgtcagactatgtttagaagtctcatgggtccttcaagtgactttactaatggtcttatgaaaagctgtctcccctgagaattggtgtttgacgttcttggttcattcagcaaatgtgtgcttagccccagctataagcatgaactgtactagacagcaaaggtggacaccaaagaaataatcccatcctcatggagctgccagtgtagtgagtgatcataaatataaacaatgttgggcagagtgatgttagcagtataacgtgaggttgtcctggaggaacacggaagagggattgaatgagggaaggaaaagaatcagcccctcttatgtaagaggcagcactatgtctgccagagcctaacatctcttttagccaccttagctcatttaatcttcactataaccatgtaatatcctgattatacagatcagcaacctacttggcgtttcacaacaaggagcagatggataggattttcaatctcagaactgtctggctgcaagtccctgcccttttcattagactactgagtatagactaagtataggtttttcctaatgtatgttttttaaatacatgatagttaaagttctattctgtatacaagggtatgcgttgtgtgagactcagtgtgtctatcgagatgcccttggttctgtctgcacctcaggcagtctgcttgctcagtggtgagtcttcagatgttgctgcttttgccacgttttctaacagtgctggctgtctcatcttccctctgtgagggtggggctctggtttggtctctgttaagtccattgtggagagaactacagcaactcatgtgcctaagccccatttggccagaccctggcctctcctaccactttcaagttcaaacgtggggtgtgttcttccccagtgactgtccagagtggctgggtaaacacagcctggaagtagggagtgagggcagttgacatcactgaccagagcagttggaagctggagaagggaaggagccagcagacaaattgcttcgtgtctgcctgcctttctcctccatttaccccttacacacacacacacacacacatacacacacacacgcacacacacatacaatattagtagttccatacaacccatcctgtaaccttctaaatgagcagttgtctgtgttttcatgctaagccgtagcgggtttgttgatgcatatagccttggtttcctttccctcctattctttcctaccagtctttccccactctctgctctgagattgcaacacatgataaacaggtaagctttgctccagactgttttctagaacctgggcacaatagtagtcaataaaaaacatcttgcccatcacagacccttgccctgtttgccctgttttataccttgttatttttcacttagcataaatcaggtaatatttgaatactaccatatgattaatgtgcaccaaaatcctgtgagataaaataaaccatgagtgtagttccgtatttgcatatataggtcaattgtattttcttttcttttttttttttttttttgagacggagtctcgctctgtcgcccaggctggagtgcagtggcgggatctcagctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccagtattttcttttttaaaggaaagattattgcttttgttaaaatggtacatgttcgttataaatcaagaaatgctaaaacaaacaaacaaaaaaccccacgccagatgccatcatctggtgataacctttaggtgaataacgttctgggggcgctcatgaagctcagcttttctcattatctttatagtagtgtccgagtatactactgtaatttaaccaacctgaccagttgataagcagttacagtattttatttacttaaaaaatgtgctgaaatgaccatccttataaatgcctttggattttttaaacttgttggtatgtaagatatatttctccccctgaaaatttttattcagatactaccttgtgaccaacacacctgttttgcagatgaaagactctgggccaaagcaaaactaatagcaagataatctgcccttaggcgactcttctaatgagaaagaatgggaacacaaaacactgtataagggatgcaagtttcacatcccagattttggtaaccaaaagaaaccataggccacacagctgatcagaggtatatttgagctattccattacattttagattttaactttgctacagtaagtcatggctcaaatacagtagaggcactgattgatcattaagtttatatacactgtaaactaacccagttaaaaggcaacagcaccatattttgaagacagggtgaccaagtttctaatgcaatgattgccattgattaatacaatgaactggagaccagcagggatgataaattttcctggcattgagaattacttatctgactttttttttttttttttttgagacagggtctctgtcactctgtcacccaggctggagtgcagtggtacaatcattgctcactgcagccttgacctcctgggctcaagtgatcctcccacctcagcctcctgagtagctgggactacaggcacatgccaccatgcccgtaaatataaatttatttaataagtaaatttattaattttaaacaaattaaaaaattttttaatttttaaaaaatttgtttgtagcgatggggtctcgctgtgtttcccaggctggtctcaaactcctagcctcaagcaattctcccacctcagcctcccaaagtgctggggttataggcatgagccgccatgcctggacttatctgactttaaagatgcttttctggggtctgaagttgaagatttaaacctatagagtttatttttgctgtcttgtcttttttttttcagtttgttaacatgctgtgtagttctgttacaaacatatgtagtgaaagaccagcttttattagggttaattgttccttttctcatttggtatgcactagtatttagtgaaattcttccttcgtgtagtatgctttgtttctatttttattaaaacatttgtttgtattgtgactatttgtgtagtaatttatatatttaatttgtagcttgcttttcagccatcagtactgtatttcagtgacttctgcacaaacgtgatttaactataggaaatttttttgtccaggataatttacataaagtccctcacttgagaatttcaggtgacagaagtttactatatttctaaatagcaagcctattatagagtagatcagaattaatcatattcatgaacagtattaatctgttgaataatcaaaccatcaaggcagatgcattggttgagttgctgttcatggacttcctggttgaacaaaatggtcttgccattcttagcaaagaaatacctcagcatgtggcaactcatggatgtggccagtaagtgctgtgagaagtgaacaaagaatagaaaattaagcactgacagccgggcgcagtggctcacgcctgtaatcccagcactttgggaggccgaggcgggcggatcacgaggtcaggagattgagaccatcttggctaacacggtgaaaccccgtctctactaaaaatacaaaaaattagccgggcgcagtggcgggtgccggtagtcccagctactcgggaggctgaggcaggagaatggcgtgaatccgggaggcggagcttgcagtgagcagagatagcgccactgcctggggggaagagcaagactccgtctcaaaaaaaaaaaaaaaaaaaaagaaaaagaaaattaagcactgacatattctgagatgttttctgaaggagctcaggctaaatgctctcacctccttaatactggctgagaggctggatcttctgcctgcagcccagtagcacttggtttataacactatatgaagtgactgcatctctaagccaaaaatcatgatacatgttctaagacagattatagactggtatctttagcctgaattccatctataaagtgttttgcttggcctgcagtgttttaaacacttttaattagtcgtagattgttaaaagctgagatctcttacataaaatccgtaaaatgtccagcttccagatctgggaacactgggcccaaatttctgcctagcagcaattagctggaactgggtggtagctttccatttaagccaaagcatatgctttctagtctgctgtatcacatgcacgcacgcacacatacatgcacacaccagtcactcatatatgtacctacctgaccctttacacttccagaccatatgcccttcgaaggcaggatttttgtctgttttgttcattgcttttttctcatgaccagaatgttgtctggcacaaagtaggttaaaggatattgctagatggaggaagaatgtatttgtgactcttggtccaagttgatgggggaaaagaaaacagaagttttcaatttggagctcctccagatatttgagctatgttcccctttacccctgagatactgtatggctcaggaatataccttagtatcataattttgtatatgacttatctcccttgctagatggtaaattcattgggttcagggacctgtcttgtatttttttgcatccttaagaataccttgcacataatggaagcttaaatactccttggatggttagtgggtttttaaaatttctcatgtaactttgtgaataaagatggggagattctaatgaatatgttgttctggaggatcatttgagaagcaaccatttgagttgcttctccactatattttctccaagccctatccccaattacattctattcgccatcatagtctggatggggaatagaatgtaattggggatagggcttggagaaaatatagtgaatatagaaggtttttgataatccttaacccctgctctttggtagcagggtaaattaaccccccatcctcactttgtgcatattctattttagtactcatcttttttttttttttttttttttttgagatggagtcttgctctgtcgcccagcctggaatacagtggtgtgatctcagtttactgcaacctccacctcctgggttcaagcaattctcctgcctcagcctcccaagtagctgggactacagacatgcaccactgtacctggctaatttttgtatttttagtagagacggaaatctaatttcgccatgttggccaggctggccttgaactcctgacctcaggtgatccacctgcctcggcctcccaaagtgctgggattacaggcgtgagccactgtgcccagcctattttagtactcatcatattatgttaaagagcttgtctcctacactggactgtgatttccctatcattaagaactcggtatggtttttgtgcatctaacagctaatacttgataatgtttgtgtgccaactctgtataaacactattctaggaactcagtaaatgtttgcattgaattgagtttgtgttaggagttgtattagaactctacaccaccttatagtttataaaacatatgtatattcattgtcttatttaattttgaaatcaactgagtgctgcaaatgagaaaaatcaaagcccagagaaaactgtaactggtccataattacacagcagttaatggctgaacatccaggctgaactttgccagttagtggctgaatattcacgaaattctgatgcctccatagagcgggatagaattatggaggacttgtcattctggactgcggaatttggacctgtgtattgaaacaagaagagaaagggaagtgtttcttaagttatttttggatgaaggctttttgcgatccaaggcttcatcccctcaagctcaacaatagcattccttgggggagtgagaagatgatgaatggtcatcagtttgcttgcctcacccagattccattcctacctcccagaattttccctggtcccacccagctccacagtaacaatcaatcccaatcagtgactgtacttcattttttggatcaaggaatacccctcccttttctgtcttcctccttagggctttggataggagccctttaattgatgttgactaaactggaggccagcccctgcataccaggaatgccagtggctttgttagttgaggagggcgctgcattagcactgccctctaaatcccagagcaggtggaggaaatctaattagcatttagtaagccaaggtgccctggggagtttctgataaagaaaaggtcactgcagaaggagaagggacactgatagggagacttcattttcctagtgggaactttctgaaatggactggcaatcaggtgagctggattctaatgcctgccttactggtggctttttaatcacacttaagtccctctgcttatctgagatttcattttcttgtctgtgtctagtccgttaccagactccttttcctacacaaatatttgtttcataacagtggaagggacctcagatcattaagttgctatcaccttggggtgacaggtacactaaaatctcagaagtcaccactaaagatcttattcatgtaaccaaataacacctgttccccaaaaccctgttgaaataaaaaaaatgactgcagccattcccacccttgtatttcaagcatagcattgccacctacttgcaaaatactatatagacgtatatatatatatttttaaaaaggtgctattacctgggaagcttttcccaacattacatatgtccaaatctcactctgtatctactgaatcttctgatatcagtagatatgtagtaaatatgtatagtttggggaaaatttctcaggaaagtttgataaaatccctggtttatgcttttttgaagaacttaaacacatatagcaaactcaaggcctatcacagcatttgctatcatagttgttagtaatatgtttggagaggaatttggggggatggctattaagtgagaagctagaggtagaataaccactgcaagcaataagcattttacaaaatggggattgagctctattcgtaggtgatgaaatcaatggtaatgagttgctaccagtattttcaaagtaaaatagtatacaaaaagtagcatgtattgtgtccagttaaggatatttattgaaacttttaagttcattgtatttatagatactgtgctacaatttaaaagacatttcttactgaatttttgtcaaaatccattgacctagataggaatctgtattggagtaaagatggttctaaggggaaggagtgtagagaagcaatgtgggagccacatgcggtggttcatgcctatattctcagtactttgggaggcggaggtgggaggatagcttgaggccaggaattccagaagcaatgtggaaaggacactagggaatgtaggttctagtctttatccaagctctttgacttcaagcaaatcacatttttctcctggaccttacattcttttttctcattgcccttagtaccttctgtctgacttcaaccccacatctgcttgacaagaattaactcaaatatctcttcttaacacctacctgattctggcatacagtaagtgcttataaatatatgttaaatgggtgagaacctttcccttaggtctgtgggtactttcactgggcttgtatatctaccactccatttaaaactctacttacagctttttaagaaaatgtatttctaagccaggcacagtggctcatgcctacatttccagcagtttgggaggctgaggtgggtggattttgtgcttggaaattcgagaccagtctaggcaacgtggcaaaaccccatctctacaaaaaatacaaaaattagcagggtcatagtagtgcgtgcctatagtcccaactacttgggaggctgaagtgagaggattgcctaagcctgggaggtgaagactgcagtgagctgtgggtgtcccactgcacttcagccttggcaacaaagtgagaccctgtctcaaaaaaaaaaaaaaaagaaaatatatttctatttatcttttactaggttgtggtcccctggaaagcagacatttttattcatctgtgtattctcagtacttaacacagtacctggtatgtaataggtgcttcatagatgttggagagaatacatatttttaagaggagtattttagtagatgactcataaaacatttattgagcacctactatataccaggcagtgtggtaggtatgggaagtgatacaaatgtgtgtaagagaccaacatcttcccttgaggaatttagagattaattgaagcataagcacacagaattgctgacaaagccattagtgttagtctctagctatgtggttgcttatgcagctcatgtgtaacttctcatttctgtgtttgaatactggtcaccagaaccagacaggaagaatgtctttccgttctgattaattttcttaggaattaagtaagaaattgtgtatctgatatggtgatctagttccaaggaaggttaacttgagttggcaaaaggagcctcatcttttttatattagttactgggaggttgtttaaaaatctcccattatgtaatggacttgtcactttctacttatagtaatggcaattcttgctttatatatttcgaggccatattactaggtacacatactttttagaagtacatgacttctgggcctttgaacctcttatctttgtgaagtgcctgaccctctttgcctttttaccttaatatctttttttgcttggtagtcatatacctgcagcagcattcttttgagtaatgtatatgctttatgtaattttttccatcctttgatttcaacctacctgtgctcttgtattttaggtgtatctttaaaaaacagtatgtagctagattatgtttttgtttagtctggaaagtctttcttttaacttgagaatttagttaattcacatttattgtggttaatacagtgagacaggctttatcttttaaatggtgaattaaattgatttacatttattgtgattatggaaatgttttgatttgttgcaaccgtgtagtgttgtaccttaccttacactgaaattttctgttgttttttttaatcttaccttttggattgaacattttgtttcctttttctaatttcctttttatccctctgcttatttggaagttacactctaactacttcattagaagttactctaggtattttattatgcatacttattaaaatgtttaaatttaatagataatacatgcacatggcttaaacacaaaatatttgaaaagtatactgtgagaagtctcttctctatccttctgccaccatctgctcatttctaataacctggtgtatttatctttataatgtatgttggcctgttaacatattagatatgttagaatatatctaatagagattataaatacgcatacaaatacgtattaactcctccatttatacaaataaaggacaactttctctatacttgctttttttttttttacttcataatatatcttgatgctctttccatattgatacatgaacagttttcttccccatgcctttttaaaaagcagctgagtggtagtacatcaattggtgaaggcataactaagtctttactgatgagcatttacattgttttcaatattactcttttaaatagatcccaaaatgcacatatgtcattgtgcacatgttagtttatctctaggataagtttctggcattgcctggttaaaggatatatactcttacacttttggtagattatatgtaattttgccacattgctctccagagggtttgtaactatttacactcctgcctctttttccacagtcttgccaagatgattaccaaagttctgtatgtttgccagtctaatgagagaaaagtaatatttaagtgtatttttaatttgtattccttttgtaagtcaacattgatcttttcacatgtttaaaaatcatttatagttatttgtctgtgaacatttgcttatttttctgcagggttaatgttcttactgatttgtaggagctctttatgtaggagattagccctttgtaataggaattgtgaattttagcgaaatatttatgacttctaacccaagttaccatttttttccttgctttgtccataggcatttgtgtgggtgtgggggggtgtgtccgtgttgccatgcaggatttgaaaatagttttcatttttagatttataggtttctgtgtagtcactataacaatcattgttatggtttctggattttaggtaatagactttccctcttataggctataaaagaaatgtactatgttttataatttcattttatattacatttaaatctgatccagttggaatttttcctgatctatgcttagaggtacaggttcaactttgtttcagctttatttttaacagtgtcattaaatctttcccatggatttgaggtgctacttctatcataatctaagcattttatgcattagtaaccatttgtgaactcactaagtattaaattccattagtctgtatacttataaaatatatatagcaatacgctttgttttgattaatgaggtgtgttttaccatatggttgtaatagtgtcctctgctattcttgtttttctttatgaactttacaattgtattctcttatttagaacaaatatggtgggttttttgttgttgttgttgttgttgtttttctttgagacgaagttttgctctgttgcccaggttggactgcagtgacaagatcttggctcactgcaactgccgcctcctaagttcaagcgattctccagcctcagcctcctgagtagctgggattaacagggacatgctaccacccccagctaatttttgtatttttagtacagacaggttttcgccatgttggccaggctggtctcaaactcctgacctcaggcgatccacctgcctcagcctcccaaagtgctgtgattacaggcatgagccaccacacctggccaaaaaaatggtgtttttactgagtttatgttaaattaataaattcatttagggagatttgagctctttatcagcacatacattttaattttttaatttggcctaaagtatagcagtatatttactctctgtattagtttcttttttctttcctcctcctcttcttcttttttttttttttaaatacagaaacagggcttcgtcatattgtccaggctggtctcaagtactgtgccagctttggcctcccaaaatgctaggatcacaggcttgagctatcatgccaggcccttagtagtttcttgtagttgctgtaacaaatgactacaaatttgttggcttaagacaatagagatttatcgtcttacagttcaggagagaataaatccaggtgttacagcgctgtgttccttctgaaagcactggggaaaatcttttgcctcttttggcttccggtggctccagatgttccttggttcatggttgcatcactccaatctctgcccatggtcacactgtctcttcctcctctctcttctgtccctctgtctgttcttcctctatctctgtcttatatggatacatatgattacatttagagtttccctgaattctccaagagaagtgctgcctatgaatattatcttatatggcctaagggtctgagacctttaacttaatcacattttatgtcatataaggtaatattcacaggttccagggattaggacatgggcatatcttttgggaagggaccattcaacgcactacacccttcttccaaatcatgtaagaatcttagcatacctaaacttgaatcactcctcctaacttatgttattgttggccggtattttctatcttatttatttatacccacttaaaataatattcttgttttacactggaagtgttcagatttcccatgtatttatcaatatctgtgctcgtctttgttttcttttatgtcagaccttccatctgggattatttttcttcctaaagtatatcctttagaattgcctttagtgagagtctgtctgtggcaatttctgtttttttgtctgaaaatatctttattttgcattcattgagtttgaatggctattgacttctgcattgaaagttattttttcttagcacattgaaaaattattctgtgatcttctagatttcactgttgctgttcaggagttagctgatagtctaattgccattcttctgcaggtgatctcttgtttctcttttaatgtcttcttttttgtctttggtattcaatttcattaccatatgtggtttctatttatcctgcttgacatttgtttagcttactggatatgcggtttggtattctttcaatggttctgaaaacataccagccaaaggcaggcatagaataatactccatcctctcttatttaattattgaacttcagttacaagattagatatatgttagaccctcttactctatcatccacgtctcttaaactctgattttttcatatctttagttcttggtcacattctatggaatttctttggattgctcttccagttgactaactctttagctctatttaatctgtttaacttgaccatggactttttcatttcaattgtaattttcatttttggacattcagtttggtttgttttcaaaagtatttagttcttttttatactctcgtttgctaattttttcaagcttctcttctaaatcttaaaaattttatattctgtctctaattccaacatgtgaagtctttgaagatacgattctgtcatcagtttttcctggctgtcattcattatggtattatggcttatttccatatatgtttttgttttacttttaacagcaagtgttccttaggactttacctgtggaagctatttgaggcctaggttaaacatttattctaccagaatggattagaggctgctgcctccagtagcctcaggacattattaatcctggactacttttagatcttcacttgaagtatcatgaatttgatcacaaacttgcattagagccagattttgattacagacttttaggaaagacattacttcttttttttttttttggtcactttattattattattattattattattattattattatattttaagttctagggtacatgtgcacaacatgcaggtttgttacatatgtgtacatgtgtcatgttggtgtgctgcacccattaacttgtcgtttacattaggtatatctcctaatgctatccctctcccctccccccaccccacaacaggccccggtgtgtgatgttccccttcctgtgtccaagtgttctcattgttcaattcccacctatgagtgagaacatgcggtgtttggttttttgtccctgcaatagttgactgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccgcaataaacatacatgtacatgtgtctttatagcagcaagatttataatcctttgggtatatacccagtaatgggatggctggatcaaatggtatttctagttctagatccttgaggaattgccacagtgtcttccacaatggttgaaccagtttacagccccaccaacagtgtaaaagtgttcctatttctccacatcctctccagcacctgttgtttcctgactttttaatgatcaccattctaactggtgtgagatggtatctcattgtggttttgatttgcatttgtctggccagtgatgatgagcattttttcatgtgtctgttggctgcataaatgtcttttgagaagtgtctgttggctgcataaatatcttcttttgagaagtgtctgttcatatccttcgcccagtttttgatggggttgtttgtttttttcttgtaaatttgtttgagttctttgtagattctggatattagccctttgtcagatgagtagattgcaaaaattttctcccattctgtaggttgcctgttcattctgatggtagtgtcttttgctgtacagaagctctttagtttagttagatcccatttgtcaattttggcttttgttgccattgcttttggaaccaaaagacattacttcttttctagtggtcaagacaggtcagtttttttatggttcctttcagtgctgtagatgtattgcccacacttgaaacagtcatcacaattgtcactagtgtttgttacataaataacctcagggcaaaaaatggttttagtgctctctttctttccagaatttctgctttcacttattttttttattgtggtgaatgaaacatatataacatcaaaattatttttaagtgaacaattcagtggcattaaatacattcacattgttgcatgaccatcaccaccatccatctccagaacttctcatcttacaaaactggaactgtgtacccattaaacagaaactccctattaccccctactcaccaacccctaatccctggcaaccattgttctactttttgtccttatgaatttgattctaggtatgttatataaatgggatcatacagtatttgtccttttgtgaccagcttatttcacttagcgtaagtcttcaaaattcatccatattgtaacatttcagaatgccattccttttaaggctgaaatcatattccattgtatctataaaccacattttttaatccactctttgtcagtgaatattcaggttgcttccacctgctttcatttaacttttgttctctacagattccttacttcttgacagcatgactcattttcaaaattactatttaagaatattttatttagcttttaagttgttttctttgggagtgtcattcatggtatctaggctaacttaattgctcaaaaccaaagtcttatacctactataggtggaccagaagacaaccagaaagaacataatttgactttcttttgggatgctaaaaagggaagattctgagatatgaaacaattaatatgtagttttgcatgttttgattcttgaggtctgctataggtaatatttttttccttgcatgtgagaaaaccttaagaatactataagaaaacataaacatttctgtcttgcaggatttggcattgttaccatgttgttagtactaacctctcaccctcaagtgccccaatatccagtagtagcatttgaaacttgtacagagataacaaaatcataaactgcttgagctgaaggggtctaatttctaaacatcaccccttccaccactgtgtcttttttttttttttctttttttttgagatggagtcttgctctttcacccaggctagagtgcagtgacatgatcttggcttactgcaaccaccacttcccaggttccagtgattctcctgcttcagcctcctgagtagctgggattacaggcacacaccaccacacccagctaatttttgtatttttattagagacgggctttcaccatgttggccagtctggtcttgaactcctgacctcaagtgatccacctgcctcggccttccaaagggctgggattacaggcatgagccacgagccaccacacccagccactgtgtcttaaagatgagttggctaaggttaagtgactgacccagccagggtcctataaggagtttgtgacatcaagaacctcagttgcctcattttaatctcagtatacttggtacttctgtgtactttctctctctgagaagacctgtgatcatttaatgagttctgagcttggtcttttttttttttttttttttttttaagtgagacagggtctctctctgtttcccaggctgaagagcggtggcgcaatcatagctcactatagcctcggactcctgggctcaagtgatgttactgtctcagcctcttaaagcactgggattacaggcatgcgccatcatgccccgcctgagcttggtctcttgaaatgttgctgtggatgttgataaagatgacctgacactgatacatgggtcagagtagaggcaagaattctcatctggttaactggtgaagatcaaatagagttggccttccaaatactatttcactcctgtctctcctgttcatggaatcttttttgataacagaaggttacagttgggtgggagagctcttgtgatcattcgtgccaatctcaaattgcccacagggacgttttgggatcccctgcccagaaactttgctgttgtttatagatgaggaaactgaaacctaaaagatgtaaatatggtttccctcaagtcacataaagtgcttttagcaaagccagaactggacccacatctcctaatccctattcccgtggaggatctctattacactaatgcattaacttcactcctgatctttaagtaagctccacgtctgtggtctctgttttaagattgtgaaatgtcataaaggtggtttgcctttgaaaataagccagaacctagagagttaatagaaattgaacagtgaaagtggagtccttttcttctctcctcaactggggagccgccaggctgtttcacttgcaccgcatgtgttccattatggtataatgatgtaattaccagtaatgctgctgctgcttgagtagtggtgaagaggcagcattaaggaaaagactagccccagttctctcctaagagccatttcagcccacttcagtctattagattgaagatgctggaaggcgaatggcttcagcacaggaaaaggtcagatttaaaagcttttctgggtttggtatttattgttgcttttttgaccttcagaaaagtcccctgtgtgtttgtccttgattcttgcctttcccattaatgcttgaaagctgtattgctgtccagaccaggtctttggcatagatgatttcctttgtggtgttagagaaagcctagcccccactccagatgaccagtcctgttgtcgttcatgccaccattgcagtgtcaaaagcctttttaactcttgaacattttagttttcagcaattctgtatgtatatatatataatatatatgtcatatatgatacaatacatatgatatgatacagtacagtacatatggtctgtactagtatcacatattctttcacaaacttgcctagatctaaacaatttatgaattaatactttaaaatacagagaagtaagcaataagacttgagtgccttgagcaaacctttctgtgaatctctttcaaaacgtacagcctgccacctgatgattatgaggaggtaatcatggtctctggaacacagtagacacttccaaaagtgttcctttattagagggtagccatcattctttcaataataagcacctgctgggcccaaggtacaggttataggaagacagcaagttttccttatttcagtagttctcaaagtgccatccctggaccaacagcaccaacatcacgtaagatcccctgagaaatgcaaattctcaggcccccaagccagagctactgaatcacaaattctaggctgggagccttcagtctgtgttttaccaagctttccggtgattctgatgcatactgaagtttgagaaccacttctttattttgtagttcagtaccaggagttatctgataatataaaataccttatgtttatctagagctgcactgtccaatacagtagtcattagccataggcagttatttaaattttaataaaaccaagttatctagagctgcactgtccaatacagtagtcattagccataggcagttatttaaattttaataaattaaaaccaagtaaaattaaaaattcagtttctgagttgtactagccacaagtgctcagtagacatatgttgctagtggaaaccatactggacagcacagatgtaaacatttctattatcacaggaagttctattgaataatgctgggctcaaagcagtggtcctcagattttatcatgaatcgtatcattagtctgtaaaatatacattgttgggccccatccccagtttctcccagtgtttctttttatttgagacaaagtctcactcttttacccaggctggagtgcaatggcacaatcttggctcactgcaacctccgctttctgggttcaagtgattctcctgcctcagcctcccgagtagctgggattacaggtacacaccaccatgcccagctaatttttgtgtttttagtacagacgaggtttcaccatgttggccaggctggtctgcaactcctgatctcaagtgatccgcccacctcagcctcccaaagtgctgggattacaggtgcatgccaccactcctggctcccattcccagagattgtgattcagtagatctggggtagggctggagaagatacacgtgtaacaagctcctagatgatgctcatgctgctggtatggggaccactttttgaggactactggtcttgcataaggattcttgatctgaagtctgtgaaccttaaaaaattataggcaaaatactctatgtacccatataatagaggttgcaggatataggactcacagttttaatctgattatcaagtgggtcagcaggtcaggagaacttttagctgcagttaacagagaatctgactaatagtgacttaaatcacaaggactttgatattcatttagcaaagtaagaggctggaagtttcagcattctttcagtggctcaagcatgtcaccaggaaaatcaggcactttccctcagaaaaccccttatgttttttttggctagcaataggtcacatgcccacctctagatcattcccatcaatgaggaatgggatttgtataattgcttttgattcagcccctggggcaaagggaggggatttaccttccctgataacatcagatctccaccagtcctctgaacaaaatatgaattctgtaacaagggtgaagggagaaatggctatttggtctctcagtgagtgacccaaaaagtgttaggagtgtctggtctgcatcctttcagcttatcacatgctttcaacttgctaggcaagcagggcacagacacgccgagctgtgaagccctgctgagctctgtcctctagtgccttatgacgggttctgtgaagtcatcctgcatgtaacggggatgacgtggtatgagatttaagagcctgatccaggcttctgggagtcggcatcaagtcagccttaaagctagtccccgtctgactttggcccccagttgttttgtgtggttgtgtgtttttgtttgtttgtttgagacggagtctcagtcctgttgcccaggctggagtgcaatggcgccatctcggcttactgcagcctccgcctcccggattcaagtgattctcctgcctcagcctcccaagtatctgggattaaaggtgcccaccaccacacttggctaattttttgtatttttagtagaggcggggtttcaccgtgctgcccagctggtcttgaactcctgacctcaagtgatccttccacttcggcctcccaaagtgctggtattacaggtgtgagccactgcgctcgacctggccccccaattctttttagaattggctcttgcttggttccttttggtcaagtccctgtcaaagtacaagtttttgtactttgattctttaaagactcccattattcttttctctcaccagtctccttggaattagagtcctggtcctggatttggggaccaaacacttggaattctgctgccagacttccagttccctatctacttacctagctccctgcttgtcttctcccagcagtatgctttagatgcttggctttcagtagggagatagtgtctaaaaatgtacaatgtgagactatttcacgtagaaatggtaaatgaagcactgggagttaatgagattattgaaggagaagatgtgagaacgaaagctcataccacccctctactgaatcaaatgaagggcatggtcatttgtgtgttcatctgtactctccacaagtaccatgaatcccaggctgagaatcaacaaagaccttataaacaaagacccagggccacctgggaatccagagaggtgcctgatgaaagggatgacagtagctcagctggcagagctctctgcctgcatcccctgccccctagagcagttctgcttttacttctatgttatgcttctatacgaaatcttgtatgtagaaataaataattccacttattaaaaaaaaaaaaggccactgggtaaatgatgccgaaggccccttctaatactgagaatgggctcaagggctagaatacaggtactaggctatgacatgtgaaacagaagtgtagtcctgtcgtattttaggagaaggaactctggctcccttgttctctgcatggttttgagctgacagttgcctcggtcaacagctggatacagtacccaattgtttgcagcaaaagtcctgcgagtctgtttcctctaaaaagcttcttccacgacttccttcccccatcctcccaggacagaagtggacacaagggggaatgtttcagttcccctgtcgggttgtgtgtcttcctctcaaaccactgttcaaaatgtctagggaatttttattttccaaagttgcttaccggaaacaacttggcagagcatagtttggggaggaggctttagttcaatgagcacaaaagcacatgttcctgtggtgaattcttaacgtgtgtgaaggggaagcaaaggagctttagtaaaattgcagttcaggctaagtcaggaatggaaatgaggaacaaccagaaaacatcacagtttgttttagagcatttagttcctaactctcaatgacacacactcaggcttatggctgaatttcagattatccttgtatatactttttagaagtttttatttggtatcataatttatagtgtaacaatgaaaagtcgcctggctttataacagatttcagaaagtgaaacttggtttctgaggaataaacaggcagcagagcaatcctcaaagaggaagtgcatgagaaactgagggtttagggagattatatttggttagaaacgctgggcctttgttaaaagttgaaaaacctgatcactccagtctttggaggttctgagggagagcatgtcttgccagagtctcacggatgattagagttaatcccggcacccaggcctctttacttttcctctgcagtgtgggttcccctcctgagctacccgctagagcctagtttcccagggtttctctctctggtctgtttttgcagctcaagccatgttctccttgatctgttggccaggcttcaggggagatggactacagctggtctgaaataggaagacggtaaatttacttaaactttcagcatgacccatttgcctaacttttttttcaatgtgatgaatgaaaatatagacaacagaatgtttcacaagacagccaactcaaagagaataagaatgaggacgtgtgcaatttgcttttacctttaaaaagaagcatattacagaacctcttgattgtctttcttttttttttctttttttcttttttttacctctgtcatctgtgatccattcgcctgttcagccaagatattttggcatttttactctgggaaaccagtgggtgggtgaacatggaggagccaaaagttaacaaaataccagcaaatgctggagccaagtgagaggattctcctctgctccagaagcagaggtgtaccccacctcccactctcccaagctgctttgaaaaaggctgctaaaactcaccgacttaaaaaaaattttttaaaagaaaaaaaactccctgacttgagaggatttctcagtcctgatgaaggaaatctctagcagctcttcttgtccctaggctatcagggcttttcctttctgaggatgccctaagcactgtagggaataatagcattcgaaggtaagtttatctggtctgatgccagcatacattgttgaatccaaatctaccatttaccatcggggtgactttcaatgagttctttaaactttctgagcctgttgtctcatctgtaatagagataatagtgcctacctcatcaaaagtgttagaattaagtaagatgatttgtaacttagtaccagacacctcattaataatcaaatgttttttgcaataccactcattttctcaccaacttctatacagcttcctgttttcccagtgatcgtgagatatgggaggtagtagcttgctaacttgtttccagtggcagcaggagtggcaaaggaaattacttttttccttatcaacttcaaaggataatttacacacagtgaactatatctgtgtacatttaatgagtctcataggtgtctgtccgtactcatgaaacaagtactacattgaagatgtagaacattggcatcatccccaaaagattcctcttgcccctttgcagtctttcccttcctttgcccttagccccaggcaagcactcctctgttctttgtcactctaaattagtttgcattttataggagtacagtatgtacactttttgtgcagcttatttcactcagcatagtgatttctggatgtgtccatgttgttgcatgtatccatgttattgctgagtagtattccattgtgtggatataccacctattgatggacattgggttctttcttgtttctggctcttttaaataaagctgatatgaacattcacttggaaatctttctgtggagcatacattttcatttctcccaggtatacccagcagttgaatggctcagtcatatggtagatacgtgttaaactttttgagaaacttccaaactgtattgttttactttcctatcaacagtgtatgtgatttccagttgctttacaatctcagaagcacttagtgtgatcagcctttttaattttagtcattctaatgggtttataggtcatggtattcattgtggttttcatttgtttccctgatgtctagtgatgttgagcaccatgtgccaactggcattttgtatactatcttcttttgtctagtatctgttcaaatcttttgcccatttaaaaaattgtgtcatttatcttcttactgagttgtacaagttccttttatgatctggataccagttctttgtaagatagaaatatattaaacatttccttcaatctgtgaaaacatgtgaatacaactgatccttgaacaaaatgggcttgaactgcatgggtccatttatacttggattcttttcagtaaaagtgacactgagtgtgcttgcctctcctgcctccccttcctccccttctacctcttctgcttctgtcactgctgagacagcaagtctaacctcttcttttcctctttctcctcagcctactcaatgtcaagatgaagataaagacctttatgatgatccacttccacttaatcaatactaaatacattttaatcttccttatgatttttttctctatctttactgtaaaaatgcaatatataatatataacatactaagtatgtgttattccactgtttatagtagttaagtttcaggggagtcaaaagttgtacatggatttttgactgcatgggagggagccatcccctaacccccatgttgttcaaggttcaactgtatgttctcccagtttgtgtcatgccctttccttctcttaattgtatcatttgaggaacaaaagctttgaattttgatgaagcttagttttcagtttttcttttatgatttatgctttttgtttacttaaaggtcacaaagatttttctcctatgttttcttgtaggagatgttttagcttttacatttaggtctataatccagttcaagttaatgtttgtatatggtgtgaagcaagggttaacatggggattatcttttaggtaagtgtctattatgtatcaggaactttatttctcaagaaataaatgttctaagataattatccttattttaatgatgaagaaaagaagtctcagaagtattaacttgttcaaatcgtacaaccaaggctcaagtccatgattgcccaactccaaagcccatgttctttctaccttattatgttggcattgttttcaatgtcagtttggacccatataaaaacgcccagctgtaccctatgaggaggatataaaaatgtgagatggtagttgacactcggaggacattcatatctccaaacccaaccttatgaagttggccacagcaagcatgttggaaactagaaccaggggtttcatatcaagccatttgcttaggtctgtatctcaaaagctttaaatacaactttttttggtgccctcttgataaggagtcttatactgagctcttcttctcttttatagctggtccatcagaaagattaaattaaacgtttggccacatggacagttaatccttagatcacccagttggatggttcattcctgctatgtttggtttgattttttatttttggaaaacaaatagtgagtcagtctgctttccctccctttctctgcctcaccactccttctggattctcttagatgctctggtcatactaggtaaacagtatttttcttaaaattttccttgagccatgacagaatcatgagagagctcccctggctctgatacttaatgcccccctctaaaaagaaaggtctatttgaggctattcacttttgtcatcttgaaagagtctctgagtcttacctagcaggaatattttgtttcttttcctaaaaaaaaaaaaaattatatatatatatatatatatatatatatatatatatatatatatatggaggggatgtaaacagaacagcccatacctctctgttcttgcttctcattaatgtagatttggtaaattctcctttctcttctcttctcttctcttctcaggcagcatgatgtaggtgggaagaatatggagctttaaagtgagaagtacctacatttgaatcccagctccagtatttacatagctagcaaatcacccagtctctatgaagttcgatttcctattctgtaaaatgggaataacaagtactttatgggtttgttactcagtttctggcacatgtgtgtgcttatattatttcctcctgttcttttattagatctctttctgaagagtaaggatgtgagatgatactcataaaaagtctgaataagggggtgttggaagcttataaagggtatgttttgaatatggagccctatttaaggtgccttaacagatttattcctttcactttggctaatccgggcagtttgatttcaaagtccagacatgaagggtgaagaattgtagtcattctgcctgttatttttaaagttatttttaattttttacagctgtcgagttgattgtcctgggtctctgtaagcaaactctgttctctgtgatgcaattatttgctagtgagaaatttatctcatgggcaacagtgagacttaggaaaagagtggaggagaaaagacagtttatctgtctaatacggagaggatcaaatataaattggtaggagagactgggaaactctgataacaaatttgggagagttatacctctgtcttgggaaacagagccctgagaaacaccaatctttgtgtcagctggtaggatgaggacagtcggtgtctcccactatcttctggttaccgtgccttccagctggcatcattttcctctgttccatgagaattttctttgcatttcagtctgggctgctggcctctgcctcctttttgcctactaaaaattctgtggactctcaaattaacattttcaaactggtacattctttgagatgcagctcaaggcgtagttcttctaagaagcctctcccttgactattctgcacagtttaatggtgctgagaccaccctaaattattcaggtagccttgagaatctgaacctttgaatatttaatgaattacaaaatgtgtgtgttgaggaacaggagttagctacagagagacagatcagagttagtaccaactagaagcacttacacctgacttccttttaccacttttgtcttctcaactaaattcctaaaccttcgcaggattgcctttctaaagccaggtgattatataactctaacagataaatatagctctagtttcatctatttgcccagtcttcatattgtctctacaattttgggtacagttttttgtttttgagacaggatttcattcccattgctcaggctggagtcaatggtgcgatactctactcactgcaacctctgcctcctgagctcaaggaatcctcctacctcagcttcgaagtagctgggactataggtgcgtgccaccacacctagctaatttttgtatttttagtagagacggggttttgccatgttgcgcgggctggtcttgaactcctaagctcaagtgattcacccgcctccctccctccctcctgtgccaggattacaggcgtgtgccacagcacccagcctgggtacagtttatttcacttaatgttataagcttaacaatgcttattataaaatttgaggataatttaatggctgcagtgtgactcactcattaaaccacttttgtgccaccaagacattagaccctttgtcttcctagattttcaaaaaaaacaggatattgttgaatcattaaagcctttaggcaaacttgtcttatgcctaaaattctgtttttccctctataactgtatacaggatattttgactgtccaacaagtaagatgaaggaattaatttttttttctcttagaagtgttcactgtgtagatgaataacatttacagttagatctatgaaatatcttaggttttgtttgtgattgattctaagaattaaacaatgaatattctttgcaacactatagtcatgtaaatattcacagcatagctgagtttcataatttgacccataggacaaaaataaagtttgatgatattaagcctgcaatatttaaaagagaatattccaaacatcaagatcaaatagattctctttccgtcacttgccacattgtctttcctttgcatttataccttgtctttgctttttgtttaccttggaatttttaattgccttttttatcttaattggagatttttttcctgattgaagaaaaacagcatctgccattaccttatgactaagatcacttagcttcttaatcatactgtttgttataggaaaatgactttcatcttgacacatttttctctaagtcctcagagttcctgttctaatttcaaggccttcattgaaatcctgagttaaatctttctcacatgccatgtcatcctacttcttaaaaccctttttaattttgctgtaaatcatccctggtaatttgttcagaaagagtacacaggagttaaactttgtaactccttgcatatctaaaatgttttgcctagctgttctatagacagtccttcaactcatcaccttgatttctcctcctcttcctgccgttactctccttgttgtctaattctgtgctattcagtatggtaccttctggctacctggtctgttgagtacttgaaatctggcttatttgaattgagatgtgctgcaagtatcaaatacacactagattttaaagacttagtacaaaagtaaagataaatatgtatactatttttatattgattatatattgaaataatattttagaaatattaggctaaaatatattaaaattaatttcacctgtttctttttacattttaaatgtggccactataaattttaaaatcacatatgtgcctcacgctacatttgtatttgacagtgctgctgtaattcccaagaagcagcagtggctgccgcatacagcctttccccatggtcctgaacctggcttctttgggtggattatgatacatcagcattgtagtatgtctacaataatgtacatttaccaatataatcccatctatttccatcttttgaaaatagttaaaaatttctagtctgtctttttgcccttattcctctctccctctccttctccctctccctccttctgtctccctctcctccctccccctccctccctccctctctccctctctccttccctcccctaattacattattccttcttgtactacattgccacttctttggggtttgggaggaaaatgaattttcagtctatcaacggggaagcagaagattttactcatctcatcactatttttaacaacagtgcagtggttatcttcatgtgtaagtcagtctacatctctagatattttctcatggtggttttctagaaatagataaactgttcagattatgaatttcttgactcttgatatagatattgacaagttgattcctcaaaaaagtaactaatttatattcttagtgggttattcaataaaaggtgggagcagttactcaagggtacctacattcacatctgaaccccttatgtgggtcttgtatctcagcttctgtggaaaatttggcctcttttctgaatcactaaacttttctgggcctcttttatttgtaaaactgggataatcataccctgaagtaatgtatggaaaagctcattgaaagtagtattttattatttcagcaagtgcttaagagcctcctacttgtactaaatacatgttctgtactaggaactatggaggatgtctaaatgatgtgaacctgggcctcaaaaccaatttacaaaaaaaagaagctaccacacaagtctttttgtgatatctaacaagaagtgcaggccaggcgcggtggttcacacctgtaatcccagcactttgggaggccgaggccggcggatcacgaggtcaggagatggagaccatcctggctaacatggtgaaaccccgtctctactagaaatacaaaaaattcgccaggcgtgctggcgggcacctgtagtcccagctactcgggagactgaggcagaagaatggcgtgaaaccgggaggcggagcttgtagtgagccgagatgtgccactgcactccagcctgggcgacaaagcgagactccgtctcaaaaaaaaaaaaaaaaaaaaaaagtgcaaagtgttgaaggggtttagaggagggagggtttatattgtattttaaagatcaaggacaacagcctagaggaggtggcatttaaggtaagccttgaagaaggagtttaatttcaacagagagtaaggctgggaataatgcgatgtgagaatgatcttgagaagaggcacagagggtaggttcagggcagatccgttgatagcattcactagagtgtaagcaaaaggtgaggaaaactgaaattgtaggttgaaatttttgtttctgcgagtatacttatttgcatttgcacagaaggtggtgatccttatatttatttctgctgtgcatcaataggggaggtggagataaataatttcattgttttggctctggccagaattcattaggcacagtttgttgtccatagggaggggaacacaacacacactggcctttgtctcccttccacacaggctggtggagattctgaggcatttttaaacattgcacttagccattcagatgataacttggatcagaaattttgagaagtggtgggatgaagaagatccctgaagagaggagtaactgagacaaaggcgaggctagcaatagagagacaagtgagggaattagacctttggtatcatcatgaaaaggtgagttttgggaaacaaagagtatggcgggcaagtacctagcaggttctgaatatttgttctttaggagtcaccatttaaacaagaccccaagagtgacattaggtgtaaccaaagtgaaattgttgactacttgatgagattcgtgaggataggcattaaatgatatcttttaagaaaccattggcagtcctggagctgatgaccctagtgcaggatcattatggttgcttctttcatcatctcaatttgatgacatatttgaattgaacttaaactatacctaagccttaatcccagggtctactagtgattcagctcagcacatctaaaggcaatgattattcaagaggattacattggtatctcctgtcacaccagcatttagtattctatacttattccctaaatatatctcgttgtcattctccgatatttaccatttaccaatattaccaatatgcctagagcatagcaattgctcaataaaagtgtattgaagaaatgacacataataggcattcaataaatgttgaatgaataaatgaatatatccaataaaagcatgtgcttcctttattggatgagagatgtgaaaccatagactcaagaataaagtcatggggtacagggtaaagtaagatagtagatataatcaggagcttctagctgaactggagtcacctttaatgccaggcacatgaacttgacttcattttataggcatcaagaaagagcatctttgaatgttgctgaagatgaaaaatatcttgggcatggtagtagggaggtgggagggaggtttactgttccttaaatgaggcttatcccttcctgcttccatgcggctgatcaccattgtgatgaggaaagagatgattttgagccagatctgggtttgagacctagatttaccttgggcaaatttcttaaactggttaaaggctttgagagatacaccctttcctagggtcatctgttgtgaggttgtgaggtacagatgagaatttatgtgtaagtacttatcatggtggtatctgtcacgtggtaaatactttgttttcttcctttcctggggagtttccttttctctcttcccccagtcttactaaactcctgcccatcttttttttttttttttcctcttcacataagcagtgtagcttttccagggttcccagatgagacagatataagctttccctttgttcatcttcatttgtggaattttagacttttgaagaaagatttcaaagtgataggaggaatgacacaggaaagggtagaaatctgaacaaaatactatatttgggagcagaaaaataagggtccatgagagggtgtatgcacagtgtgaataaaggcatcttgtcacttagggcaacatcattgattctcagcccatctttgttcatccaggaggccaaagagaaagactgtcttgccagttcctagaattatccacgaaaaaggggctactcactcctctttattcagtgagagctagctaccaatctcccagatagccctgagcttttagaatatgatggtatgttttgattaggattagggcagtcattctacagactttttctaggaaaaccgagcttggtaagcagaatagaaaacatccagaatgacatcagtctggtaagctttgaaggaaacaaccaaagatggtcaacacaactgcttgttcttttatttaccatttcacacctggtgcagtcaggaagctacatttaaaaaacaattttctctttaaaaagaaaaacaacccgtagtcaaaaaagcactcatttgccataaagctggaaggattcattcattggagctgattgttcacatttgtagaatttagaattttgtggttggaaggggccttagagttgaataaggtcttcaaaaggaaacaaaaggctcttgctttctgtatgaacagagtttattcacaagtcagttttccgtgatctatgaggagtgatttcagacaattagctaattggttgaggcaggtgacctatcagctctgtagaggggatgtttgctcttagggatctacataaagaacatatcttacactttccatgacagtcaaaagcagccccattaatcctcctatgtaatggccagtcataaccacagatgaggagtgcatttcatgagaaccttaacagctgtcaacagttgatcactgccaccatcagctcagtgttgtgtggggctttgaaatattactgaatgatcttccaatttgttgtattgtagggcataagcggctctccagatatagtctgctatttattttttaagtgttatcagatgcttagtctgttgaaatgacacttgtctattgtatgaaaaacaagggcaggactgacttgtgaccatcttgaaaccccaaatgggtgcaaaaaaagaaaagagaacagggcaagtttggctaggcaaatgttatatttttctggatttcaagtgtgaaagaaattcaaaatgaaagaagagtgtcatagatttgtcatgaaaggaatcagggcctgtcacagtggctcatgcctgtaatctcagcactttgggaggccgagacaggtagatcagttgaggccaggagttcaagaccagcctggccaacatggcaaatccctatctctactaaaaataaaaaaaaaattagctgggtgtggtgacacatgcctataatcccagttactcgggaggttgacgcacaaaaattgcttgaacctgggaggcggaggttgtagtgagctgagatgacgccactgcactccagcctgggcaacggagtgagattctgtctcaaaaaaaaaaatgtgggggtgtacagggaatcaggagaagatgaccagtatgtatgaatcagtaaattcagtctcgttgcccttagtctaaaacccagtgaaatttggagtcattgtttttggagcatattattaaggtgttcccagaatgtaaagttttatgaggagaatggctgtgacaatcatgggatgactggtccttcaaaccagaacaaccacagtactggtcattaagatatctggtttttttgacactgtgtgtatccttgttagtgtattggttaaggtcagggctttgggtctgtcagaaatgggattgaattctgtttttgtcacctacctactttataaccttggccacgcacatggtaagcatttatctcaggaatattttcagtttatgtaagagaaagcgcatagtgtgttaaatagttgatttttctcacattacaagaagtctagaataagcagttcctgcctttggtgtagacagtcagtgttgcaatcaagcatgcttcttctgtcttcccagccagccatctagtgtgtgggctttcagcctcatggtagcaagagaagcaaaagctttcccaggaacctccaaaagatttctacttatgtcttattattcagaactgtgacatgtggatacctccagttaccaggaaagtaaacattctgtttgcctagactctctaattaaggacaaacaaggaaaagggattatgaataggcattatgttatccagccaacagtgcagtgtctggcattgaattgaacattgaacattcaatgctcttatgatggtgatggtaacagataattcacttcatcctgctctcctgaagagtcaggtaacatacttaacattttatactttatggagtacttttgtaagacatttgatggtgtattgtttttatatgtttagaagttccttgctgactgagccaaagaaagaagatgaactaggaaggataatgtagtccaggccttcatactgacctggcctggcctcgggtcttttgcttacaaagctttctcaaaccactctgagctacagcagttgttcatgcctctaaactcctaatattacttctgacttaatgctgtatttgtgctgctttatattttaaaaatgtacatggcttcttagctaagtttggaactccttaattacaggatctacacagaatgtgtcttacggaatatagagaggaactcatttgtgattcatttattgacaaaacattttctacttctcaccattagctgcacttgagatagggtagggatggggagttactagaatgatgctttcttcttctatgagggaagacttttattttctttgcctaatactctaccattctttctccaacttccaccttctttctcttttccctgcctctaagagaacggtgtgggttgtcaggggagaaaacatatcattccattcttttattactttctagcccctccttaactaagtcttgtctgtgacatcactgtggggaattctgccttacttcctaatagggcaaaaacttctgacccctccctgccatttctgagactacagcaaaaaggaaacccccgcatagtagcttctggtgccttttgcatattgccttttgccctgtccttatttctttttggacatttgatttaagaggcaaatagtactagatgaggaaatcaaacccactaactgaaatctacgctgagaagcaaatgattatctgatcttttgctgagaccaaatgctaagaatgtgttgagatcttggaacccaaaggtattagatgaacattgagcaagaagcatttaatcgcaaggctggttgcccagtccaaggttctttgaatgttgttccctgctagtgctagtactatagtcttcagaagtccatagtcaaaggtaggtagatgctggagtactcacagtcagatttctgagcagttgaatacaatggcttttcttccctttactatgatattttagaaatagaaatgactagatgctaacatattttagttcaatatatatcacttcttgtcattaattcaattctttggtttattttgtttctaattgcacagataacaagaatttcctaacatttttctcataccctttggccacttaatgttcccatgctatttattcctgttcatttttcactgtttgatgatggttattgttgaaatttagcaaataaaatgtcagctgtggcacctgtatttccagggtctaaaataatgtgtagacatccatagacaaaacacaaaattctaactattatctattttataaaacaaagcactttaccaaggttttagagatttaaggtgcccgttaattatccctcctcccaggaagtcaaattatccttgtttgctcatgatatgatctcatatttggaaaaacctaaagacttcaccaaaaaaaaaaaaaaacaacaactattacaactgataaattcagtaaagttgcaggatacaaaatcagcatacaaaaatcagtagcatttctatatgtcaacagtgaacaatctgggaaataattcttgttgtgttttttttttttttttttttttttttttttttttttgagagacagtctcgctctgtcgcccgggctggagtgagtgcagtgagtgcagtggtgcgatcttggctcactgcaacctccacctcccaggttcaaacaattctcctgcctcagcctcctcagtagctgggactacaggcgtgcaccactatgcccagctaatttttgtatttttagtagagataggatttcaccatgtcagccaggctggtattgaattcctggcttccagtgatccgcctccctccgcctcccaaagtactgggattgcaggtgtgagccaccatgcccgacctggaaaataattttttaaaaagtaatcccatttatagtagccacaaataaaattaaatgcctaggaattaatttaactaaaaaagtgaaagatctctgtaatgaaaactataagacactgatgaaaaaaactaaagaaggcaccagaaaatggaaagatattccatgctcatggattggaagaattaatattgttaaaatgtccatactacccaaatctatagattcaatgcattccctgtcaaaataccaatgacattcttcacagaaatagaacaattctaaaatttatatggaatcacaaaagacccagaataaccaaagctatcccaagcaaaaagaacaaaacttgaggaatcacattacccacttcaaattatactacagagctatactaaccaaaacagcatggtactggcaaaaaaacagacacatagaccaatggaatagaatagagaacccagaaacaaattcacatacctacagtgaactcattttcaacaaagctgccaagaacacacactggaggaaagacagtttcttcagtaagtgttgctgggaaaactggatatccgtatgcagaagaatgaaactagatccctatctttcaccatatacaaaaatcaaatcaaaatgaattaaagacttaaatctaaaacctctaactatgaagctcctacaagaactgattggggaaaatctccaggacattggtctagaaaaaaatggcaagtggtaactccacaagcacagacaaccaaagcgaaaatggacaaatgggatcacatcaagttaacaagcttctgaacagcaaaggagacaatccctaaaatgaagagacaacccacaaaatgggagaaaacatttgcagactgcccatctgacaagggattaataaccagaaaatataaggagttcaaacaactctatagggaaaagtctaatctgatttttaaatgggccaaagatttgaatagacattttttgaaggaagacatacaaatggcagacagacatatgaaaaggtactcaacatcattgatcatcagagatacataatcaaaactacaatgggatatgtcacctcaattaaaatggcttttatccaaaagacaggcaatagcaaatgctggcgaggatgtagagaaaaggaaaccatcttacactattggtgggaacatgaattagtacaaccactagggagaacagtttggaggctcctcaaaaaatagagctaccatgtgatccagcaatcccacagctgagtatttaccccaaagaagggaatcagtattttacacagagatacctgcactcccatgtttgttgcagcactgttcacaatagcccaggcttggaaacaacctaagtgtctatcagcagttgaatgggtaaagaaaatgtggtacttatacacaattactattcagccataaaaagaatgagatcctctcatttgcaacaacatggatggaactagagatcattatgttaagtgaaataagccaggcacagacagatagacattgcatgttctcacttatttgtgggatctaaaaatcaaaacaattgcactcatggagatagacagtagaaggatggttaccagaggctgggaaggggagtgaggggtggtaagagaggtggggatgattaatgggcaccaaaagtaaaatagaaagaatgaataatacctactattttattgcacaacagggtaactatagtcaataataatttatttgtacattttgaaataactgaaagaatataattggattatttgtaacacaaaggataaatgctcaaggggatgggtaccttattctccatgatgtgattattacacattgcatgcttgtgtcaaaacatctcatgtatacctactatgtacccacaaaaattaaattaaaaaagttacaaaattataaccatcaaaaaaattattattagtcctcccttctgttgtagaaaataggaaggaaccaaaaggagatgaacttatcacctttactcatgacagctcaagagggtctcagatatagtctggagatgccagtctaggagtacttggtacaatgagagaaatatgaatcagcaagcaatatatagagtaagacaagagaaaactgagggtgaaatcccagggatcatagaccttaaaaggatccttatgatgactgaaaatgaggatagaaatgcaggaaattgtggtgtcaggtaatctaaaggatttaggagaggagccttcaggtgtctcaaatgctgccaagaaatcagtgaagataagagcagcagtaagtatctatgggattttacaacaaaaagttttagatcacccatggtgaaaaacttactgttctccctgcccagtctccctagactaatcacacaggaccacctacattttgtttttcagtctgtcttcacatctggctcccactgtgtataaaaatatgccactgggcagggggtggtggctaacacctgtaatcccagcgctttgggaggccaagatggaaagatctcttgaggccgggagtttgagactagcctgggtaacatagtgagaccccccacctctataaaaattgtttaaaaattagctgggcatggtggtgcattcctgtagtcctagctctcgggatgctaaggcaggaagattgcttcagctcaggattcgaggctggagtgagccatgatcgcaccactgccctccagcctgagtgacagagcgagactttttctctaaaaataaaaaataaaaaaagtcaccaaaagatctttggactcaaattattcattataatcctagaagaaggacttatcagtatgtgtattattggaagatggttagtgataagattttcctttgtaattggagcccagtatttccgggtgaagactgtaaagcactggatcaagagtatactgatggtaccacatgtcccaggcaggctctgaaacaaagcccagcattatcctcctccttctgtcatttgaaggaccatctttcccattaaattataagagattcttgatctgctataggggatacaccagtgttggggctcaataaatatttggcaaaattaggctctgcaggtataagacaaggcaaaggggaaggttcttaaaaaaacaaaaactatatcttcaaatttctgctcagactctagggcatgagggaactccatgtgcctgcttcttcctctaagcacctagaaaggttctttctcaaagtcaataaacaacacttcttaatagttactttttggtctcctaaatgttactttttagtttccctactgttcaagccagagctatgatttgtcattactcacatatgccttcaagtgcagataaatttcctgcatgccattgctacctcttgctgcatcccattagactcttacttaagttgtgaggtttattttttgataaccaaaattcacttaaacataggatgtcatttgtactactgatccgtttctctcatcatttgagtcaggatatgtgtgtaggacactggggcttttaccttctttttgtgctatcatagcttatatgaatagaaagctcagacacagtgaggacttgatcaatattgaaaggaaatttaaatcataccaggtaccctataagcttctcccccaggcaaataaagccagtgttaagttgatctccctaggttggtgggcagggaaagtcccaagcctggtggcttcctcagtcacttctttaaaaaccaggggcctcaccactggtttccaatagcctgtgtatttttagtcctgcttttcatgtaagtttcccattaactgcttgcaggaaatcttttcttggacataatctgcccatttcctgaagtcttcctcccgccttgtgtcagtttggggatgaatcaagtcagcagttttggagggggtttgttctgttccccgccacaggctccccactttgtagagtaccagaaagctgcctttcttgtcttttcctagaggcaaagggaggaggggcaagcccttggtgtgtgtctgcctcttgggttgcccaacacaaatgcccttttgtgtgtggagggggcatgtgtgttttttttccccttcccaatggacactttcatttacgaggtccggatggtgtcctctgggctataaacaatggcataggagataaagagctgccttagtgaccaggctgtggtggcagccactggttttccatctgtgtctctgttttccaatccccttggtctattgtgagtttggtctgatctgagccagcctgggacctctgtaatccctttctaggcccagagcagcgtgggcactattcctcttatcctgaggacttcaagcttagagaaagaggttttctgtggtaaggatagcaactcctcatgtttgcacaatgtgtttaaacacattatatcttttggagaactgaaattctggatttgttatcccttaagaatggaggattcggggctgggcgcagtggctcacgcctgtaatcccagcactttgggaggccaaggcaggcagatcaggaggtcagaagatcgagaccctcctggccaacatggtaaaaccccgtctctactaaaaatacaaaaaattagctgggtgtggtggtgcataactgtagtcccagctactggggaggctgaggcaggggaatcgcttgaacctgggaggcagagattgcagtgagccgagattgtgccactgcactccagcctggcaacagagcgagactccatctcaaaaaaaaaaaaaaaagaatggagaatttggatcaaaagagttggagtgctggtcctgctatttatttattttatttttatttattttttgagacggtgtctgtctctgtcacccaggctggagtgcagtggcgcgatttcggctgactgcaacctccacctcccgggttcatgcaattgtcccgcctcagcctcccgagtagctgggattacaggtgcccaccaccatgccctggtaatttttgtattttttagaagagacagggttttaccatgttggccagtctggtctcgaactcctgacctcaaatgatctgcccacctcagcctcccaaagtgctggggttacagccatgagccattgcacctagcctggttctactattaataactgtgagatctcaggcaaattctagaactaatacctttctacttcatagggtgttccacagttccattaagaaaatacgttatgggaagaaaaatatttccattaagaaaataacatatgggaagcacccaaatgttaaccaaaaaaggagggggtgggaagaggaaatgtacaatgagacaatataaatgaatacgctatgcataagatgctaagtatatagtcactatttggttttagaggtctaagagtaagccttttctccagataaatctaccccttcacctggattctcattctgaccatcacttccttctctgtcatctatcactacgggcccttctttcacatgttgacatgactctcctatctcaaagcaaaccactatttcttgattccagcccctagctcagtgcttggcccaaagtaaggttcaacattttcttgaatggatacttgtgaaaaactccaaaacgcaaagccttgtatttcccttctttcctgtccccagagacctgctgtttgtcactcaaacttctttatttttatacccagggatcactgtgagaaatggaaaccactccagatactttaaacaggaaggaatttaatacaaggaattagatgcttaccaaatgataggaagaactagagctgcatgttctagtttaagaactccataggtgacctcctaggacaccactggtgatccatttaacccccacccacaccccatagctgtggtctcgggtatgggaggtcagacttgagaagctactaatgaacctgccccatggcactcaggaggctggataatacctcagccgcataaaacaatcaaacgtctatatccttttttgccagtagaaacgagaaatagccaaaagagaaatggaaaatggtcttagcctcatttccaccttaccagtcttatatgaatgcaagtaattggcagactgcctgcaaacaaatttggtaaaggtgacttttagttttccagattttctaactagaaggggaatggaattgatgttgagtgggccaacctatcgtacataccaaccaacttcatctagaaagtatttcaggtagcaatatggcgagatacatgctagctgagaaaatccaaacagatctctgtgtttctagttataacaccttccaagtacaaaactgcttccataaaatcatgcttttctgtgggaaatcttcacatttccctgtggcctctaaaatggtctggttgccctagcagccagctcgccttgtacttgttgagtacctagggtattctcaacaaatgcttgagtgagtgcctactatatgtgtcagttactatgaacacatcaaaaacacatcaaaaaagaaagacaaggccctgccttcaaggagttcatgatggtctagtagggggatacagagatgaaaacagttacaaagtgatattataaatgctaaaaggaacacagatgagagatacataaatcgtattgggggataaaatgaggataaatatgaaagggccatctgtactcttgtaaaaagttaagtgtaagggatttttaattaatataaagagcctacaagactggccttataaactctctactctctttctcctagccacgcaacccagacacaaaaccccaaaaatgttcttcatttttgctaacatttttaaatgaaaaatttcaaacataaagcaagattgaaagaattttacaattaacacctatttatcaaccatctagattctgtcattaatattttactatgcttgctgtatcacttatctatttgtctatccattcctttgaccacccattgtgcatcttattttttatagcatttaaagtaaattgcagacattagcatatttctccctaaatactttagcatgcatatcattccctagagttccacatctgttgagtatttttctttgaggtaaaatgtacatggagtgaaatgtcaatctgaagtgttctttgagatgtgacaaaaatgtaactaaagctcctatcagactatataaaacattaccatcgttccagaaagtttccccattcccctttccaaacaattctcaccccacccccaccctccagaagaaacaatcattctgattttttttctaccatagattagttttgcctgttttagaatctcatagaaacagaatcatacagtatgtactcttttgtgtaaggcttctttcatttggtataatactttttgagatccatccatgttgttgaatgtatttatagaccattcctttttattgctaagtaatattccattgcatgaatataccactttgtttatgcattctccttcggatggatgcctgtgccgtttccagcttttggctattatgagtaaatctactataagtctgtaatgtcatttttaatagactttttgtcagttttattacagaagaactgagaagatggtacagagttcccatataccccacacccagctttccttattattaatgtcttacacataatgtcttttttaaaaagccttccgcggcttagtgtttttgatggctgcttaatggactgctgattgggaagactgcaaatgcaatgctaccagtaaatgccctgcaacaggaaattgtttttgtcatcccattgagattattgacccaggatttattttatcaaacaatgtggacccgagagtgcctagtgtttggtgtgtatatccgtttctcggaatcttgctcagggaagggtccaaggtcaggtccttgtgtctgcaggtgagggtaatagggctttgtcctcatctgcacaagcaaatgatcagcccaccacgactttcccacttttccacttctaggccttcctgtcacccacaacaaattcccaacaagtttgtaagatgttttgccaaagcacagcttattattataatgacaatatttatgctgtacttgccagtttatagaggtctttaacatccacttcttcaattcaatctagtaaggtattatatccatcttctagaggaaaaactaaaattcaaagaaatttaatgatttatccaaagtgacactgctagttattaagaatttaggatataaacccagctgtcttgcccttaaatcctgatttttttaaatgtattattattttcaaaatttggggggctcaccattgtttttcaaggcaaagttcaaaccatttagtacatcatttaagtcccactgtggttgggactcaacctaccttttcattctcatgttttcctggctccctgtaggctctagaaacattcaatggtatgttgtttcccaaacacttcatgaatattgctacctctgtgcactttaatgatgccttctccattatgttcagaatattatttcctttgttccatgcttcatatcttggccccaaaatctgtttctgggaatattgttcatcctttaaggctcattgcagatattgttattttcatatgaaacatctcttgattactttcctcctcccacaaccattcccagcttgaggtgcttggttccctgttctgttcattgattagactttgaatgcccagcagaccccatttcatattaaaatgcaaagataattaaaacatgattgtttatcattcttataggctattagtgaatcagacatgtacagaagtgatgataatatgacatgaggattaaaattgacccagataccgatttattgagttcccactgtatacccaccacagatgctcagtacgtatttgtagaattgtattgaataatagacatgatgcatttgcgctaaataggaatgatcttgagtatagacaaagaatggtggcttacctgctgtggttaaagagcataaatgggatctttgctcaaataaatctccatccaatttcttcttagccttcatcccatcactccaccaccactttctggctttcctacttctaggccttcttcttacctccagtaaatcctcaacaaggttttaagactttttttcccaaagcatagcttatggggaaattttaccgggtcagaactgtgtctgctttgtatatatttgagagtagcaaactgagttagttctgagatgactgaaaaattctccacaatagaatttcatgtattcaacagaagttactaaggtcctattctgtactgagaacacaaagatgaacaaactgttatccttgacctcatgaagctcatagcagaatgcagacaccacacacaaattcatggaagcaacgtgactctttttttggaaaaagataggacagaaataatttgaagtaacaatttcttattcctacaggaaggcccttcagagtgctttcatgaccaaagtttcagttatttactcttcatttagaaaaaaaaattgtccaaacttgattcagtagggtttactgttatcctattaacctgcaaccactgtatgtcatttccttttataaagaaatccaaataaatgcagaaatgaagtcctcttaaaagtttctcagtgtgaccttaagtaatgtttgcatttcagtggtgtttgtgttttatagccctcctctgacatcaagttgtgatattttaaatgagacacttatgtaaaaataagggtatgacactttttctatcacacaaggttggaagcatctttcataaaaactaatgaagttatttagatatggatatagaataagctccaagatataagtggaataaagcaaagtgcatttaatatactatgatgctttactatatgtattaaaagggggaagacattgtatatattcactctcatatccataaaatatctgtgaaatgaaacacaagataagaatgattgtctctacaaaacagaataggatggctggagttagggtagggaagacttacagtttgctattttatacctcaattcttgagccatattgttaaaaaatacaatgtttaaaaagaaatgaacaaaaatggtttgggggtagcttactgctgaaggttcataggaatagactctggtgaattttcttttttatttgtggcaatactactggcatattttctagagaaattacctgtgaagtattatctatatatcttgtgatttaactactgacaatgtagtggttgtcaggatgttgctaagtcatgtaagatctttgaaagcccacactttacgtgggtagtagttgctgtggtcaggaagaaggcacatcagaacacagatagagttcttagaaatctagcatcataaacccccagggctgaaagaaccagagttcattctagtccacctctctgtatgttcgtatgtcctctacaacattcttgcttagggatctttgtcattccggtgttgttcaatattattaatagagcctcagcaacgtggtttctgtgctgtctggaatgatcagtggactaggactcaaattacttggttcctagtctcagctctgccactaattaattctgtggcttcaggcaaatcactttgcctctctgggcctctgttttttcatgactgaagttagagcattggcctgatggttaagcacatggcatggtcactgttgcttcccctccccacctataatagacattacttcttagttttggcaggttctttgtggtggataactacaaacaaagtctcagaatccttctcaacacagccttccaggcaactaaaatcagtagatagaacttggatgggacttgacaaacaagataaaagttacttacttccatctctaaggttctcaagtagcagtgtgcaggtacatatttaatgacaagttctcagcaaaaaaataagatgccctggtttgcatcgtttgccaattcccatggtgtaaatattcacaccatgactgatttcagactaccattgcgaagtaaattgggttgcaaagttcccgaaagtttaacagtcagcttttatgagctgatagaagctgtctctggcccatcactgtaaaattaatgactttagattagctggccataaccataagtgaatatgaaaatgaccatcttcctttgggagttttatccagaggcataattcttaccttgtatggtcttttggacttcggaaatacttggttgtcatcagaccttgatgttttacttccctgaacctcagctacactatctggaaaatgggaataaggattcctacttcagaagattatagtgaataatgagacactatgtataaagcacttagcatggcatctagcatatggattgatattccccttcccttaacagtgtggtagattatatctttatctttcccagactcatgaaaggctagccattgctttccctctagcacctttctttttccattatactcccttggcattccattttcctctgctctaatttacttaatcttctgtctgagtggaatgttaaatatttaatcttacctgttcttaatgttttatttatcatctatccaggcacatttgtgagtagagaccagccctgtgtaagtctcctgaattatacaccatcacagcatcataagtaaataagtgctaataagtccccactcttgggatcaaacttaaggatgataccgaagggagcttgtgttacatgagcacaagaggaggctgctaaagatcagccagaatatgatatacttgtagaattctgtctcctcctgtgtacttatggccagtgacctcacggcaagtagaaagaatttcacattttaagaacatgcctctttaaaaaaaaaaaattcagagggagtcaggcatggtggatcatgactgttatcccagcactttgggaggccaaggtgggcagatcacctgaggtcagtagtttgagaccagcctggcccacatggcaaaaccccgtctctactaaaaatacaaaaattagccaggcatggtggcaggcacctgtagtctcagctactcgggaggctgagggaggaaaattgcttgaacccgggaggcggaggttgcagtgagctgagatggtgccagtgccctccagcctgggcaacagagccaggctttgtctcaaaaaaaaaaaaaaaaaaaaaaaaagaaagattcagggggtacacgtgtaggtttgttccatggatatattacaagatgctgaggtgtgggcttctattgatcctgtcacccaaatagtgaacatagtgcccaacaggtagtttctcaaccttacccccctcctccctcccccgacctttttggagtcctcagtgtctactatttccgtctttatgtctgtgtatacccaatatttagctcccacatataagtgagaacattataagtgtggtgtttggtttcgtttcctttttttttgaattggggagacggagccttgctctgttgcccaggctggagtgcagtggcatgatctcggctgactacaacctctgcctcctgggttcaagtgattctcctgccccagcctctcaagtagctgggattacaggcacacgtcaccatgcccaggtaactttttgtattttagtagagatgggatttcaccatgttggccaggctggtctcgaactcctgacctcaggtgatcgtcccgtctcagtctcccaaagtgcagggattacagacctgagccacctcatcaagactggttttctgtttctacattaattcacttagaataatgacctccagctgcatacatgctgctgcaaagtatgtgattccatactttttacagctgtgtagtattccatggtgtatatgtactatacattttaaatccaatccaccattgatgggcacctaggttgattccctgtctttgctgttgtaaatagtgctgcaataaacatatgagtgcatatgtctttctggtagaataatttattttcctttgtacatatactcagtaatgggattgctgagttgaatggtagttctatttttagtctttgcaaaatctccaaactgctttctacagtggccgaagtaatttacattcccaccaacagtgtataaggatttcctttgctccacagcctctccagcatctgttgttgttttttttttttttttacttttcagtaatagccattctgagtggtgtgagatggtctctcattgtggttttgagttgcatttctctgatgattagtgatgtttgtacatttaaaaatgtttgttggcccattgtgtgtcatcttttgagaagtgtctgttcatgtcctttgcccactttataatggtattatttgtgttttttattgaattatttaagttcttagataaagattctcagtattagtcctttgtcagatgcatagtttacaaatattttctctcattctgtaggttgtctctttactctctcgatagtttcttttgctgtgtacaagctcttcagtttaattaggtcccacttgtcaatttttgtttttgttgtaattgctttagaggacttagtcataaattccttgccaaggctgatgtctagaagggtattttctagattttattctaggatttttatagtttgagatcttacttttttttttttttttttttttttttttttgagacagagtctccctctgtcagccaggcttcagtgcagtagctcggctcactgcaacctccgcctcctgggttcaagtgattctcctgcctcggcctcctgagtagctgggattacaggcacgtaccaccacgcccggctaatttttatatttttattagagacagggtttcgccatgttggccaggctggtctcaaactcttgacctcaggtgacccgcccacctcggcctcccagagtgctgggattacagatgtgggccactgtgcccagctgagatcttgcatttaagtctttaatctatcttgagttaataattatgtatcatgataggtaggagtccagtttgattcttctgcatatgtttagccagttttcccagcactatttattgaagagtcttatccccattgtttttttttttttaactttgtcaaatatcagtttgttgtaggtgtgtggccctatttctgggttctctattctgttccattggtctacatgtctgtttttgtaacaataccatgctgtgttggttacaatagccttttagtatagtttgaaagttgactaatgtggtgcctccatctctgaagaacatgtcaatttttaaatgcaagtagagtacttttcaaaagtttcccaaaactgaacttttgttaaatcttacatataatcttctccctcctctagtacaatgtttataaaatgagagatactagaggaaatgcagtgtgaactgtgctgcatctcttaattacaggaaccatttctccgcttactgaacacatactgcactccacgctgctgtgggctaggagtaaaaagacatgagcaatttttcctgcttgcaaggaacttaaaatctatagtaaagaggtaattcagccaaaaagtataacataaagtgataagttccatcggtaatagaggtaagcaggaggtagagcagaccatacatacgggtcatttccatcagccagggatggatagaagattgtgggagagcatcctggaaggagtgatgtcggaaacatctgttccccttctttcctctctcacagctcttagtactgtgctaaggttaataagtccttggtacaggggtactcatatccacccccatggcttcagttacctttcctatatgctgatgacatccaaatgtacatctccaacccatgcatgaacttttcagaccaaatccttggcctacagctcgggaaacctgcctcagtagatgtcatagttggctcaagctagaaacctgtaagtcattcttcactctgtttcaacccccacattccagcagtgactaagaaattgatcagttaaatatctcttttgcattaccttctctctctctccattgcccaccacagtttaagccataatttcttactgggactataatatctcccagttgagactgggcacagtggctcatgcctgtaaccccagcactttgggaggccatggcaggtggatcacttgagcccaggagtttgagatagatcagcctgggcaacatgacaaaactccatctctaccaaaaaaaaaaaaaaaaaaaaaggcaaaaattatccaggtgtggtcatgcacacctgtaatcatagctacttgggaggctgcagtgagctgtcatagcaccactgcacttcagcctgggcaacagagtgagaccttgtctcaaaaaagaaaaaaatctcccagttagtatacctgatgctaggcttgctcttctcaagcttttcacacagcagccagagtgatctttctagaacataaatccagccatagcactcctcttttctgttgtccttaggatgatgtccaaattccttatcttcttcccacattgaacaaggataagaccctcttccttgctattaattctcatggtgcaccatattttccttgatcataatattgatcatgctttatcataattacctgtttcttagctgggcatgatggtacatccctgtagtcccacctactgggaggctgaggcaagaagattgcttgagccaaagagctcaaatcctgcctgggaaacatagtgagacccctgtctctagaaaaaaagaaaataaaattgtttttcaaaattatctgtttcttctcacctgggcgcagtggctcatgcctgtaatccccgcactttgagaggccaagcaggggcagatcgaggccaggagttccagaccagcctggccaacatggcgaaaccccatctccacaaaaatgcaaaagttagccagtgtggtggtgtgtacctgtaatcccagctactcaggaggctgaggcaggagaattgcttgaacccaggaggcagaggttgcagtgagccgagatcacaccggtgcactccagcactccaccctgggtgacagagcaagactcggtctcaaaaaaaaaaaaaagtctgtttctttatatctctgccagatactcagctctgagatcatggaccatgtctgttttgtttactgctgtatcctcagcccgtggcacagtgcctggtttacagtagaataataaatgtgtaagttaattttttattttaagtgcactttaataattttatatctcataaaaatgaaaaggcctcaaatgtggctctctgctaagtatgattagtcatatagtaaattatttttatagcagatcttgtttaggttgtgaacatgggtgagaaattccagtttctgtcattatgtctggttctatcaagagccatagagatgaatgttaccaagcctaagggtaagttagagaggaaaacatgggagaaaactgtaaagaacagaaactctaccacttttttccccaactagtactgcaatatatatcttcatacatacatctttttctttcctttgaattattaccttaaagtcagatgccagaaatgagaattattgggcacaaagggatgaacatttttaaggcatttgaaatactgccagattattttccaaacacataatactaacaaatagttcagagcaacatgcaagggtgtctgttttatcacactacagggaattgtcatgaaaatcttttagctggtttaatggaggaaaaaatggaggaaaaaaaattcatttttagttaaggtttggtgtttttcatctgattatttatgcagctccttctgagggtgcatccaaacgctcacagccttgtttcagaggctgagaggcctgcaacctcagcggcctctggggcacagcacctctgttgtgcagcagcagggaggggcagtgatggagggaaaacataacacagaccacaccattgttaggggatgaggttgctgggataatgctgtgagaagggatgaaaagaacgattctccattcttgattgttgtgatttccagggatgagccaacagctccagtgcgggaagggatgggtctttactgcatccagatgctcctttttccagtgctgcctccgattatttctggtgagaaggggtggtggataacatagcagctgaaacagattaacttttatgccagtttcctccctttaagtgattgccctggacctggggacattcagaattcgtcagaaaccgtttagaaataagaatgtggttcaaggtccctggtgtgcaagagccaaccttctggagtttgcgtaccattcctgcctttatctgtgggagctgcttgaggcaaagggatctttctttcctctccttccctactgccactgccgttgttcaggcccttatcctgttttgtctgggcttcctgtttcccttaatctatcctcatctatgctgttgccaaagtgatatttctactatgcacactggatcctatccctctccagttaaaactgtcagtggtccgccactgccttcaggatgaaagtcaagctccttttcacagctttttttttttttttttggcatttaacaatcagatcccaaaatgtctttcctgactggctcccaccgcttctctggactgttccaggaccctgactagtgcatgcactctgtaaggtgcttgtgctggtccctcctcctgatagcccttctgcctctgttccaccagattcactcctgatccctcatctccctcctcaaaaagaagtctccctcaattatcaactctctgatggattttccctggtaggtaatcagttctgttcctgtaaccctctagtagcaactatatacaagattgtgatttctattattattttcccctaaatcaggaattatcttccttttgtatattcatatttgtggatccccagcccttagtacaatatttgacacataataaatgctccagaatatctttttcttccttcctgccaggttgtttgtaagttcttttaccttcaatgtgttcttagttttagagttaaaaggaaatgtaatgtagtttaatcttcttcttctttttcttgttttttaatggttgacaaaaccaaagcccagaaaagaaaagaattcaccctgggatgatcagccagatataatggcagggctgtttagggctgatctccttaggtaacttaaaaagaaccttgaaacaaaagattgcatcaggaggaaaggaaggagcaaagattcgttgccaagttctttgctgaatgcttaatatatgttactttttaaaaaaattatttcttcttttgattgtgataaaatacacataacataaagtttaccatcataatcatctttttttttttttttttttttttgagacggagtctcgcactgttgccaggctggagtgcagtggcgccatctcagctcactgcaacctccgcctcccaggttcaagcgattatcccgattcagcctcccgagtggctgggactacagctgcccgccaccacacccagctaatttttgtatttttagtagagatggggtatcaccatgttggccagaatggtctcaatctcttaacttacgatctgtccaccttggctcccaaagtgctgggattacaggcgtgagccactgtgcccggcccatcgtaatcacttttaagtgtatagttcagtgacattaaatgcattcatattgctgtgcagccattaccaccatccatctccaaaactcctttcagcttcccaaactgaaactatacccattagacattgatgccctattcctccggtggcctaataaccactgttgtattttttgtctctctgaatctggctactctaggcttgccatgtaactttgtcatataagtggaatcacatggtattttctaactgcttatttcacttagcttaatgcccttaaggttcatccctgctgtagcatgtgtcagaatttccttcctttttaaggctgaatagtattccattgtatgcatgtactgtgttttatatctccattcatccaccagtgacatgtgggtagcttccaccttttggctcttctgactaatgctgcaatgaacataggtgtaaaaatattccgtttgtgttcctgctttcagttttttggggtctgtatccaaaagtagaattactggatcatatggtaattctattttcaattttttgaggaattgccttactctcttctatagcagctgcactattttatatccccaccaacattgcacaagggttccagtttctccatattctcaccaacacttatttctattttttaaagtagccatattaataggtgcaaggtagtatttcattgttttgatttgcatttccccaatgattagtgacatgagcatcttttcatgtgcttcttggtcattttgtatcccttctttggagagatgtctattcaagtcctttgtcaatttttagttaagttgtttgtttttgttgttattgtagttctttatatattctagttattaaccccttataatcctgtactagtcagtgttctccagagggacagaactaataatatgtatatatgaaagggagtttatacatatttcataatatgtatattatgaaagtaaagaattggctcacacagttataatgcaaagtcccacaataggccatctggaagctggggaagagagaagccggtagtggctcagtttgggtctgaaagcctcaaaaccagggaaaacaacagtgcagcctttaagtcagtcccaaaggcaggacacccaccccctggccccccgtgcaagtcccagtgtcaggccaaagaacctgaagtctgatgtccaagggcaggaggagcgggaggaagcatccaatatggcagggggagggggagtggggagaaggaagccagaagcctcagcaagcaagcttattccaccttcttccgcttgctttcttctggccatgctgacaggcagtaggatggtgcccaaccatattaagggtgactcttcctttctcagtacactgactcaaatgtcaacctcctctggcagcaccttcacagataaacccagaaacagtacttcgccagccatctaggcatccttcaatccaatcaagttgacacctaatattaaccatcacaaatcctttaccagatatatgatttgcaaatattttcttccattcagtggattgtcttttcacttggttgattgtgtcctttgattcactaaagttttaattttgatgtccaatttatctattttttgttttgctacctatacctttggtgtcacatccaagaaaacattgtcaaatccattgtcatgaaacattttttctatgttttcttctgagaggtttatcattttcattcttatatttaggtctttggtccattttgagttaatttttgtatatggtataagggtccagctgtttttttacatgtggatatccagttttcccagcaccatttgctgaaaagttctgttatttcttttgtatttgtgtgatagtcctaggatgtgttataattaccttatagatgagaaaacagaaggtgaaatattcctgaggatcccctaaaagcaggcttcttgctatccttggcagttcaaagacattaaaaaggggggaaagccattttgaaataatgcgagaagaagaggggaatagactgagaggaaaagcaaaacaaaataaaataagattgggatagacagccagccgtgagcagaactttgaagtgtgtttataattcactcagagacctcctcccccctgcccttttactctccttccttctcttactctctcaattagctccttcagtttgctgtctcttctgaaactctttgaaagcttttctacagtctgtgtccagcctgttttctgagctttatctgctgtctccctcgctgccactgtgaagctgtaatggagtcatgttagttctcactgctcccatagcaagccctgcctttacagaccacgttcattttattcactttacctttaatgtgccatggtctttctccaaggcctcttgacggtggtggcacctcttcacctctgcgtcccagtagcattgtggcacagaggtggctgttctgtaaatgtgtcaaaaagatgactaaaccgacagtttttgttcctttgcataaccattccacatatgcaatatagtcttaccttccgggatttaaagtaagcatgtgacctggtctctgtccaccagtgattgtaatctagctgggagaaagcaaggtacttctatatacacttgacactttaatattctgtataacatgttatacttgtaaccttcagtgaatgacagggaagacttgttttatctccattatattaagatactaaagcacagcaaagttggagtttggctgaaatcacataactagcagaagatcaaggtgggacttaaacctaggggactgacttcaggcaagatgcttaaccacttaaagctactcagtttgttcatctacaaaatgaggataatagcgtctacttcctaagtggttgtattaaaaattacaccatgtgagtgaagaattttggcatgtcatatgggacgcagtgcaagctgctattgtctgtctgtctatatggtgttttttgtcactgttataacactttcagtgtattactttggaaaagaggcttgcaagtaccatcacaacggtttctccctggacttttggaaatattaatggccactcctgttttacatgcgagccctatgtcaagcacctcatgtgatgcctgcctgactcagggctcagtgaatggttcctttacttcccctcctggccttgtgcttttatgggtgaattgcacaggacttgacactcccacatccagaggctaactagctgaataacccagctagaactagaacttagaattctgccatgtttttcagactgtgtcttcttttccattactctttctgtagtctttcatgtgctctcttcacatttttttggtaggtggatttaagttggtaggatcactgaggcatagtagaagctaatctgtactgataccttattttcaatttgtagaggccccagggcacttgtgtgataaatggtgctatgtaaattaaaatgcaagtaagggtctcttcagtgtttcttaaattaagtttattatatgtggtaatttgcacctagaggcttttgttgttatttgttgtagtgactatggcagtaatgagcctgctcccagaaaagcttggcacatgccccatagacagtttatttgcatttggctggactccatggtgtaccctgaacaaatgaatcagcctattggaggggtggagaaactgaatcatagggaggctgtgggtcttgcacatgatccctggtgatcctgaggtggggcaataccagagttctatgtcctgttcctagctggattattccttagcctcaggatttgggagcatcaagcaccttgcagttcacccttaaaagcacaaagccaggaggggaagtaaaggaaccattcattgaaccctgagtcaggcatcatatgaggtgcttgacatgtaaaacaggagtggccattaatattctcaacagtctaggattcggattcagtctttgctttattgtggtaggtaacgctgtttatctggcagctgcattgatccaaaccatgtgaagaactgaaaaaaaaagtgctgggaaaaaaaaagctttagagtgatcccaaagaatacactaaggcttatacacatcagattctcgtgacaaccttatgaacagagcaagtgacaccttcttcatgaatcttagcccaaggaacttgcctgagatgtggtgatcacacaataaatagcagaccaaggactgatagatcaccacccagagattctctaagaattaacatgaaacagtatatcatgttttatattacacacacacacaaacacatattttttagttcccgtttctgccacccttgatgggagttgaggacactagatctgagaagtttcagtacttttctgagacacgtggggcaggtcttggtgagcaaaaagagcccagaggacagagtcataagtccttgctttgtcgatttataactttatatctacaattaagttacttaaccacttcaccctcccagtttcttcatctttaaaattggataataggccaggcgcagtggctcacgcctgtaattccagcactttgggaggctgaggcagttggatcgcctgaggtcaggagttcatgaccagtctggccaacatggtgaaaccctgtctctactaaaactacaaaaaaaattagcggggcatggtggtgggcacctgtaatcccagctactcgggaggctgaggcaggggaattgcttgaaacagcgaggtggaggttgcactgagctgagatcgtgccactgcactccagcctgggcgacagagcgagactccgtctcaaaaaataaataaaataaaatgggataataatagtaacaactcacaggatgttgtaaggatggaatgaactcttatatgtaaagtgcttaggagagtgcctggcccaaagtaactgtattttgtttttgttgtggtggtggtggtggtggtggtggtaaagaccacacagcttggagaaaccccagaatctccctcttgttttcctcttactttcttattgaagaactgtagggaaattaccttttttttttttttttaaactccacaggtcatgctggctcagagtttacagtaaacaccaggaacattcagttggttgtgccctcagttcagggcatcttatgtaatgtgctgccctgtgacacagacctagaaaaagggctgttttcaagcctagacatgggaggaaggttggtattcttcgtaatttgcagcaaggcatgaagctgatgtctatcactacagccagccctggacggcattgtttgttaggtaaaattgtcggtagaactctgctctgcctcttacctgtttctctcaccccatctcagggcctcagggctctggcctctgtatgacctggtgggattgagcttctgtaggcacctcttcttgcccacagcctcatacctaactaccgcctcgctccaagtccagttgtctcaggctttctaggtgtcttgctactctggtaaactaattgtatcttatgtatttatggaaagaattaatgaataaacaaatgcatggaggcaatttaaaagcaatataataagcagtaccaacaccactgcctggcccacagcctggcacgcagaggcttttgttgttatgttatagtggctcagtgaaaacttattgaataatttattacttttggtgtaatgcatttactatcctaaccgtatgtttgaagcccagttcaaatgctctatcctttgttgaactgttcttatatcaaataaaaattcttccttttctgtaatagaactttataggaaagtttatatatataatattctttagggaaagaaaaaaaaacaacctttatattaccttacttgattcttgtaacaacctggttaggattatcatcttcattttataattgaaactgaggcttaggtatatgaaagagctcatttttatgcagctcttaagtaatgaagctgaccccaaaacttactttcatgtatataaaatgtacctaataagtgttcagtaaatatggggggaagaaaaaacttactttcatttagtaaattatttttacctcagtacattatataggcagatgtatattttatgaagttgtgcccatattttagcttccccactagaacagaagcccttttgatctgagaactgtcccatcttgttgcctctgcttcccagagcttcacacataataaatgtttgaaagtaaattgctaattttaacagggttcttcagtggcagaatttcatacaaaatcattgtagtgaaagaaaaaacctttagtaaggagacaaatcaaacttttttcccctgtgtagagagctccctaatgggtcttcttatttttttagaatgaactgtaggacatacccacaagggtactctttctgatgggtgatacgaggctcagggtttgtggcaatgaactttgctctttcccacacctgaagctgcagctgtaacacacatcagagactgaaggacagtggcgctggaacacgaccaggcctgggctgcggttcgccttggtgaactgagattcatcactattaatatctgagtttccattaataacccttttcactgtgagctcatttaaatcttctgttctctaagctatttttaaccacacattcttgggcctgggcctggttcccgcttacagatcataactttcattttgatttttttttctttttttttttttttttgagacagagtcttgctctgtcgcccaggctggagtgcaagtggcacgatcttggctcactgcaagctccgcctcccaggttcacgccattctcctgcctcagcctcccgagtagctgggactacaggcgcccaccaccgtgcccggctaatttttttttttttttttgtatttttagtagagacggggtttcaccgtgttagccaggatggtcttgatctcctgacctcgttatccaaccgccttggcctcccaaagtgctgggattacaggcgtgagccaccgcacccggctcattttggtttttgtacttgcagaaataataggaattctgcccaacccctcactccctccacccccacatttctcagaggcgtgtattgaaattgtaggtgggacaattctttgttatgcgagattttatcctatgcatggtttgaggttaatatacctgtcctctgccctctaatgcctgtaaggctttccaatcattgtgacaacttaccccaccactgccaccaccacacacacaggcgcgcgcgcacacacacacacacacacacacacacacacacacacacacacacatttctaaccctccccaaagtgaaccgtactgggactgattgaaagccattataaccagacacctctctctgccacccttgatctctctctgttgacttgagtccctatccaaggtagaactaggaaacaggatgttactctctatatcctgagaaaagcagcttttctgtttccccagagctctccactttgtgaaatagagaagcaaattaagatcttggggattgaactgctgagaccagttgaatatcattgttgctctgtcaagacaggttttttaaaaaaatattagccaggcatggtggcatgtgcctgtagtcccagctactcagggggctgaggtgggaggatcccctcaaccctggggaggttgaggttgcagtgagctgtgatcatgccactgtactccagcctgagcgacagactgagaccctgtctcaatttaaaaaaaaaaaaaaaaaaggcagggggcagggtttaaccacaagattttattctcttaaaattacatgaaggctggggagggggacagggactggggaaaggctgttagttagtatggaatttctttttgggtgatgaaaatattctggaattaaatagtggtgatggttgtacaaccttgcaagtatactaaaagctactgaattgtacactgtaaagggtagattgtattgcatgtgaatcatatctcaatttttttaattgcttgagtctgctactcttaatatttccctacctgtcatctgatctcccaagcttgaaacttttatctggcagttacttttgactcttctctctcccgcagttttcatttctagtgggtcactaagacctaactcctaagtaattctcaaatacctttttttctgtccccactcccagtgacattactcaggctctcccttgcctgtactgtcgtgactagctgttaatttctcttcctgtctctagacttctcctaccctcagcatctttccaggatgtttccaactatgtcttcaactttttattgtgaaatggaatacacacacaaaaattatatataatatatactgtactataaaggaaacacccatgtaattaccacccaggtcaaaaaattgccagcatcccagaaatccctgaatgtctctttccagtcatattcttcttattccactccatcccttcttccaagtatcatgacttctgtggtagtcatgcccatgcttttgtttgcagttttaccataagtatgtgtattctcaagaaatattgttagttctgtttatttttgaacttttgaaatcacatttttatactcgcttccttctctcaactttgtgtttgtaaaatttactcatgttgtgtatatagcttggttgtgttttcttaaaatcttgatctgatcctgtttcttccaatcacatagatgctaagttcaaactccttgataatggcagcattcaaggtcctccaggatcctgtcttgtaacctgcctctccatcttcatttgcagtgacctctctccccacatcctttcccataatcacatcaaagatgccctgtctttctttgagtagggatcttgctctgtcacccagcctggagtgcagtgttgcagtcacggcttactgcaccctcagcctcccgtatgccctctctttctatgcgtcctgtgcttaaaatctagactgtctttctactctttcaacctagtgtatttttgactccctcctcaaagtagaatagactcattttcataattatttatactctctctccctgttttaacacttataatatgtcttgtattgtaagtgttataggcccaagcatctggagttccgatgtccgaaggcccaaggatttggagttccaataatgtccaagggcagagaaacatgggtgtctcagcttcagaaaagaaaatgttttccctctgcctttttgttcttccaggctctcaacaaattggatggtgctcacccacactgggtgagaatggatcttccttactcagtccactgattaaaatgccagtctctcccagaaacaccctcaaagacacacccagaaataatgctttaccagctatctgggtatcacttaacccagtcaagttggcacctaaaattaaccattacactgttatattctcacttcttttgtattaaaaaataactcatacactttattccattgaatatcatgaactcctatgtttgcagattcaattagttataaacttaaaatgttacaacttggacattgggagcccctttaaatcgtatcttttgactcaacatctctctctctctctctctctctctctctctaacattttttgtagagatgggatctcaccatctttcccatgctggtctcaaactcctgggctcaagagatcctcctatcttggcctcccaaagtgctgggattacaggtgtgagccatcatgcctggccaagtccttaacatttttttttctgtgatttattttttcctttatttattttccccatcacaaatttcatacacaattctgtgatatattttaaagcaaccttgcttttattattgaacaaaaataattttcaggcttaccttaaatttttttttaacttcacaacatagaatcaacccctttccagagagttttgattcctttggtagagaataatgcaaaggacccacttctaggactctaggtgcacatgaggttgtagaggttgtagtgttcataagcactgttgctgtcatgggctactcttagtgactgagttggaaagttaattttttcaaggttatgagttcacataagggtgctgtatctaacttttcttagaatgcttggttttattgaccattaatactgtctcctacataaatattaggaagtatttttaattacttgctgtgatcagttccattgaattatgcccaaatacaggcctggtgagagatacatgttcaaaacaattagaagataaaagttgatatttatacataacacattttgtaaaacatatataccttactttatctctttctgtgactatgtgagatggatggaatgtgatctattttacgaacaaggaaactaaggcacacagcagaagttaagtgactcattagggtcatgcagctaataagtaaaggctggaattttaacctgtatcttcagaatctaaatcctgtttattttccactgtctgtacatcctttcactctctgccttcaagacgcttgcaaacacttgtgtacctgaaataacataaataacattcatgatgaagcttgtagctttataaaccaaggattgcttccaaatgaaatctatacttataatcctttcagagaaaacttatgatctgaatgactatattgatagcttaagaaagtatataggggccgggcgcagtgctcaccgcctgtaatcccagcactttgggaggccaaggtgggcagattgcctgagctcaggagttcacgaccagcctgggcaacatggtgaaatcctgtctctactaagaatataaaaaattagccgggcgtggcggcgtgtgcctgtagtcccagctacttgggaggctgaggcaggagaattgcttgaacctgggaggcggaggttgcagtgagccaagggcgcaccactgcactccagcctggctgacagagtgagactccatctcaaaaaaaatgaataaataaaaataaaaaagtatataggttctagattaggttgggatggatttatattagtaaatcaggttatattctagtttattgaaagctcatgtccatttggggtaaagttgaaggttctaacaaagataaagtattaaatttctaggtatagggcaggcttggtaaatgggtatagatgttttaatataggggtttgcattctagacgttaaactgctgggcttgattctgtatttttgactgctacagtgtaaaaaatatttttgctcagagaaggattaaggacagaaatggtttgtttcagtcttagaattttatttagaatttcactagggttgagcatgggcaatgcttgccttttcctctaggaagccatagctcctcagttggaatctgcaaacttttgctctgaggtcttgggagaaactgagaccttgggaatgcatcccggactccagagagccctattcctcagggtcaggatgtctcaagatgaaaaattatctaaaaactatgtttcaactctaatatttatttagctgcattttccactcaggcacaggcaaagaaaagtgccagaaataaaaagaccagggatttttcacttcttaagatgaaaaggtcctggtgctttatatccagaagtgctcatcacttacctccacacaaagaggcaactctgaacctgctaagtggccacaccagattataaagttacaaagaaggctggctgcaaggcacctggagcctccctgtgccacctcccctctgtggagctctctcttgccctgcctaaacattcaggattcattcctgtctaaagccctgatctccattctgtattagttttataccttaaagtaaatctaaattgtgtagaacactgctgggcaatttttgcagtttcagagacaagactcattttagaataaaaggctttgggtcctatctataaaaaaataaaaaaagactagagtttttgtcccagctctgccacagacttccatgtatgagtttagtaagatattaccattttctcaaccactgctccttgatctgtaaaatgattatgataatccctttctttccctactcataaggcaattttgaaagtatgaaaagggatttatattctgaggtctcatcagtactgagtcctcagttggcattcagctcagctcagttcccgtgctatctctagaagggaaggagaggcactgtgcctgtcctcccagagagagtaaggaaggcttttgggcattcaagtggaatcttgaaggattaataggattttcacagggaatatcacattaaagcagtttgcttttcctggaatgtcagatgttttgaggctgagaaataggcatggaggggagggaaggttgaaaatttcaggtagcagtttggaaccaaatgaaggaaggcccttgaatgctatcctgagtagtttagacttggcactgtaggacagtgcttttcaaactttttcatattacattatacaaagaaaacaatactttaatgtcaggctgcaggtagctattggcaaggggtaactggcccagggactacagtttctctgagggctaaaggaattaaaaacttttaataacttggcacttcatcactggttgaaaagcactgctaggcaataaggagcctggttaagaaacttcaggaaaaatatttcttctttgtctctccagagtctaagattgtaatgtgacttctactctagattcttgccttgggagcctggcccttggcgaaatcgagtacaccaaaaatgagtcagcctatcactacagatcctataccattaaaaggttaataggagattagtaattgccaggggatggaagaaggggaagatggagattgactaatgggtatgggattgctttttggggtgatgcaaatgttctggaattagataatggtgatgtttgcataatcttgtgaatatacaaaaaaccctaaattgtatacttgaaaggggtgaatattatggaatataaattatatctcattaaaaaataaaagcataataggagaatgttatgaacaactttacttcaataaatttgataaatgaaattctataaaagacacacatatcaaaactgacacaagaagaaagcaaaaaatctgaagagccctatacctgttaaaataatttaattataattttaaatatataatttaaatataattcatgggcctcatttgtctgcccttcccccaactttgccctgattttcactaaatctttgcttaattcagtgctttggatataactgagatcagttctttcaaggacatgagaatgaggtccctcaagagaataacttttgtttctccaacatgcagaggactggcaacagctcatctgttgctttgccaacgggagaggtaagaaacctccaggcctggatggcttcttcagtaaattcaatcaaacagtaaaggaaacataatccctaaattgatcaatagattcagtgaaaccccagtcaaaatcccagcacttctcttttttgggtaaaaattgacaaactgattctaaaatccgtatggaaatgcaaaggaccaagaataaccaaaacaactttgaaaaagaacaaagttggagaacttacactacctgatttcaagacttattataaaactgcagtaattgagacagcatgatactgacatatatgaaaaatgatattatttaaacataggaagtctagaaataggcctacatgtatttgatcaattggtttttaacaaaaatgcaaaggtaatttgataagaaaaggatatttcttttcaacaaatgctgctagaacagctggatatccatgtgtaaaaaaattgaaccatgacctttttctcatactctatacaaacatgggtcatagacaaatatcaaagctaaaattataaaacatttataagaaaagcaaaaaatctttttgaccttggggtaggcaaagatttcctagataagacacaaaaaaaagcctaaaccattttttaaaaaattttgtatttccacaggtttttgggaacaggtggtatttggttacatgagtaagttctttagtggtgatttgtgagattttggtgcactcatcacccgagcagtatacactgaacccaatttgtggtcttctgtccatcaccctcctctcaccctttcccgagtccccaaaattcattgcatcattctttcttttgcttttgcatcctcatagcttagctcccatttatgaatgagaacatacaatgtttggttttctattcctgagttaattcacttagaataatagtctccatcccatccacgttgctgtgaatgccattaattcattcctttttatggtcgactagtattccatcatatatctatctgtatagatacatatatatatctcagtttctttatccactcattgataggtatttgggatggttccacatttttgcgattgcaaattgtgctgctataagcatgtgtgtgcaagtatcttttttgtataatggcttcttttcctttgggtagatacccagtagtgggattgctggatcaaatggtagttctacttttagttcttcaaggaatcttcacactgttttccatagtggttgtactagtttacattcccaccagctgtgtggaagttttcccttttcactgcatcgatgccaacatctgttttgttttttttttaatggccattcttgcaggagtaaggtggtatcgctttgtggttttgatttgcatttgcctgatcattagtgacgttgagcattttttcatatgtctgttagccatttgcatatcttcttttgagaattgtctgttagtgtccttagctcactttttgatgagattgtttttttcttgctaatttgcttgagttcattgtagattgtggatattagtcctttgtcagatgtatagactgtgaagattttctcccactctggcctgtttactctgctgactgttccttttgccatgcaaaagctctttagtttaattaagtcccagctatttatctttgtttttattacctgtgcttttgggttcatggtcatgaaatcttttcctaagccaatgtctagaagggtttttcttctgttatcttaatagaatttttatagtttcaggtcttagatttaagtccttgatctatcttgggttgatttttatataaggtgagagacgaggatccagtttcattctactacatgtggcttgccagttatcccagcactgtttgttgaatagggtgtccttttcccattttgtttttgttcgctttgttgaagatcagttggctttaaatatttgggtttatttttgggttctctattgtgttccattggtctatgtgcctgtttttataccagtaccatgctgtttaatgactatagccttatagtatagtttgaaatcaggtaatgtgatgcctccagatttgttctttgcttagccttgctttggttatgtggctaaatgactcaaaaaagcctgaaccattttaaaaattgatgttggactcatcaaactcagaaacgtttgttctttaaaagataccactaaagactgggtacggtggctcacgcctgtaatcccaacactttgagaggccaaggtgggcagatcacctgaagtcaggagttcaagaccagcctggccaacacagtgaaaccacgtcttaaaaaagaaaaatacaaacattagccaggcttgatggtgggtgcctgtaatcccagctgctcaggaggctgaagtgggagaatcgcttgaacttgggaggcagaggttgcagtgagcccagatcacgccattgcactccagcctgggtgacagtgcaagactctgtctcaaaaaaaaaacaaaaaaccacaagataccactaagaaaatgaatatgtataattattatttgtcaattaaaaataataatttaaattccaaaaaagaaaaggcaagccacagactgggagaaaatgtcctcccttgctcccattatgtgtgtgtatatgtgtctgtgtctgtctgacaactgcatccagaatatgtaaaggacttataactcaataatacccccaaaattaattctaaaatggtgaaagaattgaacagacctatcacaaaagaagataaatgacaactaaacacatggaaagttgcttaccatcgttaatcatcagagaaatggaaattaaaaccacagcgaggctgggtgcagtggcttacacctgtaatcccagcactttgggaggccaaggcaggtggattacttgaggtcaggagttggagactagcctgggcaacatggtgaaactccatttctactaaaaatacaaaaattagctgggcatggtggcaggtacctatagtcccagctacttgggaggctgaggctggagaattgcttgaacctgggagacagaggttgcagtgagccgaggtcatgccaccgcattccagcctgggcaacagagtgaggctctgtctcaaaaaaaaaaaaaaaaacaaaaaaaaaccaaaaaaaaaaaccacacagtgagataacattacccatcccctacagtcgccataatgaccaagtcttgtgaaggaattagaattctcatacgttgttgataggactgcaaaaacagtacaacaatttcagaaaacaatgtggtagttttttgtttttttgtttttttataaaattaaacgtagacttactatgtgacccatccattccactcctaggtatttaaccaggagaaatgaaaacctatgctcacaaaaaagacttgtacaataatgttcatagctattttgttcataatggctccaagctggaaacaaccttatttattatccctcaataggtgaatggctaaataatggtacctccatcatacactactcagcaattttttaaactactgatacatgcagcaatatgagtcagtaattacaacttcatgttgtgcataaaaagccaggcacaaaagaatatatactgcatgattccattttttgtgatgttctagaaaagacaaatttaatctatagtaacagcagatcagtgtttgcctggcaccaggatagggagtgaggattcacctggaaagggcacaggggaactctttggggtcatggaaatgttgtgtcttgattgaagtggtggttagatggtaaatacatttgtaaaattcagccatctgaactgttaagatggatgcattttacgttatctaaattatatctatgtaatgatgatttctggcaacaaggaaacaaaagaaaaaaaaaggatcagcccagggtcattcttttaattctgtatactgaattcttacaaattaaacaaaagcctttccaatagctcctagagaggctaaggaagtctctgtatgggaatgttttccagctacatatgcaatacttcaagcagctggactgatgtaaattggggctcccaggagcaagatagtccatttacttgatcacctgaattaatctttggaatttggttctgtttctcatgtcatcctttgaatgatttccctccatttttgtagaatactgtgaccagggaagagaagccaagttcctgaagggccccattatttgttcattctgtaccttggaagtagcttttcatgatactgtatttgcttatgaccagcaaattccactgtgtactggactccagatggctagtccagatgggaaaagctctccagaaagcaccagactttgtgcgcatgttcatgtgtcttcacagtttgggcacctttgggagagtcagtctagcacagtccagaagctctgcctgacattttcaatcctctgtcttttcctgtgatcttaaaatgtcagaaattgaagtgatggtgggaacaataataaagtcaacacttgtacgttatagatgaggaaatggcccagagcaggaaagtgtttattttcccccataagttcacatttcaaagacagctggaatcacaacctgaatatctaaactcctgatacatttattcctctagtgcaggtcactaagtcaaggctacatcctgtcaatcatcattaacaatttagtgcattgtttctcaaaatagggtccttgaatagtctgtagtagagtcatttgaggtttgtatccctggactgtactccagacctactgatctgaatccctgttgagactgaggcctggtattctccattgtgaacagatgtcttagtgattctgatgcacattgaagtttgaataccactgttgaagacagtagtgagctaatttaaagcaaagaagtaaaacaatcagatgtatatttacgaaaatatggaaccaggtctttggagggcctgcgggactgagagagaagcctttgtcccagaagaaaggaaacaatttatattcctgggcatcatttgtctactcttcccccagctttgccctggttttccctggtaacctttgcttaattcagtgctttaaatataactgagatcagaccattcaaggacatgaaagcaaggtccctcaggggaatgacctttctttctccaatatttaaagggttggcaacagctcatttgttgctttgtcaatgggagaggtaattcccctaatggatttcgagtcctctgtagaaaggttgacctggtctttggggaatgaacctcacagaattcaatcagtgtaattactgatacagggctttttggtttcccagatgtgaccctgtctctctcatacacatcaaattcatcttgtccctttgtctttcatgtggtagaggcagagaatggatagaatgcaccataatagacttgtcagagagatgtgactgtgattctcttctccatcataatgagtcataatacagcccacccacttgctcaagctggaaatcttgaagtctttattcttccttctccggtatctcccatattctgtccattatcaaggttagtcatttcagcctctgaaatatatcttggttgcatatgccctcttcaatgtatataccttttgccactgccctggtccatatcaccattatttcttgagcagtagtctatctgggcttcctactcatgctcttgccctacttcaatgcaattattataggccagaatgatcttttagaattttaaatatggaaaaatttaaaaccattcacagctctcatgttctgtttacttaaaaatatagaattatgtggattaaaatgtgaaagttccctgtatcttttctcttatatgcccattcccctcaacaaggagccattggtagcaatttgaaatgcttttctaagcatttgtaaaatgtgtgtatgtgtgtatgctatatatacactttatgtggttgtatgtatgtttgtgtacataaacatggtatatttaatataaataatatgtgaataatataaatagtataatacatggttctcaagctcatttgccaatatattgatttattaatcatgcccctattgagggattttatttaagataaaatctaaacttcaatctacccctgccttttgcttgttctactttcccctttgtttactgtgttccagccatgacctcctgtcaggttctcccataacccaagctcgcttcctcttcagggcctttacctatgctgttctccctgcctgagctactcccctgggtgcacgacagtagttcccatatgatggactgctgtgtcctgggtccttcaaaacacacacactccctcacacccagtattgcttatgaactgaataagtgttttccatgaatttgtacttttttccccaaaaaatatggatattctgattaaaggaatcatgaattcattgtagttttttcttcattaacaaatacttaaaaatatgttattttctggaggaattctcagattttttaattttataatattttaaaatatattattataatatttgacttaccttcaataattttctctccacagttttctcatcctcccgacataaacgtcaccaaacttacctttatcatttgagtacaccaaactttttcatatacagtgaatcctcatattcacacattctagattctgtactcactgaaatttacttgtaaccccaaaatcaatactcaccatgtatggactgaatgtttgtgtccctccaaaacgtgtatgttgaaatcttatccctgatgtgttggtattaggaggtggggcctttgggaggtgattaggtgggctgtgagggcagagccctcgtgaaggggatttttgcccttacaaaagcagcttgagggcttccgttgtcccctccaccatctgttagaaacagggccctcaccaggcaccaaatctgctggtgccttgatcctggactttccagcctccagcactgtggactgtaaatttcatgtttataaataacagtctgaggtattttgttttaccagcctgaacagaccaaacagcatgctttggctgttaatctcagacattcacatggacagggcagtgaaaacatctgagtctcctgacgtgcacattcccagctgaggtggcacaaggcagtgttttgtgtacttatttcacctctcatcctgtaaacaagtgtcttctttgtcatatatcgggtaccatgttttttgcatttttgtgctttttgttggtgatttcactgtttaaaaagatccccaagcatagtgctgaagttctgtctagtgtttctaaacacaagaaggctgtaatgtgccttactgagaaaatacatgtattagataagctttgttcaggcagagttgaagtgctgttagccatgagttcagtcttactgaatcaacaaatattaaataaggtgtctttaaacagaaacacatataaaacgaggttatgtattgaccgattgataaaaatgtgaccagaggctaagaggaacctaatctggtatttttcccctagagcaggggtccccagccccctgggccgaggacccttaccagtctggcctgttaggaactgggcctcacagcaggaggtgagcagctggtgagtgagcattactgtctaagctccacctcccatcagatcagcggtgacatcagattctcatagaagagtaaactctattgtgaactgcacatgcaagggacctaggttgcatactccttattagaatctaatgcctgatgatctgaagtggaacagtttcatcccaaaaccgtccctacccctttccatggaaaaattatcttccacaaaaccagccgttggtgccaaaaaggttggggatcgctgccccagaggaatgattcaatattaactaatacagtgtttgtgctgactttacagaccataactaccagaaataacaagagtcacctatactcatcttactctcttttcctgaaagttctccctccagcagtttttcttcacccagcaaaactcttcacatccttcaatacccaatccaagtgccacctgtcctgtaaaacttctgtgactcctcgaggcaagcagagtagtcctctccgtcaagcatccactgttcatgtgggtgctgagaacacctacatgaactgtgctgagaacctctgttcataccattataagagcactgaccatgtactgagttacctatgtactgtacttgtctgccctttccataagtcatgagatcctgaaggacctggcattactggatttcataaatgttgattgaatgattggaatgaggaagggagagtttgtgtaggtgtgagtaagtgctaatggaaaagacattgaaagtgaaggaaaaagaaagtggattgaataatgaatatgatcagggctcttgtaaaggacccctgagttactccggtggtagcaaactggttcggacatatggttacagcctgtattgatcagtgacctaagttaccttaaatgaggaaagagtttattgacccggaaagtctaaggggaaaatctaaatctggcctcagcctcaggttaagactcacatttcgccattctaactggtgtgagatggtatctcatggtggttttgatttgcatttctctgatggccagtgatgatgagcattttttcatgtgtcttttggctgcataaatgtcttcttttgagaaatgtctgttcatattcttcgtcaactttttgatggggttgtttttttcttgtaaatttgtttgagttcattgtagattctggatatcagccctttgtcagatgagtagattgcaaaaattttctcccattctgtaggttgcctgttcactctgatggtagtctcttttgctgtacagaagctctttagtttaattagatcccatttgtcaattttggcttttgttgccattgcttttggtgttttagacatgaagtccttgcccatgcctatgtcctgaatggtattgcctaggttttcttctggggtttttatggttttaggtctaacatttaagtctttaatccatcttgaattaatttttgtataaggtgtaaggaagggatccagtttcagctttctacatatggctagccagtttccccagcaccatttattaaatagggaatcgtttccccatttcttgtttttgtcaggtttgtcaaatggcgatcattaaaaaatcaggaaacaacaggtgctggagaggatgtggagaaatgggaacacttttacactgttggtgggactgtaaactagttcagccattgtagaagtcagcgtggcgattcctcagggatcttgaactagaaatgccatttgacccagcaatcccattactgggtatatacccaaaggattataaatcatgctactataaagacacatgcacctgtatgtttattgcagcactattcacaatagtaaagacttggaaccaacccaaatgtccaacaacgatagactggattaagaaaatgtggcacatatacaccatggaatactatgcagccataaaaaatgagttcatgtcctttgtagggacatggatgaagctggaaaccatcattctcagcaaactatcgcaaggacaaaaaaccaaacaccgcatgttctcactcatagatgggaattgaacaatgagaacacatggacacaaaaaggggaacatcacacaccagggcctgttgtggggtggagggagcggggaggggatagcattaggagagatacctaatgctaaatgaggagttactgggtgcagcacaccaacatggcacatgtatacatatgtaactaacctgcacgttgtgcacatgtaccctaaaacttaaagtataataaaaataaaaataaaaaaagactcatatttcatcaatatccatcttttaacctgcttgcatgctctcgctctccctcactctcacacgtactctttttctcttgctctctctcggttggctgttcttaggcgacaaatagtggttcctgcaacttcagggaaatattgtgacaaccctttgtccagtgacacagccagtttgagtaacacaaaacaaaggtcctggagttgaatcttaatgactctgagctggcttggaacataacgcttgtcgctaaactgatcacagtggcatgtaggatgaaatggtgcaaattggcttaatctagattaccatgatctactccttgaagcctatagttggagtcagctttatataaaggattctaggtgatcttttgtgtttatggtgtctgtgtaccatcttacctggaatagagattgtgttaaattaacagatcatctgactgagaggtttttttcccccaaaacagaagcaaataaacattattttgttcctttggtataactttcattgaacagttatatagtgctttggaagtatcaagtcctgtgctaaataaatgctggagatacaaaagcccctgacctcagaatgtcatagtcttggggtaagaaaaaattcattctgtgcccgaggagcaaataagttcctttagagtccgagggaaactgtacttatctgccctttctcagatgaatgagtccagaacaaatacagttaactatgctgctctcttctaggggatctgcatttgaggagtggaaataactttggactaggagctgaggcctagattctagttgcattattgccatctgccatcaccaattaactataaacttgaattcataaactctgtggccagtgtttctcaaagtgtagtgagcaattcatctgcagtagcttcacctcaagttctttgtgggtctggacccacagaataagaagatcttgggctgtggtctctgtaagttgtttaatctctatgaacttctttttcctcacctgttaagaggatcctatttaccttgcagcatttgttaaaggattaaatgtgataatgagtagaaagcacatggcaggtagcaagagctcagcaaatacacttttaaaaatttcctcagagagtataaagtctctatggtccagagtagtcgaaggattgctagaggaaggatagcaaaaagcctttcctcgctcaggaagtgtgccttcaaaaatgtgtaactgttacatgactcccactgtactcttgtaatgtttgctgttaactattatgggacacgagactggcatagtagcttcgtgttgaaatatattaggatagacttgtacatcatatgttcagaagtgagatcagattcccctgtgtctttgtgtttgtttgagctagaactcaaccacatcaccacctgagagttgacagttgaaaatatttctaaacctccagaatcttctatcttctgccctgactttggtataccaaagataacagaactcttctttgatgactaaggacttctcaaggtctcaaatcatcttttctgataccaaatctcacgtgccttgtggctaaggttgtagaaggggcaagacattacttggaagaggcttttgcgaaactcctggaataggcgtgtccttttaacttcccgctttctgaagagggtaaaaccaaaaactgccagtaaacctagagaatcctatgaagtgaggtttatggttaatctgaatctaactgaggttactgggtgatacctataatttaaacctgttaggcgggtatatgaagaacataacagttgtatcttcaaaaagctctttgccttattttttaaaaattcaccaataacaaagactgactctctctctctcacacacacacacacacacacacacacccctacacacctcttagtgaagctcccaggtggagatgtggttattcagaagaacacatccctctgttctaagaatctgagtaatctgattaaatgaggtgttaccatatcatgttttcttagttaaaaaatacataaggggctgggtacagtggctcatctgtaattccagcactttgggatgctgaggtgggagaattacttgagcctatgaatttgacattagcctagccagcatagtgagactccatctctaaaaaaaaaaattaactgggtatgatggcgcatcctgtgatcacagctaaatgggaggctgaggtaggaggatcgcttgagcctaggaggtcggggctacagtgagccatgtttgcgccactgcactcccgtctgggcaacagagggagaccctgtcgcaaaaaaaaaaaaaaaaaaaaaaaaaaaagaaaaagaaaaaagtaagtctctcaagataggggagaatagaccttaggtagtctcttgtccatctattgatctactcttttttttttttgagacagagacagagtcttgctctgttgcccaggctggagtgcagtggtgcgatctccgctcaccgtaagctctgcctcccaggttcaagccattcttctgcctcagcctcccgagtagctgggactacaggtgctcgccaccacgcctggctaattttttttttttttttttttttgtcgttttagtagagacggtttcaccgtattagccaggatggtctcaatctcctgacctcgtgatctgcctgcctcggcctctcaaaatgctgggattacagacgtgagccaccacgcccagccttgatctactctttgagcccttcttctgtcacactccccaaccttcccaccctttgtttaggccaggagtcaacaaacaaatcctgccaccacttctttttctaagcagttttattggaacacagccatgcctgtttgcttatgaattgtgtatggttgctgtcatgccactatagaactgagtagttatgacagagaaaatatgacctgtaaaacccaaaatatttgctaacatccttaacaaagtttgctgatccctcaccttgcctctttcttcaaaatctccagtgttgagtattctccagtttccaagagacctgctttggaccactcatttagaaagttcttacgttctaaaaaaaataaaatttggttttccgtagactgctcctgctggtacttgttcaacttgagtatgttgagtaactaaaaataaatcaaatcgctcttccacatattggcggccctttatatcttagaacaacactatgatcatgactccaggcagaatcttgcagaatcctggtgtgataaactttcacgggccttcattgtcaccagaagggagcataacactcttgcacagctaaattgtggcccacctaggttttctgggcgccaagagcaataagaggaagttatagcctcattctacatgcttgaagaccttgagatctaacccaaaggatagagacaggttcatgtgacatgtactgtctgttcaacagctaggagtgatgcaacttccaggtcatatgtacccacactttgtggtcttgatggttgtgaaatggtttgttttctgacagaaggaaaacagtcacttctatttcatcagagatgggagtggcatacccttgatcctagacacaaattcttttttccaactttcttgacagtagaccctatccatatacttctttaagccccactgttaagtaaagtgactttcattgtcttttgtctccgttattactaccctaatttagattgccatcttctctcaccattgcagactatcgcaacagcttcttaattgttttcttgtctcttattttttatttttctggtttgtctcccgcactttgccagatgagagcacagcattggttaacatttctctgctgatctatactcttcaatggctccccgttacaaataaaggaaagatgaaacttcttagggtggcattcaaggcttttcaggacctccaaactcttcctttcctccctcttttccatattgagaagactgtgccatattctctgaacctattttatctgttcccatgcccaggccttggtcattggtcatactgtatgttgtatttaaaaaaaaaaaaaaaaaaaaaaaaaaggtcctgttcttcctttccaaaaccgcatatcaaaccctaccttcctcattgtttgtgttcattgctccttctctctcgtgcatgtttgctttctctcatgctgtttctctctcttaaccctgaaagtttgattccctgcttcagtggtctactagcgtattatgtctttttttatggtgcttacaaaaaaatcttctagttttagggatatatattaatgtcttaacttcctgaaactttgtaaatattgtaagttacttcaaaggagtatttttgggccttgcctctttatctgtcaaagcattcaacacattttgtgtttgtttttactgaattctatacaaggagcttgttgatttctcatgaaatgtaccttagatcccaaagattttcacctttttttctaaacgttttatagttttacattttacgtttaagtccatgattcattctgagttagtttttgtataagatgtgagacttagattaaggtctttactcccctatggatgcttgattgctttggcaccatttcttgaaaaggccttttcttttcttttttatattaaaatttttagtagagacagggttttgccatgttggccaggccaatctcgaactcctggcctcaagtgatccacctaccttggccccccaaagtgctgggattacaggcacgaaccatgacaactagctgttttcttgattgaattgcttttacacgtttgtgaaaaatcagttgggcatattgtgagggtctgtttctgggttttctgttctaatccattgttcttcacttgatcttagccaaacggccaagaattgatctattccacttttctgtgtctgtctcttcgccagtgctacacagtcttgattgttgtagctatataataagtcttaaaatctggcagactgattcttcccattttatttttcagaattattttagctattgtgcttcctttgccttttcatatacattttagaacaatcttacgtacatctacagacattcttgtgggattttgatgggaattgtgttaaatctgtacgtcagtttggggagatgcaccaagtcgagttgtccaatccatgaatatggtatgtctcttcatttatttaagtctcctttgatttctttcattagctttgtatagcttttagcatacatgccctgcacagcgatttttttagatttataccttttcaatttttaagaacaattataaatggcattgtatttttattttatatgcctgcatattcatcgctagttagaagtaaattgatttctgtatgattatcttgtatcctgtgaccttgctgaactcacttattcgtcctgagagttttgttgggttttgttgtagattttttgtgttttttctttttctttcttcttcttcttcttcttttttttttttttttctttgagatggagtctcactctgttgcccaggctggagtgcagtggcaccatctcagctcactgaaacctctacctcctgggctcaagcaattttcctgcctcaccctccctagtagcttggattacaggtacccaccaccatgcctagctaatttttgtattttagtagagatgggatttcaccatgttggccaggctggtcttgaactcctgacctcaagcaatccacatgcctcggcctcctaaagtactaggattacaggcatgagccactgtgcccagccacgatttttctatatagataatcatgtcctctgcaaacagggaccatttttttttcttcctttccaatcagtataccttttatatatgttttttgctttatcaccttgacaagaacttccagcaatatgttgaataagagtgataacagtggctgggcacgctggctcacacctgtaatcccagcactttgggaggccaaggcaggtggatcacttgaggccaagagttcaagaccagcctggccaacgtggtgaaaccccatctctaataaaaatacaaaaattagccagtgtggcagtgcacacctgtaatcccagctacttgggaggctgaggcacaagaatcacttgaacccaggaagcggagcttgcagtgagccaagattgtgccactgcactccaccctgagcaacagagtaagactctgtctcaaaaaaaaaaaaaaaaatgataagagcaaatgtccttgccttattcctgatcttaggaaagaggattcagtctctcaaatctaagtataggccaggtttgctggttcacacttgtaatcacagcattttgggaggccaaggcaggaagattacttgagcccaggagtttaagaacagcctgggaaaaatagtgagacccccatctctacaaaaatttagaaattagccaggcatagtggcatgcacctgtgatctcagccactcaggaggctgaggtgggagattcacttgagccaggaggttgaggctgcagtgagccatgttcatgcctctgcattccaacctgagtgacagagtgagaccctgcctcagcaaacaaccaaaaaaaactaagtataacatttgatagtggtcttttgttgctgctctttttcaagttgaagaagctcccctctgttcctgtttttctgagagtttttatcaagaatgagtgtttaattttatcaaatattttttgcattgaaagatatgatcatgcagtttttcttcagcctattaatatggtagatgacggatttcaaatatggaatcagccttacctccttggaataaattccatttggtcatgtgtttttatagattgctgaattctatttgtattttatgtgtaagtccataatccattttgagttaatttttgtatgagattttatatagacgttagaacagtcctgaaaaagctttctctttaatagcatattcaggactcatgtcccgtattctccttgcattatgtgtcagtaatccaacagcaatttttcatttttgtatcatgggttacttttcaggtgaagctcccagaccccccttataaatatttattacatggatactgcacttatcagaatgaagggaacaaggtgccaaataactcacaccatagagaatctattacacatctttatcttattcttttttctgtaatcctcttgctgtccttcttttctacttcctactgtgaaagcttacgtataagttttattaatttgaacaaattaacatattcatggaatgaaaaaaaatcaacagatcttccctgagctcctatatgtgttaagcactctgccatgtagtttttggccacattggaccttaatctcaggatgctcagaacttaaaggggagaaagacatataagcattagaaatgccaaagcagggagtagaaatgtcaaacccggggaaagaaatgccagcgtggggtaagcacaggttagtaagggaaaacaagcagaagcacctccagctctacctgggggagtcaataaaggccttccaggagaagtgacatttgtgctggcactgagagaacatagaaattctccagatggatgaggtaaggtgaaagcctttctaggcagaagccatagcttgtgcaaagacataaagtcatgaaattacatgacttactatttggagaataataggtaatttttagtgctcctgtaaattctgtgagacgaggaattcatgctgtatcctcagcattagaataatacctagagcatagtaagcactgaataaatatttgttggatgtaaggaaacaaaggagggaaagagcgatggaggaaggaaacataattgaggtgagagcggtaagaaagctttggcaataaagaattttgttcatgtcctagttgggaagagacaagtacaaaaacactcatgattgttgtaaaaactgacatgccttgaaaagaacataaaaagcattatgaaggttccgaggaaatagaggtccacttcagatgaatggatcagggaagttgtcactgaggccagacacttagagttgtttgtacttggttctgaattgtttggctttttaaaaacacatggggccccatgccgtggctcacgcctgtaatcccagcactttgggaggctgaggtgggtggatcaattaaggttaggagttcaataccagcctgaccaacatggtgaaaccccgtctctactaaaaatacaaaattagctgggcatagtggcacacgcctgtaatcccatttactgaagagaggcggaggcgggagaatcgcctgaacctgggaggtggaagttgcagtgaacgagatgatgccactgcacaccagcctgggtactctaaaaatatatataaataaataaaacctggaagtggagagaaggtgttgtggtggaagagggatgtgtgaatttgggactagactagacagccttgctgactctgtcataaatatatcagtattttgtaggcagccatttatcagcctacaccacttacttggaagcaaaacctgacaggctctgatattatctgtagcaaacatggttttcttgttcatgagggtgtctgtgttttttgtgcttgcacctgcataccagagatttggggacagctctttccacagagacaagactaacggggacacatcaactgaaatgccagctgaactagaaacagatctttttaaaatgcaccttggtgcccacacactatgtgtctatgtgtgaacctgcagcacacagaagtacatgcataattctgaaagcagtgaccgggttaagattttaaattactataaataaatagtacttatttttatttttctcagctccatcctatctggctatacctcaattttcatttcagtctaaggcttattgggcaccagttatgtctcctttgacctgctagataatagaaggatttcatgcaagaaaatgattcattaattatatatatattgattactagctatgtgccaggcaatattctaaacaccaaggatgcatcatggaataaaaagaaccaatccttgtcctggaggagtttactttctgggaggtgggtgcggaaaagtcataaaaattgatatcttttgggggtatacatgctttgtgagaccagtaaagcagggtaaggggggaaagagagtgggagcatcggggaccaggaatagcctgtccagtaatgtgacatttgaataaggactagaaaaaaagattaagcaatggaaatatctgggggaggagtgttccagggccaggaaacaactagactaaagaccgtgaggcaggagcacgcctggcactgtgtaaggccacgtggccagagcagaataggcaaggcagagggcagcaggagctgaggtgaggggtgggatgaggctcagtcccatcaggcctgtaggccattgtggggactttggctttactctgagtgagatgaacagccattgcagatggtgagcggagaagtggcatcttctgatttacttcctgctttcttactttgcggttgaggatagactgcaggatgaaagggtggaagcaggaagactacaaaatggtggactagaccaggtgagcaacagtggaggtgaggagaagcaagctcattgttgatatattctgaactgtctgaactgacaggatttgcttttgggttagatgtagagtatgaaaggagtcagctatgatacatagatttttggtctgacaactggaaggctgaaggtgctggtaaatgagatgggagagagtgcaggaagaacagatctgggagatatcaggacctcagttttgaacacattaatgttgagatacctactagtgaggagttggatatacaactctagggctagagatataaatttgggaatcacagcaattcgatggttttttaaagctgtgaaactgaataaaatgacctagagagtgggtgtagaaaaaaaaaaaagaatctcagaactgagcattggggcattctaatgttcggatgtcagggaggtgaagaggagccagcactggagactgaaaaagagaggcccggtagatagaaggagagttgagagtgcatgctgaagccaggtgaagaaagtgtttcaaagaggatggaataataaactgttgtcagatgttggagagagatcaagagagatcaagttaaggcccatgagttgatttatcagcactgaagtctttgacacctttgatgagctatttcagtggtgcagttggggtggtggggggatgggggatagcctgattatagtgccttcgaataggaggggaggaaacaaagattagtagtatataatactctttgaagtatcactataaagagaagtagaaaaactgggccatagttggtgaagaattgtgggatcaagtcaaacttttaattttttcttctgagataggaaacgttgatgtcttgatgggaatcatcctagtcaggaggaaaaatgcaacgattctgaagaaggggagaattgttgaagtgatgtctttgtgcacaaatggaaaaaggttggccttcattgggtggactgtctatgctccctagtaacagagctcacagctacaggtgcaggcaggatggtaaatgtagtcatggaacatgtgtaaattttcttttgattgtttgtgttttctcatgaaataagatataaaagagtggaggcattggaggtttaaagagagaggccaagagattgttgccaaagaacaggagaaagtcattgactaggtaaatatagtaggattgttgggcaacatgaggggccacttgaagtaaaagtgagaccagtcagcatggtcatatgattttctccatgtatgtacagccaagtgggaacaggtagagttggcagagcattagacttagctggggtttgctgggtaaataagaggaatggagaaagaagcaagggaataattatgataatggatcgcagaaatagagttggataaggaaagaaaagaggacagggatgaaaggtgagagtgaaaagatggtagaattaatggagtgtagatcccatggggtctaaagaattgtgataatcaaatccttgacatttgtagtgcttcagggtgtatacaaagtgctttgggctcacataataaccctatggggtaggtagggaaaatggtggtggtggtagtgattttcatatagatgaggcaggattcaaagaggtaaatgacttaatcaaaaatcacacagtgccgggcgtacacagtggctcacacttgtaatcccagcactttgggaggctgaggcaggtggatcacctgaggtcaggagtttgagactagcctggccaacatggtgaagccctgtctctactaaaaatacaaaaattagccgggtgtggtggtgggcatctgtaatcccagctactccgtaggctgaggcaggataaatccgcttgaacccaggaggcagaggttgcaatgagccaagatcatgccactgcactccagcctgggtgacagagcgaaactccgtctcaaaaaaaaaaaaaaattcacacagccagtcaatggtaaagcatagactgaacgcagatttctgttatatgtagtctttgtgcaatgtctgcttacagattactcagtcttgttgaagagatggaatatggaagacaacttgagagaatatgtaatcacgtgttcaattctgtggtatggaatggtataaggagtttactcattcagtaatacatattgaaagcttagtaaggtacaaggcattatcataaggactaaggaaacatcaatgaacaagacaggaaatataatcctgaggttacatgtttttagagcagtttctctgtgattcttctaaggcatcatgttttggttaaaagcaggttgtactaaaaagttagaaaacttgtttttctgctacttactgtgtgtaacattgttacttcaactcaccctgccttagtgggggtccccatggataaactgattatggctttgcaagttctcccttgcctaaaaatgctgtgagtttggatctgtattctagcctaaagaaatagttgctctaaagtgtcatcatctaacttcctgatctagacagtgggaatgccacatcttactttatagtgataagaccctgtttacatagtgagatgctgcacaaacatgcattccaaagtaatcctccatttttgaaacttgggaaatctgaaaaggggacaggtcatgtggcacctgcaggtcccacagtccccgtctttaacctatgatatctgaggacctattaaaagctttaaggtcgtctgggcatggtggctcatgcctgtaatcccagcacttttgggaggccgaggcaggtggatcacctgaggttgggagttcgagacccgcctgaccaatgtggagaaaccctgtctctactaaaaacacaaaattagccaggcgtggtggcacatgcctgtaatcctagctactcaggaggctgaggcaggagaatcgcttgaaccctggaggcggaggttgcagtgagccaagatcatgccattgcactccagcctgggtaacaagagtgaaactccatctcaaaaaaaaaaaaaatgcattaaggtcaggcacagtggctcatacttataatcccagtgctttaggaggctgagttgggaggatctcttgagaccagcctaggcaacatagcaagaccttgtctctacaaaaaaatgttttaattagctgggcgtggtgatgtgcgtctgtagtcccagccacccaggaggctgaggtgggaggatcgcttgagcccaggagttcaagattgcagtgagctttgattgtgccactgcactccagcctgggcaacagggcaagacctgtctctgaaagaaaaaagctttgaaataactaatgacttcttccccctcttcttactccttcctgatatgatttaggcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacaggtatgagaacgcacacagatctttctcatagggggttgaggtgaggcccttggattcctggagcattgagagcaggctctagctaaggtttcctgttggaagagcgttcatagataaagggtaaagagtgtgaaggggttggccaaatattagagggacacctggccctaattatgctctaactggaaaccaaaaaaaagtgttggggttgtgataaagctaaaggtatttgtggtgtttccttaggtgcctcaacaccactgccgttcctcatccctcctgttttctctcttccctgtgctgtccagcactctgtgtcccattatctgtcacccatcccatagggaaggtctcaccttggtcccttctctccttcatctctgtctgtcctagcccatttcaggccatcctgcacagtcacacttgacccttgtttgtgcgggttctttgtgatgattattgacgattcagtgttcatttatgtttacttgggaggggacagataaaaggaggaaacagtgatttatgtttgggtttttataatcttcacaaaagagtagctcacctttttgaaatgagtgttaaattgtagaaatgctccttaacatttgtttaggctcatctcaaactctctgggatggttgaagagcagagttttttctggggcagtagaattgacccaggaattctactcgcaggcatattcccaaaacatgtttacacaaacacttgtacaagaatgttcacagcagtattattcataatagccaaaaagtggaaacaacccaaatatccatcaataaatcaaatatggtatatacatatatattactaagccataaaatggtatgaagtactgaaaacatgttaagtgaaagaagacagagaggaccatctttttatgattccgtttgtatgaaggctcagagcaggcaaatccacagagacagaaagtacattggtggtgactgagagtgacagtgtgagaagcgactgcttatgagtatggggtttcttcttggagtggtaaaaatgttctggaattagatagtgatgatatttgtacactttcatgagtatactaaaaaccactgtattttacactttaaaatgctgaaatttatggcgtgtaaattatgtctcattctttaaaaaaaagttcctcaggtgattctgaggaccagccaggttagggagcccctagatgtaagaccaggttcgtggacatgtgaactgtggagtcacaaagagccccatccttagaaggtcttgcacttcgtttaacactccactattactatcttgaagttcttaatagtttttttaacaggaagttctgcgttttcattttacactgggctctgcaaattatgtagccagtcattcctgaactagatatcctaacctaggaattctgtgatttttatcttccttggggaaggataatgagcccctatttattaagttctttggtataatcttcttgcttcctgagtggaatttcctgttttccccaaatctttgtcatttataggtttcatggaggttgtttttgtttttttcctttattttattcctgatggagagcaatgcatattcagtaaaaaaaagtggtagagggaaaggggccccagctggggcagcatagcgagactagagtgcagtgacacaatcatggttcactgtaacatttttatttcgataaaaaataaaaattagctgggcatggtagcatgcctgtaatcccagctactagggaagcttaggtaggaggattggttgatgccaggaattcaaggttgcagtgagctgtgatcacaccactgcactccagcctggatgacagaacgagaccctgtgtcctaaaaaaaaaaacaaaaatgttgggggtggggaataagaaacgaattaaaaggccagggagctgggcacagtgtttcacgcctgtaatcccagcactttgggaggctgaggcaggcagatcacctgaggcctggagttcgagaccatcctgaccaataatggtgaaaacccgtctctactaaaaatacaaaaattaggctgtggtgacgtgcacctgtattcccagctactcaggaggcagaagtgagagaattgcttgaactcaggaggcagaggttgcagagacaagatcgcaccactgcactccagcctgggtgacagagggagaccctgtctcaaaaaacaaacaaaaaacaaaaaaaaaagcagactgggcacggtgactcacgcctgtaagcccaacactttgggaggtcgaggcaggtggatcacctaagatcaggagttcaagaccagcctggccaacatggcgaaaccccatctctactacaaatacaaaaattaaccaggcatggtggtgggcgcctgtaatcccagctacttgggaggctgaggcagaagaatcgctcgaacctgggaggcagaggttgcagtgagccaagaccatgccattgcactctagcctgggcaacatcagtgaaactctgtctcaaaaaaaaaaaaaaaaaagcaggggaagaaaaacttcacaaacacaccagtctcaaagctttcataaatgttgttagcagtggcaaatctatctgggtctgcagcaacctcaattcttgcctcctcagaagaaagaattcggccaaagggcataaggcagagtgagacactgagccatgttttagaagaggggtgaaagtttattaaaaagtgttagagcaggaacaaaaggaagtaaagaacacttggaagagggccaagcgggcaacttgagagatttcagtgcactgtttgacctttgatctggagttttatatattggcatgcttccagggggttgtgtcccttctctcctgattcttcccttggagagggctatctgcatgtgcagtggcctgccagcacttaggaggggctgcatgcacagtgtgtttactaaagctgtacacatgcccacttgaggcattcttttaccagccaagtgttcctagaggaaggccaaataccagttaaactcgaccattttgcctcatagtgtgcgtgcttgagacttgcctatctcctgagatggtatcagaaagctgctgatcaccagtttcaggtgttttctatcgattgggagaccgtctttccccagcaccagctgcaaccagttgttattttagagagtttaaccgcctgactctcacctgatggttgcctgacattcctggtgagatgggggcaggagaggctcctgccctgctcatgtctgcctagctacctactctaacaatgtgagaaatgggtccaagaagtacctcagctttttaagaaataggtatgatgaggggaaaatgtaaccaaaaaccaaatggcttttaattgaattattttcttgtgggattagaggtgttctcatcaagaaaatatattcttgagatgtggcaaaaattactcagtggagatatctttcttaatcacatatttaggctgggcatgatggctcctgcctgtaatcccagcactttgggaggccgaggtgggcagatcacaaggttaggagatcgacaccatcctggctgacacggtgaaaccccatctctactaaaaatacagaaaaatagccgggcgtggtggcgggcaactgtagtcctagctactcgggaggctgaggcaggagaatggcgtgaacctgggaggcggagcttgtagtgagccgagattgtgccactgcactgcagcctgggcgacagaacgagacttcgtctcaaaaataaataaataaataaataaaataaataaaaatcacatatttaaaagatattgtctgaatccttttactgtataggacttcagtacaatgaaaatgtggaaactacattatctgagcttgctttctttggtagcaaggttcatttgttcattcacacattattcattcagcaaaccttatggggcattcattttatgcaagttcctgtcataaccaatgaggctacaaagatgaacagtagagtctgagtactcagacatcatagcctagaggaggggacaggcatgcaaccagatagtaacagagtcatgctataacgggaatcaccaagattagcgacacatacaccaccagcttaggcctccctaaggaggagagtattagagggtgacaaataattgagtgttttgtcaatggccttattaaataatatatttcctagcctgtaatccaagctatttgggaggctaagacaggaagatcgcttgagcccaggagttcaagactgcagtgagctgtattttttaagaggcagggtcttgtgagccctgtcacccaggctgggatatagtggcataatcacagctcactgcagcctcgaactcctgggctcaagcagcgttcccacctcagcctcccgagtagctgggactacaggcatgcaccacggctcctggctaggaaatatattcttttcttcttctttttttttttttttttgagacagtcttgctctgtcgtccaggctggaatgcagtggcacaatcttggcttactgcaacttccacctcacaggttcaagcaattctcctgccccagcctcctgagtagctgggattatagacaggcaacaccatgtctggctaatttttgtatttttaatagagacagggtttcaccctgttgtccaggctggtgtcaagctcctaacctcaagtgatccactcaccttggcctcccaaagtgctgggattacaggcatgagctattacgcctggccggaaatatattcattcatatatatagatatagatatatagatatatatctgtgtgtgttttagtgtatatatacacacacagaaatatgtatatacacatatgcatctatatattttcttaagcctttttaaaggaattattttattagatgtctagtgttctaattatcagagcaagaatatcatctgtgatagaggtttaaggttatttgtgagatccttctgttgaaaacaattggcttttcttctatctcagaggagaatctggtatgttaaaagattcagtcacatgatgggttatgttttaatttagtggctctcttaaaactggattatatctgtaaaaccttcaggtaaaaaattaaaacttaataattcattcagtgttttttttttaactgagaattgggatctgaggagaaacagaaagttaacatttgactactttcttttgcttagtagcctatttcatttaatcactttatcacctttatttccatttttcatatgatgaaattgagtattttttcttccctgcctagcacttttataactccccggggctaaaaatcttctccgtctacccactccccatccttggctgggttcagaagggctacccaactcttatcagccccagaaactcttccttaatgcaacactgctttccttttactggagcctgttgagaacaatccagtcacctgagtcttcatgtcagcacctgctttaggtgaagagtacctaacccttggtggccacaaaaagacataatcgcagctatgtattgagcatctgttctgtgaaagttgagactttacataaattcccactaaaaagtcacagtaatcctttgaaacaacaacgatttgacccaaggtcacacagctagaacacgggacagttgggattctagtctaacccaggcctgactttgcattataatgtgctgtgtttttgtccctgttctcctggaatataagcatctgccagaaacaggcctggatatttttgcccctttggacactatgcattgtactggaagcacccccaggggtccctatggcaggctgaggttctctctgcttactaacccatattgccaaagtccttggtctagaatattcctaatttagtaatttcaagggctttaatccagtcatcaggctctattggttagtctgtacactggggacaaggatgtcttagttcaaatcaccactctgattacatgagcaggtcacttaataaagtctcaacttccttttataaaatagggataaaatactttctgttctcaccccatgcttctgcttctccatggatgcatccagacagacatagaacccactggcagcacctcaagttgcacatttcccaaaggactattcacattgttttctgtgtaggggtatcccctggagttgatcaatccagtgtccctgtccctggtttgctcctatagaggcttcatcatatgtggagcctctttcaagcagatactccctcttttcctttctttccttccttccatctgttcatctgtcctcctttgtgtctgtctttctctctcatttgtctctctgtctgtctgtgcccaggctggagtgcagtggcacaatcatggcctcccagtttcaagtgatcctcccacctcagcctccaagtaactgggactacaggtgtgcaccactacacccagctaaattttttaaattttgtagagacagggtctcactatattgcccagtgtattagtccattttcatactgctgataaaaacatacctgagactgggcaatttacaaaaacaaaacaaaaaaaaaaacaggtttaatagacctacagttccacatgactgaggaggcctcataatcatggcagaaagcaaggaggagcaagtcatgtcttatatcagtggcagcaggccgagagagagctcttacaggggaactcctctttttaaaaccgtcaggtatcatgagaacaacctgggaaagacctgccccatgattcacttacctcccagcaggtccttccaacaacatgtgggaatccaagatgagatttgggtggggacacagccaaaccatgtcattctgcccctgccccctttcaaatctcatgtcatcacattttaaaaccaatcatgccttccaaacagtcccccaaagtcttaactcattacagcatcaactcaaaagtccacagtccaaagtctcatccaaggcaaggccttccgcctatgagcctgtaaaatcaaaagcaagttagttatttcctagatacaatggggatacaagcattgggtaaatacagccattctaaatgggagaaattggccaaaacaaaggggctacaggccccatgcaagtccaaaatccagtggggcagtcaaatcttaaagctccaaaatgatctcctttgactccctgtttcacattcaggtcacactgatgcaagaggtaggctcccatggccttgggcactccacctctatagctttgcagggtatagcctctcttctggctgatttcatgggctagcattgaatgtctgcaccttttccaggcacacagtgcaagctgtcagtggatctaccattctggggtctggaggatggtggcccttctctcacagctccactaggcggtgccccagaagggactctgtgtgggggctctgaccccacatttcccttctgcactgccctagcagaggttttccatgagggccccacacctgcaacaaacttctgcctgggcatccatacttccatacatcctctgcaatctaggcggaggtttgtaaacctcaattcctgacttctgtgcacctgcaagctcaacacatggaagctgccaaggcttggggcttccaccctctgaagcaacagcccaagctgtaccttggccccttttagtcacggatggagtgactgggacacagggcaccaagtccccaggctgcatacagcagagggaccctgggcccggcccacaaaaccattttttcctcctaggcctctgggcttgtaatgggaagcgctgctgtgaagacctctgacatggcctggagacattttccccattgtcttggggattaacattcgtctcctccttacttatgcaaatttctgcagccagcttgaatttctcctcagaaaatgggattttcttttctattgcattgtcaggtgcagattttccaaacttttttgttctgcttcccttataaaactgaatgcctttaacagcacccaagtcacctcttaaatgctttgcttcttagaaatttcttcccccagatgccctgaatcatctctctcaagttcaaagttccacaaatctctagggcaggggtaaaatgcttccagcctctttgctaaaatataacaagagtcacctttgctccagtttccaacaagttcctcatctccatctgagaccacctcagcctggactttattgtccatgtcgctattatcacttttgtcaaagccattcacaagtctctaggaagttccaaactttcccacattttcctgtcttcttctgagccccgcaaactgttccaacccctgcctgttacccagttcctgtcacttccatattttcagttatcttttcagcagcaccccactctactgctaccaattttctgtattagtccattttcacactgctgataaagacatacccaagactgggcaatttacaaaaaataaaagagagagagacataatggagttacagttccatgtggctggggaggcctcacaatgatggcagaaggaaaggaggagcaaatcatgtcttacgtggatggcagcaggccaagagagagagcttgtgcaggggaactcctctttttaaaaccatcagatctcaagagacttattcactatcacaagaaaagcacaggaaagacctgcctccatgattcaattacctcccactggatccctcccacaacacgtgggaattcaagatgagatttgggtggggacacagccaaaccatatcacccaggcttgtcttaaactcctgggctcaagtgatccacccgccttggcctcccaaagtgctgggattacaagtatgaaccactgtgcctgactaccttttttttaaagagttgtgataggactcatataaaaacttacatgtttactttcagctagaagaggtttgtggcagatggagactgtctgttttttcatccttcttgccacctccagattcttatttctactgccaccttccagtcttcacatattccaaccaaaaatgtctaggataaaacctgcaggttcaagaccagaccaggagtgaaagtgagtttgaaatcaacataaggttgaaggaaacaatctcttgagagagaactcgttccaaaaggaaaccaggaatgatgttctagaaggaaaagcagtttcaggaacacatatcaagatgctatatcatatatgtgggatttatttttgcttattttgtgtgtacaaatgaaagaacctcacctgcctcttggaatcaaaatagctgtcagtcctcagaataaggaagcagagagctgctctgagctgtgtttataggcaggcggatccaagtcctcacatttgtggctcagttgtgggcagctatccctgaccagatgtactacacacaaaaagagccatctctcagtagagagctttgatgaattattcatgtgctcaggagtcaacccctgttaggaaagccatcaccccttttgaattctcaaagctgaggacttctcttttccttttatcccatccctcctccatttattcagtagctattctagggcctgcacagccactatcacagggactccgaaaggcagctagctgcacttgagtctcaacattgctactcatttgccttattgatgttgaataaatcactttccctcttggaggttttatcatctgtaaaatggagatgatgctcctcacagcgttgttgggaggttgcacaggtaaagcttggagaatgtacaggtacacattgtgaacagcagctgctcacttcactttttccttgtagtggtcgtagcaatagtagtgatgatttctatgtctgtaggacaagatgaacagaatataatttaaatatttggtgtttttacagaactttatagtctatacaacacttacgcagtctcatttaagcatgaggaaacaaagtgagataggtaggggctgataatatcattcctatcgcaaaagcaaggaaactaaggcttaaaggcactaagtgatgatgccagaaagcagagtggaagggcccagaatccaaggcttttgactaccgtctatggctgtgtcctctgactcctcacttttcccaacccattgtcacagagctgtttaccatggctgcttctaagtcacaaaacggacagcaagaaggaagaggaggagcaagaggtttataaatcactgagaactgactattcttttttttttttttttaagacggagtctcgctctgttgcccaggctggagtgcagtggcgcgatctcagctcactgcaacctccaccctccacctcccgggttcaggcgattctcctgcctcggcctcctgagtagctgggattacaggcgcacactaccatgcccggctaatttttgtatttttagtagaaacggggtttcaccatgttggccaggatgatattgatctcctgatctcgtgatccacccgccttggccttccaaagtgctcagtgctatctgtacatcgatattaacctctgatggctaaactagcaagataacatgatccttcttagaggaacctacaagctactgtgagttacagctcaggcaatttagctcaccagagccccattttgtaactcttggagattttgaaataaggccaaagcctccactgtatcttctctactattttagttttttaccttctcgaactccttggcaggaatttcacagtagtcacatgtctaatcttatggaataaagaattcccaaagttctgaccaactcttctttatatcttccccaccttttctctactaaaattttagtgagactgtcccctttaaatattttgtaaatacttaaacttctagtaatccttaagtttcccgagtaagtcaacactcaaattattttaagtcctgggtcccacctggggtcaaacgatacccataggaatgcttttggggaagtcttcagcatccagtgaggaatgttagtggggtcttcaaatagctctttctagagagaatgactggtgccttaaaagtcaggacctcttattcaagctggatttcttacagcagggagaactgtggtagagccaagtagtccattcagattcattctgatgaccttggtccttcccccaccatgaaaagagagacagagagccagggagaagccttgctcagagaccttactctttctgtcttctcatccctgggagggccttttcctccctcattccctccctgaccttttgggttttgttttattaactgaaatcagaccaactcctctggggaacccttgttggaagccaaaagcaaatgtgggcggtaatatgcatcttctccccaggctgagactcctctctcaaggaagaaagaacagagtggagactgacccaggctccagcccagaggcggaggctgctgtctgaatcacccaccctttttttccactgagacaatgaggaaaataaatatccagaccagtttccagccagatctgaaattctaattcctttaaaaaaaaaagaaagaaaaaaaggttattttaaataaccctgaaatatcaggccttcctcctccatctcttgcttgtcatttttcatttacagctggttctagtcatccacagaacaggccgtgagttcagacatgagctccataaaatcctcgcaaatgtttctgtgttgtcctagaacaaactccaaccttgaccaacttcagggaattccaaatcctctgaaggaggaaaaggagacagggagaaacctgaccctattctcttcgttctaagtcttcatccttatttctgccttttttttttttttttttaaataccagacactccccctcaccaccccagccagccagcatagatagtctagtgttacctgccaaaacccaaagactgttagacttgggagcatctcgtcccaactccacagcgccagaagctttgaatggctcccaaacatctcataagatcccccctacttttttggttgagtgcttctgcttatccctattaaaagaggataataaatgattgttgaattggtccctgactggattccaaagcccagtctaactctaatattgggctagaggtagaattagaactttgtatttagtggtaaggtcaccttggacctctgaagatcttgattacgattaaacatccggttatgtgtagcgctacgtaggattcagaactctacaaaatcagtagatacagtcttctctctctaggatctgtgctgggaaacagagttctggttttaaatttcagctttgttacgatttatctcagtttcttcaacagtaaactaggagtgatttccaaaccttttttaaagcattgctttttaaccaaatctcacatgaaacagaataatttatgaaacaattgagagggagccactttgagtatagcagaggagagggtcaagtgatacaagctgcactcaactgcccacccttccttctccccactggttgcttgggaaggctggcacacaatgtgaggatactggtccgcagcagatgtttcaaaacagggacctgcagggctgcgctacagaaatttttatcagtccataaaaatatgaaaacatgaggaagatacaatccatgttcataaaactaaatgtaatcagattttaagacttccctttattcagagactcttttttttttttttttttttttttgagacggagtctcgctctatcacccaggctggagtgcagtggtgcgatgttggctcactgcaaactctgcctcccaggttcatgccattcttctgcctcagcctcccgagtagctgggactacaggtgcctgccactgcacccggctaattttttgtatttttagtagcgacggggtttcaccatgttagccaggatggtctcgatctcctgacctcgtcatctacccgcctcgacctcccaaagtgctgggattacaggtgtgagccaccgcacctggcctattcagagattctctttgtgcatgtatgttagtgttctcgtgtgtgtgaagtgacagtcttagtaaatggtagttttccatatttgacattattaaaaattggccgccccatgtgtccatttctaaaagtgcacaagtgtataaacaaagaggcagtgttttcacctgtccatgaaatggaagagtctgggaaatagtgatctagaggtgatacgtgtgtcaggactaactggttgccagcttctgcttctgtactcatggccaggggcctctgaactctaccattaagtccaggccccctgcatcccagcataaagccagtgctgtaggatcttttgttcctagccctgctcttgtgtgctagctatggttagccctgggatcttggctaattttccagtgtctcagtctttgccctgataacctgcctgtagtgtcagatcccacccaggagtggaccctgtcctgcttttatgtagccacttctcatagaccagagtcttaccacacctcagaccagtggctggagcccgcctgcccactggaaggcttctgggttgcatgtggtctctctgcctgcattactgaaaaaaatctgcttctcttttcccagaacatgcttcttcctcctcttggattctactgcccacatttctagtgatgcctcagtttctgtttctgtgttcacgtattcagtgcccttaccactcagaacctgcttttgccagtggacaggggttagagaagagcataagacatggacctgctttcagtggactcctgagccttgttatgttctccagtttttgttctctctgccaaaccagccttggaactcctcttagtgattctctctgcctcctctatgtctgcttctaagaggttctgggcttctcagttttcagcaagatttacctgcttttaactgaaccgtgcctggctccgtgccaagatataactaccagataaaaaattgggggttaacctcaagtgtgaaaatatttaattttttaattctgaatttggtttcaacatcaagcccccatctggccagtgatagaaatgtaagttttaatcaactccgggtattcctggtcaatatgggattttctcagtaaattcaagtttgtcttcttttgtgcctgggctgctattttaagtgccccaaggcctagagagctggagacagtttattgaggctggaaggctggagcacagtttgggattgggattgggggaggagatgcatgggagacaagggtaaggacgcgtcttattcctctttagatcaccgtattagtagccacagagtagctgcccagtaaatatccacatgattttttttttttttttttttttttgagatggagtctcgctctgtcacccaggctggagtgcagtggtgtaatcttggctcactgcagcctccaccactcaggttcaagtgatcctctcacctcagcctctcaagtagctgggattacaagcatgcgccaccacacccggcaaatttttgtatttttagtagagatggggtttcaccatgttggtcaacctggtctcaaactcctgacctcaggttatccacctgcctcagcctcccaaaatgctgagattataggcatgagccaccatgcctggctgaatgttttagttacagtgtttggttataaattgtaaatagttacacaaaattctttttaaaaattctgacttatttccagatattttcattttgagaaattcactgttggggagaacagaaagctttaaaaacattctcatcttactcataggtgacaaagtgtgagatacctgaaattctgtatattgaaacatataacatgtactttaacatggtataaagtacaatgaaaaacaaaaaaatgaagaaaagctcaaaagagatgatatactaactaggctgaagagatagagcctgccaaagacctgaagtttattttacacatctaccatttgtttattgtttgcttttatttgctacctcctcggcccttttatggatgaggtcagtgaacaaaattcttcatggctagtgaatcattattagcaagaacactcagccaagacagaagggaatagatttcatagaatgagaaacttctagaatacgagatctcaaagcgtccttagagagcatttagttccaaactgctcaaatgacagagtgtctagaggtgaagagagggcaactaatttgttcaagatcatgcagctgactggccaggctagaattaaaatcgaagtttcctgacttttgtgttttaaatgatgttgatggttatggtggtgatcatataaaaatcactttatgatttatagagtgcttttatatatatatatatatatatgtggtatagaaggcccgtttattacatagggtcttagaatcgcatgaatatgaacccacaacattaatgactttagtctaaacgtggtcttggataagtaaatttaattttttgagcttcaacttctgcatcagtaaaatagaaataagacattcttcacaagattattatgaagattaagaatccacttaaagcatatagcatagtgtttggtacacaataagtacatattaaatgtctgttgaatctgtgactaataacttgttgctgccttctctgtgatcttcacaacagccctttggagacgtctaccatgctacttttatctcccgaaaactaaaatatcctaaataacccctatctctgttttgcccaaactcaaaaacctttttgctatgtgtgattaatatgtttatcaaataataaatcttgctgaatttcctgatttgaggggcattacacttgtcgttgtggtactcaaaaacaaagatgtcttggccgggtgctgtggctcacgcctgtaatcccaacactttgggaggccaagggagataaaccacctgagggtcaggagttcaagaccagcctggccaacatggcgaaaccccgacactactaaaaaaaaaaatacaaaaattagctgggcatggtggcacgtgcctgtagtcccagctactcaggaggctgcggcaggaaaatcacttgaatctgggaggcggaggctgcagcgagctgagatcgtgccactgcactccagcctgggcaaaaagagtgagactgtgtctcaaaaaaaaaaagaaaaagaaatttttaaaaaattcctttcacaatggcatcaaaaaataaaatacttaggaatcaatttaacaaaagccatcctagatctctgtacataaaacaacaaaacattactgggataaattaaagaagacccagaatatggaaagagagatcgtgttatggagaagactcagtattgttaatatgtcagttctccccatattaatcagtagattcagtccaatctctgtcatgatcccagcaggcttgtttgtattgacatcaaagcaaattaggaagtactatataatatatgaaaacagtactatttaacacaacagcatgtcaataataattcagacctttttcagttacaatgttggactttttagagaattttgtggagatatgttagattggtaaataaaagctgttctcattttccttacagtagaaaaatatacccagaagttatgtttattgctcccccaatgagatgttttacttaaaaaaaaaaaaaaaaattgacaggagactgacatccttgcccaggtgactaggcactcagtcactggtaagaaaatcacttgatctctctgaactgtaggctttctgtcagtaaagtattaatattaaactaaatgatcccgtgggttatttccagacctgtgcttctgtgatatggaaaaagaataaatggttaagaatcagaaagaacaagctggtgatttaagcttgttagtacaagtttaccatattagactgttgattttttttttttttttttcccccagacagagtctcactctgtcgcccaagttggagtgcagtggcgcgatctcggctcactgcaacctctgcctcctgggttcaagcaattctcctgcctcagcctccctactagctggaactacaggcacccaccaccatgcccagctaattttttgtatttttagtagagatggggtttcaccgtgttagccaggattgtctttatctcctgacctcgtcatctgcccgccttggcctcccaaaatgctgggattacaggtgtgagtgactgcgcccggccagactcttgaatctttaaattctgtatgctgaccaacaactagcacattgtttgtgcctaaggtgtgctctaataaaaaggaatatggtttcttataataatactaatgggctcttcaaactagcttatcttgtcatttcttctcttggttatttcaaagcataaatttgggattcgatggtttcagttttagcttaaatctgtatccttggtgatgaacttaaattagatgctaatattttgaaggaggacatgtttatgcaaaccagagtgagaacttttagtctaagggtcagcaaactttctctgtaaagggccagatagtaaatactttaggctttgtcatctgtactttgtagcaactactcagctttgctgttgtagtatatatgcagccataaacaattatgtaaataagttgatacagctgtgttctagtgaaaccacagaaacagaccagatgtaatgtatgggctgtagtttgctgacccctgttctggtgtaataatatgctttggcaggcctgctcaaataatgtactcagtatgcaggcccactcagtacagatagtattttggccttcccagtggtgttaaaaagacaactctcccttttggactgcaattttaaaaacctagagatggcaaggcaacaagacacaagtctgggagatgagtagggaaactacagatgtgaaaccaggagattattgggacccccgggactggaggcaggggctgagaaagagctgccagctacaagctgggtcctgcgaggctctgtagctgaagtcctctactcagcacatgaagggcagctgaccccatttttgtaccctctgcgacagatcctgcctctggtcaaaccctgaaggtctgggaacacagagttcaagatcttttccctcaccaggttacctcccacagtgcagtgctgagggccagctaccatttgtggagcacccatgtgcagggactatgtcatttcttattccccagaacaattcttcaggtagctgttttataaattttacaaattagaactcttggattcaggtaccatccctaggtttcacaactagtaagctgagattcggactccaacgtgcatgttcctttcccagtagcacactgcttctcctgaagccgaagttccccttcagagaattatgtagatctcataattccctaggcaaaactggagctctttgaatcctagcctagccatccacactataccagtttaaggtgcaatcttgtgattattgccgctgatcacgattcttgataagcatccacaactgataagtctgacgcttctgttttacaccaattgccagttgtctcagagtcactgtgaaaggagggaaaagcttatctcttataaagttggttagcttcaaaatacagtgatgtattttggatatttctgtggaaaggttacaagggtcaaatgcatcattaatgtgaacttaatatacccacttgatggattgattcctgtgggaaaactaatgggttcccaaagttcctcgggggagggctgaagtgctcctccgagtataaatttgttctttctgactgcatgtaagctcataaagcataggccaccctttggggctggcctgcagctcagtagtgcctctcgtacctgctccagaccctaagtaaatcacaagagtgcttcatttcaaatatgaatgaatccttgatgggaccaactaaccaacccaagccccacacgaaggaacaggagaagggtctgccgcagctaaggggtacgataggtataaacaaagcttgtaacctgacctcttgcaaatcaacagcacagtgcatggctaaagatagacttgctatccccaaacagaaatacacacaacccagaaaacctcactaagtgataacaatttcttgtaccctaaataactgtttacatttggatctcatttggtcattcttctaacccagggaggaaagattccaacagaacttgctgctctagtgtgtttattgaagatcgccttgttctggttctggttctggtttttgttttggttttgttgagacagggtctcactctgtcgcccaggccggagtgcagtggtgtggtcacagcttactgcaacctcgacctcctgggctcaagtgatcctcccacctcagctccccagccccccagtctgggactgcaggcatctgccacaatgcccagctaatttatatgtatgcgtgagatatatatatatctcagacatacatatacacacacacatatatatatacatacatacatatatagagacagacagacagcgtcttccagtgttgcccaggctggtcttgaacacctgagctcaagtgatcctcctgcctttgcctcccaaagggctgggacctccttgttctaattggaatgttttctaggcatagaacattgtgctaaacacgattagagaaaaagatatggtctggatcctggattctaacagcttatagtttcacttcacatgacagatttatgaattcccaattagaataaatggcaaaattatgtactacaaaagatttagaaggcatagactgggcgcggtgactcatgcctgtaatcccagcactttgggaggccaaggcgggcagatcacctgaggtcagaagtttgagaccagcctggccaacatggtgaaaccctgacactactaaaaatacaaaaattagctaggtgtggcagtgggtgcctgtaatcccagctactcgggaggctgaggcaggagaatcacttgaacccagaaggcggaggtttcagtgagccaagatcgcaccattgcactccagcctgggagacaagagcaagactccattcaaaaaaaaaaaaaagatttagaaggcatgattaattctaactagggagacaaggcatttccatctctgaaatgagatgcctcgagccaaagaaggttgtaaaaggacgtgtgaccaggaactgtgctgtgtcactaagctacagtcactcgctctctttcctctttgcctttcacagaatcaatttctgctaatgtatactgtgagatcgtatgcatcaaggtcaggatgttctgacttggctctccctagcggagatggtgttctttctcagagtcttcccttggaagggggatggggaatcataggtccagaaagatctcatgggatctcatgttactgcctgtctgtcttttcttttttcttcctccgctttatagttcttataaacattaggaaacttatatttctgaactcgagaatctatttatactagtgtttagtactttgatccacaaatgtttacttaccatgcaaataatgagtgatactataaactcaaaacaaataacagatctggtccagttagtgtcctgaccagatctcatagcttgattgctcctgcccccaggcccacattacagagagtacatcttcattcatagcgatacatcttttagtgcagggtaagggctcttggagtaagttctgaattcttattccagggttcatttctgaccttctgtgtggccttggacaagtcttatttctctgggccacagtttctcaaactgtagatgagagatttgagaggtaggaggagggtggtggtgataaattagagactggactctggggacccttccaattgctatattatgtgagttactgtgtaaagttgagccattttatgtttggccttgaatttatgaatttcctctggcataaattatgatatatgccaaaggcctttgagacttaatccttcttaaataatttcaggcttatgatgaaaagtgacctggagctttggatccagtcttgccctcagcacctgtcagcatgcttttgtttttaggattcttcatatgttccttgtttttcagtgagctttctacagggaccacacactccttagaatcctatcaaatactgttgtcaaaattctttcgtcatcctctctgcactagaacttttagaattttaccaccattccacttctagtaataaaaaatgggacaagtgtcaggccaacagccatttattgagtatttaataattactgtttacctatatttcatatcaaatcctcaaaagaaccctgttgagtaggtgttctctttggcatttgacagtgtgggaaatgagggataaagatattaaaagttttgctcaaggccctgtaataagatagttccagaccaaataccacatgttctcacttataagtgggagctaaatgatgagaacacatggacacaaatcagggaacaacaggcacaggggcctaccagagggtagagggtaggaggagggagaggagcaaaaaaaataactattgggtactagatttagtacctgggtgatgaaataatctgtacatcaaacccccatgacacaagtttacctacataacaaacatgcacgtgtacccctgaacctaaaagtttaaaaagaaaaaatgccaatgaaaacattataaacttatgaaaatcaaaaagggtaccctatatatggaattataactgattcatatattgtatgtgctatttaaagtttatatattcaggccaggcatggtggtgcatgcctatagttccagcactttgggaggccaaagtgggagaatcacctgagcccaggaggtcgaggctgcaatgagccataattgtgccactgcactacaacctggacaacagtgcgcgatcttgtctcaaaaaaaaaacagaaaattaaaaaatttaaaaaaaattataattcaactctaagaagcttcttaagaaaacttttaaatacatgtttctcattgaggggaaaaaaattaaataaaatagtttcagaacctgtgtctgggaagtccacatcagggttatttttgttataccttgttcctttggagccatagattatgtgaagggccagagagaacgtggatgcttatcaatttgcaattttgatgatccaaaggaaggtttttggaaatatttgctctttcatttgtcactcaaagcctgctttgccttttcttcagtagaccctaacccttctgtctctgccccagaattaagaaccagaggttgttaaaaccaaaccagtggatcctaatctgaatctctgtaaatatgactaatgaggtctgaggtgggaccagccctctgcatttacatttcccagagataactttgatgtgtacccccgatctaatccaacctcttctttttgtaaatagagacagtgaggcttgggaagatgaaatggtatgcccagattcactcagccagtaggcggtagagctaggcctggacccccatcctcatattttaactttccttccctagtaccattcacctcatagggctcttgtgggagttcttcctctgcacaggtgaaaagaattggctttggagactgtgagatctgattcagatctaggctatgccactttctggctgtgtgaccccagagtttgctattgatgtctctgagcctatttttcttcatccaaaaaaaaaaaatggaggtaataatatgtacctcacagggtagactagaggcacataataggtgcttagtaaatggcagctgtgcttaccacagtcactgttgtccttttggttctcattaattccccgtataccatctgtacggcatataattgtgaccaaaacagtgacagttaccttccaagcatccgtcatgtcttggaaagcagctcgtacctctttggccaatctcaaggtctcaaccagctccatgtgtactccaggaataggagcaataagagtggctaaatgcatgatataaaatgatctctattcctcacagcagtcctacaaagtacttagccctattgaacaagtgagaattaaaaaggcttattaacatatccaaggctacagagctaggagttagcagagtcagactttgaatccagctccaatacagcttttggtctaccactttatgggttctgagacccactgaggcttgagggtggggataaatttttgggggagaagggataaagatgaaaagggcactgagataagggaactagtcattatttggccagtcatcttttccagaaactcccgccaaccacccctttcctgctcatgttatcactagccagtcgatggctgggttggcctgggctgggctcctcggctgaaatccttcagagctttcctgttctagagttttgcaagaaggtgggaggagtgtttgtatgctgggcaggcttcccaggggtgattgtggaaaggaaggggagtgattctgtagggccctaaaaagaagccaggaagaagaaaaaaaaaaactgtttaaaagaaaatagattgactcaggcatttgtgggcattatctttagtctagacttggagatagaagctcaggccaggagtctagaaacctccattttcttcttgtgttttgggtcattaggaaggtcagttacacagcaagaagtaccaaaaacaccccagccacacattgtttaatatcttcctttattttcaccattcttttcttctcccaaggggtacccaggcaataaaaacaaatcctattaatgccttatgcatgtgcatggatttgcttccaaacccttatctcattcacctcctaaaacaacccagtgagacagacaggtaggctagagattatcctccaatacttgatagttatgaattaaagctcagcgaccacacatgatctcacagcaagtttatggcagagctggaactggattcctggtctcttgacttctgtcccgtgcatgaggttcactcactgggagtaaaatttcaacccacttagatctattctcactcccccatgcctgccaccaggtaaccactaatctttttcacatccctgcagatttgcctcttctagatatttcacataaatgaaatcatttctagaatcactccccttcctttccacaatcacccctgggaagcctgtccagcatacaaacactcctcccaccttcttaacaaaactctagatctgtggtcttttatgattggcttctttcacttagcgtaatattttgaaggttcatcaagataacctatatcagtattttttatttctatggctaaataatattccattgtgtggatatatcacattttgtttatccattcgtcaggacattttggttgtttccattttttggctctcatgaataatgctgatatggacattcatctataagtttttggtgtttgtgttttaattcaatcctttcagcaaccctctatgataaactgcagggcaagttatcctagatattaatagtccctttttacagatgaagcaactgaggctaagtgatttgctccaggtcaaatagcaagcagatctgcctttaggcagatctagggacagagccaagtctctccactattagcctaatacatttttttctgttacatgtagcacaccatgtcgcttttgttctatgaaatgtttggaagtatatttgaaaactttaattatagggagtgaccctgaggggtgatgaagccatgaatcacagcagtgccaggtctactaatcagccctgtccagaatggccatgtagaatgtactccacttaccaatggcaagccatctgaagggagcagctttcagtgagcaaaacaaaacagcaccaaacccaagttggctgaagctcttgcctccaactgatgtggaaagtgaggtagcacctccccggaacctcatctattggggcacaggcagctcatcagaattgggggttggaaccacggaggaagaagtagcaggggtactcggccatcagggtccaaaatgagaaaaatcttattccagaaaagttgtctctgaatttagctttgtaattatttttcctgagataagcaagaaaaccttgtttgatgttttaggttttatggtatatattggtttcctaggacctccatgacaaattaccacaaagtgagtagattaaaacaacaaaaatttactctctcacagttctagaggctagatatccaaaattaaggcattggtggtattggttccttctgggtgctctaaggagagtctgtttctacctttccgttagttcctggtggctgccagcagtccttggcattccgtggctagtagatacatcatttcgatctctaccttgacccatacatcacatggtattctgcctttgtgtttctctgtctctgtgtctcttttataaggataccagttcattggatgagggcccaccctaatccagtatgacttcctcttaactatgtacagagacgctattttcaagtaaggtcacattctgaaataccaggtagacatgagttttggaaggacactagtaaacctagtatagacactaagaaataatcacataaattcaggcagagatctttttaaagttgcaagcagaagtgggattttggcaagttttagtgccaaaacagctttgaaagaatttttctggagctacatacttttttttttcttttttcttttttctttttttagagacaaggtgtcactctgtcatcttggctgattgcagtggcgcgatcatagcccactgcagcctcaatctcttgggttggagcagtcttcccacctcagcctcctaagtagctaggcctacaggcacacaccaccacgcccagttaattttttaatttttgatagagacgactctcactaggtttcccaggctggtctcaaactcctgacctcaagcaaccctcctgtcttggcctcccaaagcgttgggattacaagcatgagctattgcacccagctaagctatagatcattagatggagctggctagtttcattgacatgactttgtgctggtagagtagaaatccaagtttctgttggatgaaggcccaattcatcctaatccctacttcatcttcttaacagaccttaaaacctctctgattttgaccacaagaaacacacatatttggatttttgcgccagggaaaattcttttattttttcagtatgatcagtcaacaaatgtgtattgaatacataccatggctggggctgttctaggcactaggggtacataagtgatagaaggtgttccatgtacctatgacattcaagattttctagaccttatgtgtatttcattcttttcatccttatagctgccctatgttgatttgtaaataaggagactgagactctgagaggtgaagtgacttccccaagtatgcagctaaatagactgagtcacagatatgactccacaggctgagctcaaggaaggggctgcagaggtgaggatgggtcactcctcttttattcatactcacagccaaagcattcaacatagggggcatgaaggatgcatttgatgacaaggcagaataagtaggttgtgtcaatggcgtttattgtaatactgaggaaactcgactttattctgaaggcaataaggagtcagtgaatgttactgaggaataatgatttcttatggtgtgtactttttttgatcaacgcgtatttattgaattttgtcacacactgggcttaatgatgaggataaaaccatttcaaaatctctgccatcactgtgtttacagcctgatgtacaaagtgatgagagaaagattggtattttcctggaattttatttgaaacacagggaagcacaggtaagaaacaaggttgaagaaagaaacaggaaaatgtctttaaaaaaagaggctgggtgcagggctttatacctgtaatcctagccctttggaaggctgaggcaggaggattgattaaggccagaagttcaagactagcctgggcaacatagtgagatcctgtctctacaaaaaaaatttaaaaattggcctggcgtggtggtgcatgcctgtattcctggctattccggaggctaaggcaggaagattgcttgagcccgggagttcgaggttatagtgagctatgattgcaccatggcactccagcctgagcaacagagcaagaccatgtctctaaaaaagagagctttgactgggcatggtggctcacgcctgtaatcccagcactttgagaggctgaggcagtggtgatcgagaccatcctggccaacatggtgaaaccccatctctactaaaaatacaaaaattagctgggcgtcatggcatacacctgtagttgcagctactcaggaggctgaggccggagtatcacttgaacccaggaagcagaggttgtggtgagccgagatcgtaccactgcatttaagcctggatgacagagcgagactctgtctcacaaaaaaaaaaaaaaaaaaaaaaggaaagatatttgtaagtcatctgaggtataacagaagagttttaagagggacggtgacataatgacgtgacatggttgctgagaaacagaagagtcatagataatgcctggacttctggcttggagaacttattggctggtgatgatggacctcactgagacagggaacacgagtgatgaagaggtcaatttagattgttgagtttggcccactagtgggacgtctgaagggaggtgctcagcaggtgaagggatatatagcagggagtcccggagagagaactgagctagagatgaagatttgagagttgtcagcacataggtggtaactgaagctgtggaagtggacaggattacccgctggagagtcttcagcgggagagagaggctataggagggtctagagtggagccctgaggaatgcctccactgaaggggcaggcaaaggaagaggagtccaacgagacaacagagaatacagaatctcaccagaggcttgctttttgcaggttccctgtgtcttcttaggcagtagcttgtattctttccatggccctgtggctactctgtcccataatgtaaaccctctctcctccactattagagagttcatcttgcaaatctaatggagtaatgagctatcgattctgttaacaaatgtccagtttactgaaagacttgtaatgggagttaattttgggggtcaatacagctgtcaatggaaaagtttttccccagaggcccatcagctttttctgttgtacactggcaggtgtcctgcccagcagcagaaatgcctggagagtaattaatactgtagagcattaatgagctggtgatcctgcctaggaccatgagaagggtacagcctgagataggtcagatgacagggcgtagaaggtgaactgtgtcccctttgacatgagttgaataaccttagaaaatcaacaccaccacaacgttaacccaccagctatcatactgcctaagattacatctttaaacttttatttctttcgaacaagaagtttcactagtggaatttttgagtgctgaatgaatgtgttgtgtttgcttagtccgcagacatgaactaagaatctgctatgtaccttgcctttattaggtaaatgctgggcctataatggtaacaacatcacagtcactgttctcagaaagccatgggttagacaaggaagcatagtgaccatggatataatgggagcatgggccaagtgctgctggcacacagaagaagaagcaagtccaggaagatttgggagagaatatgatatctgtgtagggtctaaaagtctgcatatgagcttgccagtagagtagaggtgaaatccaagtggaaggaacagcagaagccaaaacaaagaatcataaaagaggctggtgtgttcaaggactgatgatgcttccatatgccttgtttatgggtggagaaaagcaggaagtaggtcagactgtcaaaagccttgtatgttatgctaaggaatttggactagcttagagagccagccaaatgaataatgaccttggcttggggtgtagtactataagctattatccgtccttaatacctcacttactaacacaacagagaaaagcttgagataagagggaaaatgaccaatagacagggagtggtaggcagtggggaatgtaactgtccttggaggtcttaggaggccaggcaggagcagctggagtccagtattaagggacagctccaaatgcatttgtgcttttctcattaatgcagtaaggcacagtccagagcctcaattaatgagtcttcagtaagcaaagcctcatttaacaaagccagccttagcttttttttttcctgtaattagatgtttaaatttcattttttttttaaatttcaacttgtttttcagatgccagggtacatgtgcaagtgtgttacatgggtatattgtctaatgctgaggtttggccttctgttcatcctatcacccaaatagcattgtaccccataggtagttgttcaatccttgtccccctctctccctccctgttaacataatccccagtgtctactgtttccgtctttatgtccatgtgcaccctgtgtttagctccaacttataagtgagaacattagggtatttggttttctgtttctgcattaattcacttgggataatgatgttcagctgcattcatgttgctgcaaaagacatgatttcatcctttgaccacagcaggcgccaccaaagagtgggaaggtggtcgtactcattactctagaggcagaccttgcctgagggtcagggtcacactcctagaccacaggtagccgtacttcctggaagtggggcagatatggcctacattgtgataggaagtcacctccaggctaccccagaagccatacaaaggtaaagaggacctcttcttcaaccaagatggccaggagggcagcaaggggcaggtatatgagagggagagaatgctagtgctggattattttctctgctcttactcttttttcttcctctgacaactcactttgggataaggatacatttccttcctttttcattcacagagctatttctccttttcagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggtaggaggctgccacagccattaggtgggttagtgaccgctcacagggcctagtacttttcagtccttgcttttttaaagacaagcaaaacattatatcgtttcaggtagacaaacacgtctatgacaaaacataattttttgcttctgtagccttcatattttattggcatcatctgtgttgctacacagtgataactgggtgccagagaaacttttcattatcaaaaatcatgctataaaaaatgtttgatttggaggcaggggtgaaggcattaggggacacagtttccgaattgcaaaaaaaaacagtcaatttacttgggcttaaaagtatagctataaaaccataacatagttcaacaaatccataccttgcttttgctctagaactgcactgttctgtatagtagctactacctgcatatgtctacataaatttaaattaattaaaatgaaataaaatgtaaaattcagttccttagttgtactagccacatttcaagtcctcagtagacacatatgtctaggggctactgtaccagacagcacagatacagaaaatttccatcataacgaagttctagagcaaggactccctgttctaggataatggtcttttgtttttctaacatcatcagctctttcacaggtgcagaacctgtaaatgtatttattatgttttattcccattgttaggctaagcaaaagtgcagagctgataggctttgccagagctaattcccagttgctaccatagccagcagattacaaatcacattttaattaacttacaagatctaattcatgttatgacaattaaggcaaatagaaaaatggctgtactaatgtattacttgattttgtccttgagaatattttcatacataatctcatttgaaccaatcaatacactgagaaatagccagtatacaaaatttatctccattttaaagatgaaggaactgagaatcatgactaataaatagcagaggttgggctagaacccaggtcttcttgtttctggtcctgtactcttttcactatgctaccctacttttgtttttctgagtcatctgctgtcacacagaagaggctccaacacttaatcttaaggctgcctcagatacccattttcatgaagaacatgattcatttgtttgtgaactttcactagttcaacttccatcaacttatacatgaagagctgagtcctaaaaagatagagtgagttagccaaggtcactgaactagttagtggcgttaactgtaaatagtacctgattctcccgaatcactaaccagagataggcagtgtggtataatgaaaagcatgttcaggctttggagtcagtcggatatgggttcaaattcaggttcttttactttctttgtgatcttgggccaattatttaacctaattaaccttcaatattcttatcttcagaatgggaataactaattcaaaggcttactaatgagtgtaaaatgataaaacatacataaaatagtagtagagagtaaatacattttacctgttcttcctatgccccatcctcttctactacatagacaactgcctgggagcagataaggtgaggtcttaaaatcatagttgtagtgaaaggcaaagtacttagctgtagtgccttgcagactttaacatgcatatgaaatacctgaagatcttactgaaatgctcactctgactcagtaagcctggcctaggtcctggggtcctttctaataaactccagatgataccagcacagattgtctacagctcacactaagtagaaggctttatatagtagtaacaattgccgccaccaccactccagtgatcctgctgacgcatcagagaacaaacgtagaaacatctctgcttgaattagcctttagggcccactctctgcacccctacctcctctgtgaaatccctattaatcttcctacctggaattcactttttctctgaattgccacagcagttttttattctctctctctctctcacaacatttggaactttctgccttgtagaatggatttttatattaatacattactattatttgatgatggagctcacagtaggtgcataataatttgaacaaatccatgttgtagagggataagctagtagaagagatagaactttacgcagctgaggaagtcacattgttgtaggcctttgaccaagtcatgttcttctctgtcatggttttcacttgtgtggatgagggaatgagagggtaatgagcaggatctcagggagacttttggagaaaataagttcaaataatgtttgcagaattccaaaggaagttgggagggtaggaaggaagctttcttaaatccagaaagacgatatattttcttgtagtagtggagttgctcgcatcatgctaaacctactgtaataattataaactctggacaaaatattaaaaaataacttttttaaggccctgaagagcaataaaaaaggcagaaactgcaagagatctgactcttgaaagaagtgaaattcagtttacatggcttttcctatgatgttccaataatatatcgtcgagaatattcagtatacaatgagaaaatgccagacatatgaagaaaccgtatacattaacccatagttgagagaactcagtatctagaaagagatcaaaataaacccatattttggacccagcctacaagactttaaaataattatgttaattttttaatctattgtgggtaaaggatataataggtgaagagatggtggattttaggatggatgtagaaaccgaaaaagaattgggtagttccagttccactatggtggtggaagccaccacaggctttccttcccactgattacaactaaaaactctggacaaaatccaaagtgcaatacccaaagactctgaaaaataaataaaaggagatagattgtaaagaggagaagaacttgtagaagtgactacacagagatgaactttttgtctttcatgcatttgcctccaggttgggccccatcacaaagtagcacagtgcaaatggctaaaatgtcataaaaaaccccatctttctgagtaggggaaccagaagaggagccccattggggctggaaggagctagtatattccagaatgaagagagctggagaagggatcttctaactctgggaatgaaactatgtgagtcttaggatcaccttgggctacacatgtgtgggacaaaccgaatcgagtgcaacaaagcctatgtgaactgaaagaagatttgaactaccatacacaggaggagagacagaacttgcagtctgagcctaaccaggttgatttcctataaaaatatcacttctcggccgggtgcggtggctcacgcctataattctagcactttgggaggctgaggtgggcagatcacctgaggtcaggagttgaagatcagactggccaacatggtgaaaccccatctctactaaaaatacaaaaattagctgggcttggtagtgggcccctgtaatcccagctactcaggtggctgaggcaggagaatcgcttgaagccaggaggtggaggttgcagtgggccgagatcacgccactgcactccagcctgggcaactgagtgagaccctgtctcaaaacaaacaaacaaaaaaatagcacttctccatgggattataacagaacccagcatctacacaacatcatgttcacagcattcaggatctgtaatccaaaatgtctcagcatattgaaaaccagaaaaatataacccattctcaatggaagtcacaggtacaaacctcaaaataacccagatgttggaattatcagacacagatttcaaagctcctgtgaaaacaacattccatgtaataaaggaaaacacacttgaaactaatggaaagaaaaaaccctctgccaccggacactgtggctcacacctgtaatcccagcactttgggagcccgaggcaggtgagtcatctgaggtcaggagttcgagaccagcctggccaacatggtgaaaccccgtctctactaaaaatacaaaaaaattagccaggcatggtggtgggcgcctgtaatcccagctacttgggaggctgaggcaggagaatcgcttgaaccctggaggcggaggttgcgccattgcactccagcctgggcgagaagagcaaaactccgtctcaaaaaaaaaaaagaaaaaaagaaaataaaaaaaccctctgccaaccaaggagtttatattcggcaaaagtatcctttgggaatgtaaacaaaattaagacgttctcagataaaggaaaaataagagcatttccaagagatctgcttttaaaaactgataagaaatttcctcaggctgaagcaagatggtactagaaggaaacttgaattttcaggaatgaaggaagagcaacagaaatagtaaatccctgcataactgtgaaagattatttttccgttttaacttctttaaaatatgtataagtgttagaagcaaaactcaaacaatgtctagtgaggttttcacctggttttcttactctttagtatgaagagctccctttgccatttcttgccatgtgagtggcctggtgagaaattttcccagctttcatttatctggaaatttcttaatttcaccttcagttttgagagagattttgctaggtatagaattccagaatgacagttctgttttctttcagcatttaaaggataccattctagtcttctgaccttcattgtttctgatgagagatcagcagttattttaatttttattattctatatgtattttccttcctctgaatgattttttcttttcaaaaattgtagtaaatacatagcataaatatatcatcttaaccatttttaagtgcacagttcagtaaagtacattcatattgttatataatcaatctccagaaatcttttcatcttaccaaactgaaattctaaccattcaacaactccccatttccccttccctcaggccctgaaaaccaccattctactttctgtctgtgtgagtctgacttctctagatgcctcatatacatggactcatactacattttctttatccatttatctgttgatgaccacttaggttgattccattatcttggctatcgtgactaatgatgcaataaacataggggtgcaaatagctctttaacatactgatttcctttccttcagatatatacccagtaatgggattgctggatcataaggtagttctattgttagttttttgaggaactttcatactgttttccataacgactgtactaatttacattcccaccaacagtgtgtaagagttcccttttctccacatcctcactggcatctgttatttttcttctggaaaatagccatcccaactggggtgagataatatctcattgtggttttgatttgcatttccctgctgattagtgagacggcaagctttttttttttttttttttttttactatgaatgttggctgtttttctgtcttcgtttgaaagataactattttcagctaatttgcctcaactccattatttgtttttttttgctgttgagttgtttgagttccttgtatatgctggatatcaaccttccatcagatgaatagcttgcagaatggctttctcccattcagtaggttgtctctttactctgttgattgtttccctttgctgtgcagaagatttttagtttaatatagtcccatttgtcttttttttttctttcttttgagacagaatctccctctgtcgtacaggctggagtgcaatggtgcgatcttggctcactgcaacttctgcctcccagggtcaaatgactctcctggcttagccttttgagcagctggaaccacagtcatgtaccaccatgcctggccaatttttctatttttaatagagacaggattttaccacattagccaggctggtcttgaactcctgacctcaaggaatctgcccatcttgaatctgcccatcttggcctcctaaagtgctgggattacagatgtgagccagcacacccagccatttgtctattttttgtttttgatggtgcttctgaggtcttagctgggcccttttttgtttttgcttttgatgggagacttttttttgcaaattccatctcattactcataattagtctgttcagattttctatttcttttgggttcaatcttggtaagttgtgtttgtccaggaatttatccatttctgttaggatttctaatttgttggtgtatagttcataatcatcttttttcttttttctttttctgagacagagtcttgctctgtcctccaggctggagtgcagtggcgcgatctcagctcactacaacctccgcctcccgggttcaagtgattctcctgcctcagcctcccaagtagctgggactacaggcacgtgccactgtgcccagctaattttttttttgtatttttagtagagacagggtttcaccatgtgagccaggatggtctcgatcccctgacctcgtgatctgcccgcctcggcctcccaaagtgctgggattacaggcatgagccactgcacctggtccataatcatctttaatgatcctttttgcatttctatgctgtcagttacaatgtctcctttttcttttttattttattcctttatctattttgagacggagtctcgctgtgtcacccaggctggtgtgcagctgcgcgattttggctcactgcaacctccacctcctgggttcaagtgattctcatgcctcagcctcccgggtagctgggactacaggcgcccaccaccactcctggctaatttttctatttttagtagagacaaagttttgccatgttggccaggttggtctctaactcctgacctcaagcagtccacttgcctctgcctcccaaagtgctgagattacaggcatgagccaccatgcccagcctttttttttctttttttttttctagacagagtctcactctgtcgcccatactggagagtacggtggtgtgatctcagcttactgcaacctccgcctcccaggttccagcgattttcatgccttagccacccgagtagctgggattacaggcgtgtgccaccatgcccactaatatttgtatttttagtagagacggagtttcaccatgttggccaggctggtctcgaactcctgatctcaagtgatctgtccgcctcagcctcccaaagtgctgggattacaggcatgagccaccacacccagactgattttgtatttatttggatcttttcccgttttttcttggtcagtcttgctactggtttgattttgtttattctttgaaaaaattaacttcattttgttgatcagttttattttgtctcaattttatttctgctctgatcttttttttccccttttactaattttgggtttggttcttgtttttctgcttccttgagatgcatcattaggatgtttatttgaaaattttctacttttttggtattagcatttattgccataaacttctctattaatactgcttttgctgtattccataggctttggtatgttgtgtttctattttcatttgtttccagacatttctaaatttcattctttttcttttttttttgttttgagacggagtctcgctctgtcgcccaggctggagtgcagtggcatgatctcggctcactgcaagctctgcctcccaggttcacaccattctcctgcctcaacctcctgtgtagctgggactacaggtgcccgccaccacacccagctaattttttgtatttttagtagagatggggtttcaccgtgttagccaggttggtctcgatctcctgacctcgtgatccgcccaccttggcctctcaaagtgctgggattacaggcatgagccaccacacccggctctaaatttcattcttaattttttcattgacccattaaatcattcaagagcatgttgtttaattttccatgtatttgtacaattttgaaatttcctcttgttactgatttctagttttattccattgtggttagaaaagatgcttgatgtgatatcaattcttttaaaatctcttggcctaacatgaggtctgtcctatagaatgtcacatgtgctaatgagaagaattatactctgcagctgttggatgaagtgttgttaggtccatttgatctaaagcgcagtttaaatctaattgtttccctgttgattttctgtctaggtgatctgtccatgctgagagtgaggtgttgaagtctccaactatgattatattagagtctgtctctccctgtagatcttaatggtgttccataagtcttgcaggttttcttcactcttttcatttgtattccccctttccttctggctgggtaatttcaaactacctttcttcaagttcagatattctttcttctaattgatcaagtttgctgttgaagctctctgttgtgttttttatttcattcattgaattcttcagctgcaagatttctgggtttttttttttctttctcttttttgaatttttttgttcatattgtgaattctttttcctaatttctttgaattgtgtgtgttttcttgtacctcattgagttttcttaaggtcattattttgaattccctttctgtaatttgttgatctccttttcactgggctctagttactagccagagttcctttggtgcttttttggtgttatatttccttccttttttgtgtttcttgtgtcctcatgttaagtgtccatgcttctggtggaaagatcacctcttccagactttctggagtggatttcttagagaaagactttcacctgcagttgggttttagtgttccagttgagaaggatgtgatgactgtgtttccacttaggtgcaatggtatagtctccatgcagcttctttgcctatgttcaacatcaacaataactgggagtgcctcagtggcctagactatagaagtttgtgcagcagcggtggtagcataggttgttaatatccttagcgtaaagggctttttgggtctttctcttctcattttccccaaatgaggagactcagtcagggggatccctcttagtgtcaggtctggcatggcctacaagtagctgcagcagtgctgggttctaggtactggtgcttggagcttatgtggcgttgggtttctaagctcagagtctcatgaacctattgtggcagctgggtcttggggtgcaggttcactctccgtagcatggttggatgtggactgccctccgggccaggatctatgatatgactctgttgaaccctctatcagctcaggtcaggggccagctgtgattctacccctggtaggcagagcacagcactggcctcaccctgggcaagaagggatgttctggaggtttggtttcagggaggaggatacaactagaatttgggaacctgagtcaataaggctcaatggcaacttgggtcccagggattgatacaccatgtagcagtgactctacatggtccctctttaggcttagcaaatacccgggaatggcagagtatagctgtgttttgggctacagaggggcagggaacagcagagcaatgactctactccccagggagaggcgtatctcaacagctcagactctagggggctagtgcagctccaggaaagcaaggcactagagttgtttggcctgtagggcagggtgtctcagctcagacactgctctttttccctgaaacacagggtcctgtatcagctcagccttggaatgcaccccctctcagctcagctagggcacccattccccaggggacagtgtgctacttcagctcaggcccaggagggtgtgactgttctgagtagcccaggcatcctttccctggaatgcagggaaccatattattttagctactggggtacctcattctggggagtcagtgcaccgtttcctaggatgcagccactggcttcagcttaggcactgtggaggcatgactgttctgagcagccaagatactgttttccttgaagagagcatactgcttcagctctggcccaagggagtggggagaggggcaggtggattagctttacttctgcttgacccccctgggaagggtgtaacagctgctcacagctcagctttggaatgttgggccactgggctagcaatggctcagccacagcttagcctcaggaatgaaagggagccatggctactcacctctggagcaagacacactccagccatagttccaattccaagatggcatagcacagtagccacacggaacacagctatgtggaccctaggcaacttccttcactgggcttagtgcctatgaggacttcaggggactccagtggtgaggcctgagatgtccaaggtgttgatggcagttgccatgatcctcttgcctaccttctcaccaaaagaacttcgtccttgttccaaactgatcttgcatggagtggtgaaggcctagtgtgtttccttctgttctctgtgtgaccatcccaagtttctggttcatcgagtttctgttactcctctcatgcattctgggactctccctccgttatttttgctaaaatgtaattgttcaggaggccaggtgtggtggctcacgcctgtaatcccagtaatttgggaggccgaggcaggtggatcacgaggtcaggagttcaagaccagcctgaccaacatggtaaaaccctgtctctactaaaaatacaaaaattagcagggtgtggtgacatgcgcctgtaatcccagctactcgggaggctgaggcaggagaatcgcttgaacccaggaggtggaggttgcagtgaacttagatcacgccattgtactccagcctgggcaacagagcaagactctatctcaaaaaaatacataaaattaaattaaattaaaatttaaaatgtagttgtttattcattgttctgcctgtctttgtgagggggacaagcagtaggggtttcttcttggccattttgctagcattacttccttttttttttttcttaatagaaatgggtgcaatgtggtatctcattgtgcttttgatttgtatttccctaatgattagtggtgttgagcaacttttcatgcgtgcgttggccatttgtatatcttctttggagaaatatctatttcaagtcttttgtccatttttcagtcaggttgtttgatttttgttgttgttgttgagctgttggagtttacctatattaaacccttagcagatacatgacttgcaaatgtttctcccatagattggttttttactctgctgatatgttctttgaaacacagatattttaattctgatgttcaatttctgcatttttacttttgttgcctgtgcttttggtgtcatattcaggaaatcactgtcaaatccaatgttatgaagcttttcttctatgttttcttctaagaggtttatagttgtagctcttacatttaggtctttgatccattttgagttagtttttttatctgttttaaggtaaaggtccaagaactttgttcttgtgggttgacttagttttccagttctatgtgttgcttttttttttttaatctagtttagcaaactttctaccaatatttcttcgacttttttttttttttaagagacagggtctcagtctggcacctaggctggagtacatagctcactgcagcctcaaactcctgggctcaagatcctcctgccctcagcctcccaagtagctgagactacaggcatatgccaccatacttgattaattttttgtagagatatggtctcgctatgttgtctcgagcaatcctcccacattagcttcccaaagtgctggaatgagccaccacacctggcctcttcaaatctttttctgccacattttcttttttttttttttttttttgtttcttccctcaacttttattttaagttgcagggtgcatgtgaaggatgtgcaggtttgttacataggtaaacatgtgccatggtagtttactgcacagatcaacccatcacctagatattaagcccaacatgcattagctattcttctcgatgttctccctccctctgcccacctaacaggtcacaatgtgtattatacacccacccccaggtgtccatgtgttctcattgttcagctcccacttataagtgagaacatgtagtgcttggttttctgttcctgcattagtttgctgaggataacagcttccagctccatccatgtccctgcaaaggacatgatctctttcctttttatggctgcatagtattccatggtatataggtaccacattttcttgatccagtctatcactgatgggcattccttctgagacttcagttacttatacactagaccacttgatactgacccaacaatcacttacattatcttttttttccaatccttttctctctgctcagttaagatgattttttaaactgatttttcatttctacatttccccacccttttttttccccacaagtttttaggaagaaattgaagtacagtcagtggcatttatataacatttcctcatgcccccttgtaatccatccttcccttacctcattcctagagaaccagtaacagcctttctgccactacagattgatttgcattttccataaatttacatagatggaatcatattgtaagtactagttttcctgacttctttcattctgcataatgcttttgggattcatccatgtttttccatgtgtcattagtttgttcctttttattcctcagtagtacagtgtatctttatatcacaattcacttttccattcacatgatgataagcatttagattgtttccagttttggctgttacacattaagacccatttgtacttaaacagtaatgagcaaatctttgtagaaacatttgtttttatttctcttggacaaatacctagaaaactatgcccagatggttttactggtaaattctaccaagcattcaaagataacaccaatcttacccacagtctttcagaaaacataggaggaggggattctttcacagctcattttatgagaccagcataaccctactatcaaaatctggcaaagatgacaggaaataaaattacagagaatatcccccatgaataataaacagaaatcctctttaaaaacaaaggattagcagtcgaatccaactaaatacgtatgtgtgtatatctatatgtgtctgtttgggacaatatatatattttagggaatatgcatgtgtgtatacattaggggtaagacatcatgacaaagtagtgtttatcccaggagtgtaaggttggtttgacttcaaaaaaaaaacaatcaaagtaattcattacattaagagaatgaaggagaaaaataatataatcataacctcaatagatgcagaggaagcatttgacaactcagtacttcattgaaaaaaaagtatttcttagcaaactatgaattgaggagaacttctttaaactgataaaggacttctaaggaaccctatagctaagatcatacctaatggagaaatattgaacataatgccctaagattgaaaacaaggagaaagtacctgttcttaccacttctatttaacattgtactggagattctcatcagttccatggaggaagaaaaataaataagagtcctggtgtggtggttcatgcctgtaatcccagcactttaggatgctgaggcaggtggatacctggagctcaagagttcgagaccagcctgagcaacatggcgaaaccctgtgtattttaacaacaaaaaaatttttaagtgagtttagcaaggtcacaagataaaaaggtttttatgcaaaaaataagttttacagtatgcagtgaacaattggaaaatgaaaaaattttaattatatatcgaatggtaccagaaaacgtggaatacttgggaataaatttaacaacaaacatgcaacacctcttcactgaaaactatcaaatgttgctggtagaaattaaagacctaaatatggagagtgatgtacagtagttatgaactagaagacctattattatttagatggcagtttttctcaaattgttctgtagattcaacacaatccaaataaaaatcccagtctcgggtatgtctttatcagcagcatgaaaatggactaatacagttaattggtaccagtagagtggggcgttgctgaaaagataccaaaaatgtggaagcgactttggaactgggtaacaggcagaggttggaacagtttggagggctcagaagaagacaggaaaatgtgggaaagtctggaacttcctagagacttgtggaatggctgtgaccaaaagcctgatagcgatatggacaataaggtccaggctaaggtggtctcagatggagatgaggaacttgttggcaactggagcaaaggtgactcttgttgttttagcagagactggtggcattttgcccctgccctagagatttgtggaactttgaacttgagagagatgatttagggtatctggcggaagaaatttctaagcagcaaagcattcaagaggtgacttgggtatcgttaaaggcattcaattttataagggaaagcagagcataaatgttcggaaaatttgccacctgacgatgtgatagaaaagaaacacccagccgggcgcagtggctcaagcctgtaatccaagcactttgggaggctgaggtgggcggatctcaaggtcaggagatcgagaccatcctggctaacacggtgaaaccccatctctactcaaaatacaaaaaattagcccggcatggtgacgggcgcctttagtcccagctactcgggagactgaggcaggagaatggcgtgaacccgggaggcggagcttgcagtgagccgagatcgtgccactgcactccagcctgggcgacagagtgagactctgtctcaaaaagaaaagaaaaacccattttctggggagaaaatcaaaccggctgtagaaatttgcataagtagcaaggagcctaatgttaatctccaagaccatggggaaaatgtctccaggccacatcagagaccttcatggcagcccctcccggtggcccgggaggagaaagtctgtcgctctgtctcccgggctggaatgcagtggcatgatctcagctcattgcaaccttcgcctcctgggttcaagcaattctcctgcctcagcctcctgagtagctgggattacaggcgcgtgccaccatgcttggctaatttttgtatttttagtagaggtggggtttcaccatgttggccaagcaaccaaagaaatttttaaaagaacaacaataaagtcaggatttatattacttgatttcaagaattcctgtcaaactatggtaatcaagataatgttgtattggtgaaaggacaaaaacctgtagatcactagaagaattagcaagtccaggagagaaatatatataaatacatatatgtatataaatattttaaatgcatatataaataaaaatagtttaaatatataaatatatataattattaaaagtatataaatatatagatgccaatggagaaaggaaaaacctgttctgcaaatgatgctgaaacagcttgacattcatataggaataataaaaaaagaacagcaacccttcatatcacaccactcacccaaaaattaaaatgtatcagagacataaatgtaaaatctaatactacgaaacttctaggctgggcgcagtagttcacgcctgtaatcccagcactttggaagactaagaagggcagattgcttgagctcaggagttgaaaaccagcctggataacatggcaaaacccagtctctacagaaaatacaaaaagtagccaggcacggtcacatgtgcttgcattcccagctactcagcaggctgtggtgggaggatcacttgagcctgggggaggtcaagactgcagtgagccaagatcattccattgcactccagcctgggcgacagaataagaccctgtatttaaataaaaagaaaagaaaagaaacttctagaagaaaacatctccatgatcttgaggtaagcaaagatttttatataggacagaaaaagcaagaatcataaaagagaaaaaactgtagtttttggtgaagtagtctttatcaaaattaaaactagttcttcaagaggcctctttaagaaaagaaaatgggctgggcgtggtggcccacgcctgtaatctcagcactttgggaggcagcaggcagataacttgaggccaggagttcgagaccagcctggccaatatggtgaagccccatgctaaacctctgctaaaaatacaaaaattagacaggcgtggatgtgctcatctatagtgccagctactggcgaggctgaggctggagaatcgcttgaacccaggaggtggaggttgcagtgagccaagatggcaccactgcactctagcttgggcgacagagtgagcaagactccatctcaaaaaaaaagacaaatcacaaaatgcgagaaaatattcaacgcgcatatctaacaaaggatttgtttgtggtccatataaagaacttctacaactcagtaagaagagagcaatccaatatttttttaatgggcaaaaaatgtgaatagattcttcaacaaaaaaagatataggaatgtccagtaaccacatgaatagatgatcagtgatctgggaaatgcaaattaaaatctcagtgagattctgctttacctctgctggaagggctaaaataaaaatggctaacaggccagacgcagtggctcatgcctataatcccagcactttgggagaccaagacaggcggattgcttcagctcacaagtttgagaccagcccgggcaacatggcgacaccccatctctaccaaaaacaattagccaggcatggtggcacatgcctgtagccccagctactcagaagactgaggtgggaggatggcttgagcccaggaggcggaggttgcagtgagctgagatcacgtcactgcattccagcctgggcaatagagccagaccttgtcaccaaaaaaaaaaaaaaaacttaacagtgccaggtattggtaagtatatgaatagactttaatcctgtgtttcctctaacattcacattatatactaggtgctctggaagaaagaaatgatgctttaaagtttacaaagcacttttacattaggtacctcatatgatctccaaagtaatcctgtaagattatttttgagtagggggtataaagtgaatcagcccattcatcctgcctcgcatagactagacataactgtgtctgattggattactgaggctactaataccagccttctatctatctcttttttcatttatgtgggaacctgattgtaaagatacagtaaattaagcaccttagaaataaaactgtgaattatgtatttatcatcacttttactgcaataatagccactagtcttccttcaagtactagataatatgtattcttgctaaaataacttcatttctcaaaatgcaggtcttccactgagctaaaataagtaactattcagaataatatctattgccaacggaaagagttttgaactggcagagtcaagacaaatagagttctttttctctttgaagacaagttggtttcactggacttatttttgtcctccagcctttggggcctcattccagattctagccagtgtctgtcttcttatttcaagaaggctgttaaacctgtaacagatgatacattgatgtgagtcacatgccctgaaaagccataattctggtgagggttactaggagtgaaatttcattggtgagattccagaatcactgaccctgcagcagtagtctatagaaagatggtgggtaaatggtaaaattagaaatgtcagtggagagcttacccatcattaatcttttctaagtcttccctgactcattcaccagaggctttgattgactgaccaaaggcaaaatatacaacttttagtttcacatatacagctttgctctgtaaccagagtcctgccaaaattggctcagaactgcagccagaagggtttgagatacaaagattgcctcatctcataaagatttgtgacacagagttttcttctttcacaggaaggatccatttggaatgggtcaaatgcaagaggatagttcaaatgacctcttaaacatggccagtgacagttacagaactctaaatggtgtttaatctacttacaagcattttatattaagtcacccttaaatgggaacatactcattgaaaatcaaagtgagtccttcatcattagggttcttggagtccagtgggatagaaaaaagcaaaatcatcatatagtatggtatataaaattatatgaaaatgtgtggaagaacaagtacaaaatgaagtggctagaaaaactagaaaaccatttttaaaagccaagggaaggccgggcacagtggctcacgcctgtaatcccagcactttgggaggctgaggcgggcagaccacgaggtcaggagttcgagaccagcatggccgatatgatgaaaccccgtctctactaaatatacaaaaattagccaggtgcagtggtacgctcctgtaatcacagctactcagggtgctgaggcaggagaatcgctttgaacccaggaggcggaggttgcagtgagccaagattgcatcactgcactccagcctgggagacagaatgagactccgacacacacacacacacacacacacacacacacaccacacacgcgcgcgcgcgcaccaagggagagactgtatggtggcaatagcctctatagcctctggaagagccattggccaggaatggaaagggaaggcacttggcactgctggcttgagggaatatcttctctcaaacttctttttgattctggggagctcccatacgtgcttgtgtttgagtatcttcctgctccaactctgccatttactgttttcctcatctgataatgtgaaagtaagaggtgtgtctcagaactattaggaggatttaaaatgagatcacatgtgatatgtatggcatagtatcttgcctattttataaggcttctgtaagcccagccctggaagagaagcctctctccaaatccaccacttccaggtggattatccatcccacaaaagcaactcaggtcatcacagtgacacaggcctcagttaaggtttacatgaaaatactaaaggccataagactgctgagtatttggaattccccatctagattattgcccaaagggaccacattttagcatggtttgcgcagtgggggcacccagagacctggctgctagaacaaattccctgccctctgagtatgtaactttgggcaagagtcccttgttcaactcctcttacttggttactgaggtgataatcagtctccctcaacatgtgtcactattatctatcatatgcctggcactatgccagggtacaggatatggccctctgccttctaggagcacatggtctggtagaagtggaaagacacagacctgaataactgacataaggcagaataaggtgagtgttgcgatggaagcacagagtgctgtggtagcacagaggaaggaatgattaccataaaaaggagaattagggacctgtaatacctttgtagagtgaaaaggcttcttgtggactttgtgtaaggtgttgatgtatcaaggaagcgttccacagggaggtgagtaatgcaagaccagggctgaagtttagactacacaggacatgtttagggatgagtgagtagttctgtgagcgagacaggaggatgccggggtagagggaagttggaacgtaagctagtgggttctacagaggaagggctttgatctgctgatcagaaggtttgggccaagcccaggaaaagggatagcagcaacatacgtttgtttattcatttgcttacttacaacaaacgtttattcattatttataatgcaacaagcattaacctaggtgctaaggagagaaaaatgagtaagacacagtttctttcctcaaggaaatcacagtctgttggcagagataagtagtaatggtgcctaatataggtaacacttgctacctgctccaagaacaaagttaagcaagtgattaagttaagcaatgcttagaggtagaggatgtaagaatggccttaaaaaatgtgtcttctgagatgagtttgaaggataaatggagtaggaacttgccagattgaggtaagaagccttccagacacagcccaacaatgcagcaaagcccaatgcttgactaactggggcacacagggaacactgcaaagtttggtttggatcctagagtggaaaagggaactaaagagaaaagattggtgagatgagttgggataaacctaggagtttgggcttaatcctgaagcattgaggcggtgttgaaaatgtttacactgggaagttaggaaagtaaatattagtaggatggaaggatcagagaggccctgggcagaaatcataatgtgggtgactcccaggtttctggcttgagtaactgttgccattcccaaaataagagaggcaggaggagaagagttccagaggaagatgatgagttcattcttgagtatgttgaaggttattgcagggtgcctgtgatgctcttgcaaccccatccccaccttgaaatccttcagaggctccccgttccctttagtcctggcctggcctccagtgtcttctctcagccctgccttctaatgtgcttgctgcagcctgagcagcttcgagtttctagaacttgccaggttgtgttctacatctttgagccttcaactagaacaccatttcccttctcctgccttctgcctggccagttgtggctcatccttccagactcactcaagataaaacatctctgaaggaggcttccctgacattgtctaccaccacccccagcaagggctgataccaactgtcagcagctacatactcacccctacttgactgtaatgatttgcatccatgtcatctcctgccctactgtgacattcccagaccacccctcactgggcaggtggcatctctgtatcccttttgcctggcccagatggaaattaggacatcagtaaatgtaaaatgaacaaatccagatgggagcatccaacagagagttggaaattccaaaaaaagcaaaatgaaaggcaccaaaaaaatgcatacaacattaacaccttatgtctaccattcgctccccccgccacccccgtcctcttccctaagcactacattatctaaagcctagatgttcaatcatccaagcccatggctgttggcttggttatgtgtctggaatggaacagaaagggaggaggagtgcagaggcccaaggaggagcatcagtgaaggtttggagactgacctggaattcctagccatcatggtgggtacagtttacatgagaggaagcctggctttacacacctgtttcctctttctaagctctggcccctattttctaacaccatctggtggccacatctgtaaataacaaactcctcaggagctgagagagcttctataaggcaaaaggtccagggattggcctcagagggctattatgtattacagccccaacaagtttatatgtatacgagatttgccttttctgatgagacactccaagagcttttgaccagaatcttaaaaactcctatagcctccaaaaggcttagaatccctgctacaaaggattgattctttttttccccaagtgaaatcctatgaagaatcatacacaagctaaagaagcagacctaaatccctgcttgctcagaacctcaccctccaatttcccaaagcacttacagagaacctggaatctagtttgaaaaccactcttgtgaaacgaagggcttgtagagcatcggggccagatgggcccttagaaatcattgtgacgtactaggtcccacctgagagaggaggcttggtgatacacacagcacgtatcagtagcagtactggaacctaacacaagtctcccctcttgtttctcttctctttttactgcttgccttattgcccaaaacctaaatttaaaaatgtactaatcaaaactttttctatatatagttcccaaacaggaaaccattcttcatatagatttctaggtctctggaaagagatctttcccctcaaaatgcctcttaaccaaccataaatcatggtagaaaataaatctagagcttacgtttgaatagtttgttgtttgtttgtgttggggcgtgtgtttttttgaaacagggtctcattctgtttactagactggaatgcagtggtgcgatcatagctcactctaacttcgaacttctgggttcaagcgatcctcctcccttagcctcaccagaagctaggactacaggtgtgcagcaccctgcccagctagttcttttttttttttttttggtggcaatggagtcttattgtgttcccaggctggtcttgaactcctggcctcaagtgaacctcccacctcagcctcccaaagtgcagggattacagtcatgagccactgcacactgcacctgacccaaataattcttttcaacttacaacatcaatacccatgggctagtttcacagtggcagaatagactcagagaggtaaaatgacttgtttgctgtttcctgtcatcaacttaaaggttctttccactgtctcacaacatttgtgttcgaatgtgcatattctgcggtacttaaaacagtgaacaaataggcaatccatctggcttattgatacttgttcagggagtgggggttataacccctgctattaactgccatttggagatgggggacggatgaagtctaacattgtttaaacattcatatactagagtctgaacaaccttcaaaatatgcttttagtcaccattttacagatgcctaaaccaaagtatagaaagagaaagtgctttgcctcaaggtcacacagctagtaattgtctcaccctcctgccctttcccttctttctcttttaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgaggtcagtataagtcctagctgagactcagagggaggaggaggtaacacaggggttctcaatagtttgatggtccttggtcatccatggccgaggggaacttacgaaccacctaggtcactgatactcaaaaacataggtgtcttctacccagatcccttaccagttggtcctccagcactggaggctgttagtagtagttgtctaacagagctagccccagagaagttaatgttctactaatggagaataggacattcttgattaaccacagtataacatattatgggtttagaagcccaaatcattgtattttattcatttgtaaatcaaatcaaagatttaaaaaataaattcagaagatcagtccaaactggagtgaaacctgtgtggactaacagactgctaaagcaaaacgaggtcttaatattttctaaatcatacttgaatctctttggttgaagtcaaaacttttatttgaagtacctaaattctattgttacttgttttccactgagagtattccaactctgcatgtaacctcctctgtatgatgaaaaaatagaacaatattaattcctttcattttgcatcttgctttatggtttgcaaagccttttcttgtccatcctgttgtttaagccaggcagagaggttggtgggacaaaacctccttgtctccatctcacatgaggccaatgacagttaagagacttaaatagagttgcagagtcattgtgccagagatgagactcagaccctagagtcccagctcctagtttagacctctttgccgtctttcaatccatcgacaatttgagcagtcatactccgttttggaactgagatgataaagacatacataaaacatgttcctgcccttcagagcttacatctcattgggaaaataaaaccaacacatataaatcaggacaagtattgttactgtggtgttcagagaagtgatggctggggtgagcaggacaggtgagtggtgtaggagtcaaaggagaggtgcatagatgagggtagagtagtcaaggacagcttctctgcagatgctaacactggagctacatctagaagcccaggaggaatttttgaactgaggagtgatgtgttcgaagaaattccttatcatttggggttgagagtagtatcttctggagtatcagtaagaccttgaaccacactggtgagggtatgggtaagtgtcaacacatgaatcaaccatgagtacttatgaatcctccttcctctgtcagcttcttcctgtgagacctacgagtacccacagcgtggtggagagagtgcaggccggtctgctgaatccatgagtgatggagttggctctttcctggtgagtgtgggttaacccaagggtcctcaggccggcctggttaggtaaaaggtcacaccttatggaattaaaagcacaaccccaaaagattgatggcgtctccatcttaggaccctgcccaagttcttgtctcagttcagaaccctgcgttgagtctttggacaagtaagatataagtattctagtctggaagaaatgtatgtgctaaggtagactggattacaaggttcaccaaccttgtaggtaagcagaggatctagaatgcaatagacccaggctgcacggtgggggaacctctaagacagcaaccttacccacgtggcctcacatgcaggagggaggctgcagtgtgagactccaggcaagggtggtactcacagtcaggctaagtggcagaattatggcttgagtgcaggatcccaggctgccctctggaagatgctaaccgcagttctccaaggtgtcaggcaagaagaccagggcctggcttcaggcccactgaaaagacagtgaaatcaggtaaccaaggcagaagcagcttagttgtatgtcacggcagatagagcaagagttagaggaaggctgggattgctgtatcacacaactctgtagaagctctgactgcagcttggtggtcccctaggtgcctggagtgagccccaggtacttagaaacctggactggggaaacacaactggccccagacctcaccttccagagccaggactcctaatatgctccttgttctgatccagggcctgagatgctgacctgccagtggtgagtctggacttgaggtggagggcaggtcctgaaccaaacctacagtctatggactatgccacccacagtgttggtcaggcgtccagaaagccaagtggacccagtcaccaagaatattttatactctagatttatcaaaaattattagtggatgccaaaggatcgtgaaggcttgaaggggcccacagacctcatatattcttgtctcccactctgcttccttttttttattttttattttttgaaacagagtctcactctgtcacccaggctggagtgcagtggcatgatcttggctcactacaaccttggcctcccagcttcaagcgattctcgtgcctcagcctcctgagtagctgggactacaagcatatgccaccacgcccagctaatactttggatttttagtagagaggaggttttgccatgttggccaagctggtctcgaacccctcacctcaagtgatccacctgcctcagcctcccactactctgctttcttatttggtctccccaaggtctcccttacagcttcaaagtatagctaacccagtcatgacttgtcttgcctcatttacaaagtcttacccccttcctgtttcttcttgctagtaacagctgtatttctttcactgttcctctccctagccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaaggtaagtccattctttcccctgtcccatctctggacagtggctagggactctttccatttgcttaggggtcatgtggatcctggacttgagaggtgtgacttggggcaaatcatgtaaaatctgagtctcagttttcttatctgtgaaatgcagatggtaattcctacctcccaggtttgctgcaaaggagagcatctaggatagtactttggtacatagcaggcgttcagtaaagtcagctttgtgccccctgcatgtagaccaggcaaggtcctcgtctgctacaatctcactctcctggcattggatcagtggcaaggattcaaagggaggagtaggatagctaggcagagatagccccctgtgggtctggccaacagggaattcaaatcttagcatttggaactgaagccctcaagcccttatggcatctaccttcctccactgtggcttgcaccgacctggccaggagcagcagggagtagtcacggtgaccatctatacttcaaatatggtctcttggctgggcgccatggctcacgcctgtacgcctgtaaccccaacactttgggaggctgaggcgagtggatcacctgaggtcagaagttcgagaccagcctggccaaaatagtgaaaccccgtctctactaaaaatataaaaattagctaagcgtggtggcaggcgcctatagtcccagctactagggaggctgaggcaggagaatcacttgaactcaggaggcagaggttgcagtgagctgagattgcgccgctgcactccagcctgagcaacagagtgagaccccgtcttaaaaaatacatatatgtgtgttaatatataaatagtatatatttttataaatattaatatattaatatataaatatattttatatatagtcttttatttttaaatgaagtcataaattgagggagaaaaatctgttgtcaaaccctgtgtccccacttttgattctgaaaatataattaccatagatacagcagaaagaatatataatttggaatctgaagacatgacttcaaggctcatcaatatgggcaaagattatacaacctcgctgagcgtcagtttccctgtgtgaaactggaatgactttgcaggcctttataaacatgctcatgtgttatatataaggtgtgtatgtgtagcattatcattactggctgattaccagactttcttttcctgctccagcaaagccaacaccacttgacctgaggaacaacaccgtcatcgatgaactccccttcaagtcacctatcaccaagtcttggtctagggccaagtaagtgcgtatgtgtgggggtgggagcttggagtcgggccattagggaaaatgagtgatgtggtagctggcctgtgggccgggacagctggattctgatgctaacgctatcattagctgatcatgtctcgatgtcttgtggcttggtttcctcagctgtaaaagagaataattatacctgccctatatcagatcttaatctgatggagtgtgcagctctaatggctgaggtctgggtgtgtgagggtcagggcccagctggaggctagaaacatggcagcagccatgcagcttccccagtgttaactcttccttcccacaacagccacaccttcaactccagctcctcccagtactgccgccccatctccacccagagcatcaccagcacagactcaggagacagcgaagagaactatgtccctatggtgagtccttcgggcttcgctggaatgacgcctttcaagtcccctgggacccacccctcagttccccacttcccagcttagctaactcacctcagcccagggactccttgtattattcatgatttagtctcctgctacaaacccttcttgagcacctgtttatcaagcagtaggagttgtcatcagatgtaaggaagacatgagacctgtcccaacgaagtcatggtcttcaagagcaggggcctgcctctcatgacagtgacatgggtggcatgatctgtgcccttggataggcagtgctggaggtatctcctcagtggtggaggtatctcctcagtggtgagaggcatacgtgcacataactcactttggtgaggccataatagagctatcaacacaggcagaggaggatatttcttccctgagatttccattaagggcgtaactgcccagcacctggtagtcactgcatagatagtgaaagaatgaattaaccaaccagtaaagcagccaacaaacagaacacaggactatcaccttctcattagaataagacttccagaaagttctagaggaggtggtgctctgctagagcacgagcctggatggacaggatcctagagcgtgtcatctgaagaaatgcgggcttgtgcagcctggagatgaagccaccctcttcagatcttggaggagctaggcgggggagcaagctgctttggggtgactaccccactctaggccacaggtgggagtttcacaggggctgatttggtgcgacagaagaaaactttccagtgcataaaggaaatgtgctcctttcttaagcgccagcaagcaaaggctggatgtctcaggagagccactgttgatgagacttggcctgatgtgctagaaaggaggcagtgtggtacaggggttagcacaggtttggaagtcagaaaacagacctgattcccatcactcaacagctgtgcagccacaggcaaagtcacttctctgaaagtaaagtgaaccacagtttcatctttgctttaaacagtatcaacagtaatcatacctaccttacaggattgtcatgaggattaaaatgaaaacatgaaaagtccttagcatggtgcatgtgtcagagtagggctcagggaaacagtgttcttactcccagaggtgtttttctgggtggtgggttagtctgttttctgcagtcactcacagttttttcctcctcgtgacagcaaaacccagtgtctgcatctcccgttcccagtggcacgaacagtcctgcccctaagaagagcaccggcagcgttgattatctggccctggacttccagccgagctccccaagcccccaccgcaaggtgcctggagtagagttgggggggcagtaagagctctcagggtcccggaggcagagatcatggaggccagggtgccttcaacactgaacagcagcactcagcctccctcctgctccagtacccagcttttatgatgcatctttagtcatagagctttcatctaggtctaaagactcctattcctgctctcagagcacagtaccctcagtcagagaacctcatcagtcagcccatcccccgtgttgtagagatgggcaaatgagtgcacagagatctgattgtcctaaggttacaaagtgaatcagcaacagatccaggaatgaggatactgcctcctggtcctgggctctcgagtgggtccagagccctgccgtcgatacatcagccttcagaagggacttccaggcctgggaaagcctccccaggaggcatccttatagctaagcagtctagacagaagggtgcagagctgtgcctcagcatggttccccttcacagggtggcagtgagcacagcacgtaaagtcctgtggctgatgtttgtttgcacctagcaaattccttcccctggatgagcgacctgacagagatgggtggaggcagagatgaaggcctggacccatccaccagggccaaggaagggcctgggtcctcccagaagccgggaagtaagaagggctggcaggtgctgctacatcctgcaggagggatgatgagtttggagtctgagctttaaagcccacattcagaaagagaagccaggctcctgaggctggtcagtggcaggcagaggccatgctcttctccccttcagacagctcaggaagatcccgtgcccaccttcttcctccccacctaactggtaactcacagctactccctctttcccactctgtcccctcagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcaaggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctaggcccaagggctagtcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaacaaaaggcctttgagcatatgggtccagccactcagaagtgtaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcacccca

SEQ ID NO: 36494 - DNA, 95042 bp, Homo sapiens
gggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtgagactgtggggcagggatccgggccgggccagcacgtgtgtcccgcgtgcccttctgcgctctctgctccagccctctgcggaacgtgcggggagctgccccggggcaccgggatgagggcgtgcatgccaggcaggcgggcactgggtgctacgcgggagacagcgggcgtcccggtgccctcgccgccaagcgctcccggacgcaggggcaggaggcagctgtggggcgccgggagatccctggcagggtgcttacgccacggccacaactttgcggggatgcaggtcggggcacagccggtcgggcaggacgccggcgggctgcggggtgagctccgctccagactccgagccctgcacctgtgtgagtgcggggtgggatgggggtgcttactacctgcactgccggaaaccttggtttagggccaccttgttcttggcttcggccccaggcgtctgggaaactgcgggccaccacctgggcctccgcccacaggccaggctcggtgggctgggtggggtcgacgtagcccgccccggcggaggagctgctcctacacccaactgaggcgggctcgagcctcagccactttctagctgtgtgacgcggcggttcatttaatgtatctgagctagtttcctcatgcatgatatagaaaggcaaagctacccccatagggtggttctgagagtcggatgaggtctcagtggaggaagctgtgtaaactgcaaaatcttacaaaagtggaaaaggagtggactccaagagtagtttgctacacttggtgggggggactccaggcatccctgagagaggtcggaatgggtgtgcctgccggcccaggtctggggtttggccttcgtttcgctgtgggtgtgtgatgagatattgtggcctccttccccatcttttccataacttatgcgctcccttattttaggaccatcctggtccttttcccctgaagttccagggaacttcctgttcctggcaccctccccccaacccagattttcccgttcttttccatttgggtgtggcaaggacactgggcaaatgggaggagaaaagtgtgggttgagttgcttgaaacacttccatctcccaataccctggccttttggatcaccagtgaggagtggcctggtactctctggttggaagtgggtggggaaagaagccccctgttctcttcggtctgtgttctccctcttggggagaaccaggctggagtggggcagtgtcacttaattgcgtctgggtttgttgaatgctggtttgccatcagttccctggagccagttggtctgggcgggtctctgggccaggaggagggagctatctcctgaaacgccccccatcggtctttgcacttgggctgagtaggaggtcctgctttcctccctttcccctcccttttgtgaaaacaaacggcttgagaatctgaaatttcattcggcagacatttatttgtcaatcacattgtttggattgatattttgccctccactgggttagattttgggcggagagcaaaacacacattgtacctgccgtctggtgttgccctggattgggcaaaggagtcagtcctgtgagcaaataatgacagaactgcaagtgctgtgaccttaagtactagtatccttcactgaaccggagccatacgttgatttaaagggaggtcagccatggctttcctgaggtggtagggttgaacagagtctgaaagatgtgtggtagttagctaggcagtggagggctgcaggtccccttcaccaggaggtgcggaagagcaggtaggtttgctgaaagcactagaacctgggagtcctgagcaagcaatttctatcttctcctttccctaagccctagagttggcttagcgggtaggaggtggagggagcatgccaacaggagcagtggtgagtgattgctggacagcgcgttgggtctttgtaaatttaaatgctgtatctatctgataagtgctccccaggttcctggaagccggttgggtttctttgttcactcaatatttactgagggctgatatgtgcacaggactgggctgtgacctgaagggtataaaggcatctgcagggattcgtgtacagggatatacacccaccacattttttacaatagcaaaatgtggaaatgggttaaatgctcaataatagtggcatggttaaataatatctggccttgtccatatcatggaaagtgatatttatctttttcagtttggcctgctataagaaatatcccatagactggtggtgtagaacaattgaaatgtatttttcacagttctgcagaccaaaagtccgaaatcagggtgccagcatggttgaattctagtgaggaccctcctccagaagactcttgacttctcactgtattctcatatgatagaaagaagactagacagttctcttgggtccctttttcaagggcactaatcctattcatgagcgatccaccctcatgacctaattacgtaccaagggccccacctcctaacaccaccactttgggggttaggattttaacatatgaattttcaggggaatgacagaaatactcagtcctggccgggcacagttgctcacacctgtaatcccagcagtttgggaggctgaggcgggtggatcacctgaggtcaggagttcgagaccagcctggccaacatggtgaaaccccgtctctactaaaaatacaaaaattagccaagcatggtagcgggcgcctgtagtcccagctactcagaaggctgaggcaggagaatcgcttgaacccaggaggcagagggtgcagtgggctgagatcgcgccactgcactccagcctgggggatggagcaagactccatctcaaaaaaaaaaaaaaagaagaagaagaagaagaaatattcagtccattgcaatgtttataaagaatatttttatttaccagaatattatgtttattatgaaaacattttatgatgtttatgaagaatatctaaggatgtggaaaaatgcccaagtgtgataagtaagggaaaagcaggatgtaaaaccaaatctgagggtggctgaagttacatgtatgaagaattagtgcatcaaaatgttaacagtcattgttctggaaggtggagttgtgatgacttctgcttctttgcttatgcttttctgtggattccaagtttttcacatgaatatgtattagtttataatcagaaaagttaataaagattttttaaaatgttgctttgggaacccttagccttccaaaagaatactggggaggaaggtgtcactgtcaaacacgtgggacaggttagttccaagagcttccaggctgggtgtctgtgccctcagaggctatgggtggcggtgccctccctgccaagtgctcctggacacaggggcaggaggtagccctagggcacagggcgatccctgccgagccatgctgccctgctcccatccctgcgctgactgcctgctttcctgctgtccagctcagctcatccctgcagctgactcttctctagggccgtccatgctgattgtcctgttggctccatccagcctgtaggatggagaaacgtcgagctggagtgaactctaggtctcctagctcagtggttctcaagcattgggccaaggactgaagctgggctgggatagagttttctggtctgcagtcaaactggaaaaaaaaaatggtgtatttttttgtttgtttgtttttcatgaatgcaaatgttttcagtttaaaaagttgtcaatttttctgacatgacgatattttgagggggagggggttacagcatccctttgaaaaatgaggctggttgtagtatattgtgatttctttttaaaagccctttcttgataaaatttatttttaataatataaaatccattttatatttaaaaatatatatattctgctgatctgtgagattcagaactgatctaactcagccttctccttttataggagaatagcgaggcttagggagggaagggactcactcaaggccacccagttagtgaaggcagagctgggagaagagccagatctgctgaatgtaaatcgggttcttcccactcatccatctcccgcctgcttctctgcctctgcccctgatggtcgcttgaagctcagaccctggaggacagtgggtggaggtgcaggaggcagatgtttgttcctggcatctcctgtagagcttttaaggtacacttatttaggttctgtacttctctgggacgattatatatttaataggcttttgtgggttggcctgaggactgaattgccatttaaaatgctgtttggaacctgtagtgcacatttcccacagaaataaacacattacagcggaagtcttaaaacagacccggcatataaggtggaagtgtggctgagtgccataagagtggcagcccctgtgtgctggggatccaggacgaggccaagcagtgggacaccgagtgatcagagaaggccccaggaaagagcaaggtgtggactggcctcacaaggagggcagacttggagctctgtgacagcagggagccccctgtcctggctgtagtgtccccagcacctagcccagggcctggcatgtcgtcagccccggtccgtgtttggctgatggaactaatgtcacaggcagagaaggaaaccttccaagccagagacatgggaaatgaggaatgataggccaggctggatggagggagggtttgagtctggggatgaggggagtaagactgaaaaagtggatcgtaaagaactttaaatgcctggcaaagctgtgggggactcgattctgtaggtaatggagagacttgatgaaagctgcccttttaataacaagatcaatcaggccgcatgtagggttgggtgggagggggagagactaattttcccagaacaacactttcatccttactttcctctctgttatctacaagataaattcaagtgttatgtagtggaaagaacatgggcttttagccagctagacactcaggagctgcgtgaccttgggccctgcctcagttttcttgtttgttagtggtggtaatgatatccatcttgcagtgttgaaaggattagaaaaaatacaggaagcacccaacacagcgcttggcacgtgaaagtgcccagtcactgggagtctcagcagtcattgccagttgttgagtaagagatgatggggaaggcagttaagaggaggaggtgggcaaggaagggccagagagaggctgcatgatttgaatgccaggtacgggtacccctgtgcagctaggattctccccacgggagttacttggagctgagctcttgactgcctccttgcctcctctctgccaggctgctgcagagatcccaggtagggggggtggtgcagaagggctcaggatgtaagtgtgcttggtttctctcccctttcttctgaaagtagatcccctcttgagaatgaagacaccaaacacactgtatcccaggagggttttgccccagctttgtggttttattctgttgggctcttgtgtcttgcttggtggttgtggtagcctttgaggctgagtgacaatgggccagaaatgaatgcatggggtataaggagaggcggaggttcttccacataacctggacttgggatggtttatttgccccctacctctccttctgtgtgtgtgtgtgtgtgtgtgtgtgtgtgtatgtggtgttgttgtttttaacacctggcatcttaggtcccaacgggagagggaaggagcaggagtgctcagccctggtgggctggcccattccttctgcctggccatctttcagcactgcctggagcctctggctccccgtgtgatctgttggcagaattgtcaaatcggatgcatttgtagagggcttgagagtttgcaaagcatttccacgtatttcacgacggtgtggttttgagccccatgtaacttggtgaggtgagtaggctagcccagtaccatcatccctggagagggatgggtggctggacagggaggtgggaagcaacatgtccttagacgaggttgaggtgtctgtggcctggaagatgaaggcataaagagataggtggggaccacagtcagagttctcagtgcctggcttgaatgtgtaagcagctgcgttggcagccattttccaggagtgtccctgaaacttgcttttcagctgctccctggtggctttggcattggacaggggtggccagccaggtacatgctgactgtatccttcccccaaggagctccagttcactgtcccctattgccaccctacatcagcagggcctctttccacataccagtttgcaaccacttctaaataattagctttgtgatcttacattggggggttgaagacactcatggagtgtggggttaaaagagcctttattcctcaaagtcatactgaggccccagtctgatgcacattccattcctagatggtgtgatggtgggcctgtgtctggcttcagagtttccagctcactagagttgcgggggcgcaagggtggagtgtccattccctgcaaagaatcctacagttcctccaaccccttggcgcaggcagatttctggaagtcgtgagcaggtcctttaatccttgttggaagatgttgatgaaaatcaaggttgagggttgtaaactggggcttaaacataaaggtgatccagtatctgagcccagatgtgggcctggtaggaaagctctgttgtttgggccaagtagggaagggtcttgaggaacgagtgggtttgttctcatcacagggtctagtcttactgggtcctgggcagagtattagtacatgcccctatttcaaaggaaggtggaccaacatcagcatcctacatgtgccacagatgttcattcattcaacagatacttcttttttttcccaaatggatatttccttgagaatcttttatgagccaggcctcatgctaaggcattggggataaccataaataagacagacaccatctctttctctcatggcctagtgggacagccactgattaattatttaattcaggtagtaagtgctggaaagagaaagtgttaatataatgtggtaagagaatgtataacagggatccctaacctaattcaaggagtcaggaaagccttctctgagaacctctgggtctttcttagaataatgtttttaaatgtataaagtaaaatgcatagaattacaaagaaagcagttttattgaaatacagttatcaaaatataacaacaaggttgtgataaaataatatttatgtttattaatgcatcatataaaaagatcaaaggtacaagcttgataacttctataattttaagttgtgatgagcataaatagtgtttcaggatatcttgtaatgtgataagaaaatatgatttctgttggtggcaaagtcacagacactgctaccctaattactactgtaatttgttatctacattcataaatgtagaaagcatttatacatttataaatacattcataatacaggaaaggctaaatttcagttagaggttagtgaagataaagatgtcatttttctccatccaaattcgtagactacagtggaaaaaaattatataacacttggaaataaaagatgattttgtgacattttagtatcatactggagtattgtataagaaaccacctaaggaccagctgtgttctaggggatgtaactctgtttattattttttatgggccatactttgtaaagttaagtaggatgcaaattatttctgtttggtaaagaagagaagcacaaagattattgccctgaaggacattaacctgttggtatctaatgtagcaatcttatatcaggattatatcctcttttttagggtctcttattagcgagttaagtaaaactttgaaatatgctcaatacctatttgtatgagaattaggcttttaacattttagaactgtacttgactccagttcaactgctgagtgagcaggacgtaaagatgtgttgcttagaagagaggtctgatctggagatgttaatttaggggtgctgttcaggagagtgggtgaagttggctgggggaccatatagggtaggaagagagggtagactgagtgagctgtggaacttcaacattgaaagaatggggagaggagggtttacaaagaagaaaggaatgattgctagagaggtaggagggaaaccaagtgtcgcatccagttcaagaggccaaacaagatgagaactggaagtgcctgtagggtttatctataggaggtcattgttgagccttcaccaagagccttttttgtggtggttgtggggagggcagatttcagagggatgagcaatggaaggagggaggagaatgggaggagcaggggagatggaaaattctggctgtgagtggagaggggagtgatatggggtccagagagagagtttttaaaagatgggtcagtgatggagtttcttcaccttaaggagatatgtgtaaaatggattcctgggctcccagcccctggagatgtttttcttcaagaataaagcccaggaatctgtattcccagaataccgagctctgcggtaaagctacaaaactagacacatttccaagttaatcttatatggctggtggtattttgccagccgaggtgggtgctctcaattgagtgtgtagcacaagttctgctcacattggagctgtgtcaccattgtctgcttggtgtcacttggcctgagcatgtgcttttctctgaagggatttgggggtttgtggacatgctggtagcagagggaagatggatcaggttgtcattgtagctcttttcagcaggtcacgctcaatagctggattggaagggacagcagacttgccagcctctcgggtattattctgggtggagcaacggggagtggatgatgctccagggatgtctgtgggaactattcacattgacagcccaagagaaaagcatcagatctgtcctggcggggacctggctctactgttttaggcttaatccgaggcaaatcccttctctgagcctcagttttcacatctctaaagtggggatagtaccacctctgcctataaacactcattgtttatgacaatttttcaactcctgcaagaacagttatacattttacagtgtaacccagtacacactgggctcactgaatgcatagtgttgctacctgtgctactcactgatgttttctagtcaatgtaattttttaaaaatgctactgtaactcactgattttatgactagactcctgggttgagacctgaagggtggaaacagtggcttagactctcagcttcagaggatgaaatgagatcatgtgtgtaaaagcatggatgtacaccgtgggtcatgaacactgagttgttattttcttatcagttaacggagcttggaggcagagttgatttccggagtgggaattcacctgctcttcctccctccctgctgcctaattcaatgttccctctaccagttcttcctcgttaacaggcctggcacaccaagctggcggtgatccagacccctcttggctcaagaagaggttttccaaaacattaaaagctttagggacttaagtcctggctaaatgcactgcagttgcaatttcaggataagaaaacctgttttcataagctctcagataagttgccctgcccctgaattgtccattgttgacagcaacatttgtgccatggggaataaaaaggggagacactgtgctgcgtagccccaaatgtaaggtgtggctttttaaaggaagcaaaatataagaaatgcagctggacttgtatttacagcagcaggcagtaagatgtgtgtggttctgggaatctgtcttccttatgccccaactctggtgctggagtctgtcagacttgggtctgaatcacagctctcttacttgctgtgtgaccttcagcaaatttcttaactccccttagtctcagtttctttatctataaaatgggaataataaaagtgcttactttatacacttgtcaaggtaattcagttagataacatgtgaactgcttagctcactgctggtcatacaataagcactctacttttggctgttattgttatcatgggctaatccctaagccctggatttggaattaaaggatcctctcttgggttctgttccttgccaggtgcttttgcatttctctttgttaataagcacagttagcccccttggctgccactagccgagggtctcacatcccagggccagcctcttctcccacctcacacacatacacacacacacacacacacacacacacacacacaacaatatcaccaccattcagggactcatgttgcttggttttatttcagaggctgctgggtagacatttgaacattgggaaacatcggtagtgagatccccaagcttgatttaaggttaggccttcactccttatgaagagtggtgtttagctatggtggctcatggcagatgtttagaatttacccttttaaggggcatacagtatgcatattttaaaattaatgttctttttttttttttttgagacagagtctcactctgttgcccaggctggagtgcagtggtgcgatctcagctcactacgacctctgcctcccaggttcaagtgattcttctgtctcagcctcccgagtagctgggactacaggcacgtgccaccatgcccagctaatttttgtatttttagtagatacggggtttcaccatattggccaggctggtctcaaactcctgactgcgtgatccgctcgcctcagcctcccaaagtgctgggattacaggcatgagccaccgtgcccggcctaaaattaatgttctttcttagatctctcatcaaaaccattctacaagtatttgctaggtatgtgttgcgtgccaagtactttgcagattccatataatagttatgaaaaaaaccaaaccacgcaatgtcacatgaacggaggcgagacagttcagctagcagtacagaaggacacataagcactgcacgtacgtgggaaagggcacagagcaagcgctgggccgggaggaatcagaaggcccatgcaagagctgggggcggtatctggttgtgttctggaagcctctttctttccttttttttaggcaggtttttttctttgtaacttttatttagaaataatatcagatttatagaggagttgcaaaaagaatccaaaggattgttatatgccctttatctcaattccacaaatattaatattttatcacatttgtttttatcatactcttcctctacatatatgaagtttatatatgatgttcctttgccccttaaatacttcagtatttcctaaaacacaaagacattctcttatgtaaccacagtacaacgatcaaaactaggaaggtagtatttgattcaggacccaaaccagaatcacacactgcatttaattgtccttctttagtctcctttaatctggaatagttcctcagtctctgtcttttgtgaccttgacatttttaaagaattttcctcaatttggtttttgatgatgttttcatttagtgcattatatcagggggcacctgacgtcaatttgacccattactggtggtgttactgttggtcccttagttaagggggtttctgccatgttttcccactgtaaagatacattttctggtggggagatactttgaggcagttaattattttcataatggtagccaagtggtggtaatttttttctttaaacatttagattggacatgcttattatggcaagttgaaaaatagagaaaagggaagaataaatattaccgagggcaaatcctcagtgtttttctgagcatacttttgtttacttatagttgtggttataccacgtatattttgaattctttttttttttttttttttttttgagatggagtctcactctgtcgctgaggctggagtgcaatggtgcgatctcggctcactgcaagctccgcctcctgggttcacgccattctcctgcctcagcttcctgagtagctgggactacaggcgcccgccaccacgcccggctaattttttgtatttttagtagagacggggtttcactgtgttggccaggatggtctcgatctcctgacctcgtgatccgcccacctcggcctcccaaagtgaattctatttttaaagacattaaagcaaatatttttgcattgcgaagtctttaaaaacaccatttaaataaaataccatctaaatggcttattcttctattgagtggtttactctgtgtaaccattctgttgttgttggacatttaggttgtttataggttttaactcttatggttagaatggttgtgagtcatacgtgtgtcagacctctgctaatttcctcaggacacattcccagaagtggaattaccaagtcaaagagcataaatactttagagatacatgataaattgtgccagctacctttccaaaagagttgtactagttgaggtttctgccagcagtatatgacagttgggctccatattttaagagattcactaatggtgtttctcaaccttttttttttaaactgtgacccaccaatgaagatttgtgttgagattaatttcctatattttgacttatgagagcctaggtatttatttctaaaaataaattatggtataaaatagcacattactcttttcaagctgcaacagtctgaaacagagcattgggaagaactctgggaatcactgaggtggcagtgtctagacagtggggatttgaggtcacacgtgaggaattaggatatttcacctagagaatcctaaaagagacgtgtttgctgtctttggagtgtgataggctgacagatgggtgtgtgtgtgggggggatttaacatttctaatgaggagccctccaagatgatatgggtatggtgtaggacatgggacttctacatattagcatattgagttcccacagccttctgggtccagctgagttgagtggtctcaggagattttgagtccttggctctggagggctacctggaggctggagacggtatgtgaggaattttgaggggatttctatatttttgggaaactcatcagcccaactcaactctgaattgaaagagatgtcctagcttttctgtctccagcagtggtcctcttaccagaaaagggctgaggtaaggaaattggagagttcccgggctaattcttctttcatttgtgaatagctggcaccaggtgaccaaagtacctgataagaacaggcacactgaaaatttgggctactgggaagaacactgggtaaatcaatcccttgacagtctctctgtctccttccttataaataacatatctaaagttaatgcatgatttggtgcttgaggcactttgaaatatcccagttggaacagatgtttgtatttctttctagttaaagcttttgttcagtgggcactcaagatctatttgtgtgtgccagaacacccagaatgagagctccttaaaaagatcatttatttcacccatgcagaagcctgcacagggatattccagggccagagtatccctctgtggtgtcagggacccaggtaacgtctatcttattagctcctctttagcaggcccttcctccccattgtctcaaggtggctacttgagttccagccatcttgtccaaattccagctggcaggaatgaggcagggactaagaagactcttatcagatgtctgttagggacagtttctaaaagttgccacatcacacttaagcttacattccaagggctggaacatggcccccttgctgcaagggagactgagagataaggcttttattgcgggtggccacatgcccagggaaactcaatggtttcttcacaaggtgtgattacctcacagtacttctctggtggtggtcgtgagaatgggtttaccaaatgatatgattgtaaagaactttggaaatcactttcagttcctcagttttccagagtaggaaacagacttggagaaggagagatgacaactagtaataatcaaagtcagcacaaaacttgagcttctgactccaagtacggtgttctttccgccaaaccaccagctctaaattctcagcccgctcaagttctctgaccttggattcagggccacatctgttttctcaggtcttcctcttttccctgagtccctttcgtaccagcttcttatgagtctagacttagattctgacatttaaaaactattttgagcaaaatgtgggttaaactaaattaaacctgtttcttcacagttcttaacataagggtatctttttttcaggtggcagagcaaaagaggttgagtcccaccttcaccctttttcctcaatgttaaacttctgttcccaagtcttcctccgttagcaagctgcttttacataattgaatatctctggcttcatggtctgcattgaatagtaaatctataatgacagacggctttgctagttacagagaatgcgagggtgctggcacgcgccccagagatgaggagctttttaaagctgaggtgtaatgtggcaaggactgttctccctgattatctcccagcgtgctgggactcttatctctttagtctgatggagatgctgggtggcgatcagcctcattaagtgagctgagtgaagagaggagtttgtgtgtgctatgttagcagattgggaggaccacacacttcctgcacacagcctctggctggaaacagacctgggctaattgccacatttaggatcttcatgctcttggccccaggaaccttgggagactccaggatctgctggacttgcagaaagcagagggttagtctaaacccctgctgggaccctccttgccctgggattctgggagataggggcatttcctggttgcttcggtaggccctgccttggaaggagatgttccttttctgcttgtgttgtgccatctgttgcagcagtccagggagcttgtggggttgagagaagcaggcctcctgtggcctggagtcgggaggcccaagttctagtcctggctctgttacttacctactgtgtgaccttggtaattaatgtaacctgtctgagcctcagtttcttcatctgtaggatgaggcgagtacctacccactggggtattgtgaggggtaaacgagttagtgggtatgaaacctgggaagtgtgctctaaatgtgccgtgtgacctcttggtctgggtcgctgtgcagctggtgatgatttgaggttttctggtggctgaatgtgtgtacgtgttcgctccttcctgcctggacctgctgccctgcctgattgcaggcagggcccctggagaggaagaggtggtccccgtgttactgctgtccttgctccccttataagttgtctcgctaataaagagaagtgcaattattctgtgcttctgcatgccaaacattatgttagattctttgtcatctctcccctcatgtagtcctgagccactctgcaaggtgggcattggtattctcctctccaccttgtaggtggggagttgacactcagaggtctagtaacaggcctgaggtcatcctgctataaatggtggcacctggatttcccccaggtctgtctgactcctgagccagtgctctttctgtggtgtctggaagactgcagagggagaagagagtgggtttctaagtgggatggtggtttgtctggccggccctgaatgagcagacacctgttacaagagcacggcagggggtctggaagatgaggaaggactcagtctccaccccattgcctccagccatggcagaggtgggcagtgaggacctccgtgcctggcactctggtgctgttgggctctgaagagagcctgtactcaggggaggggttgggtggtggaagggaactggtgctcggggtgggggagggggggtgcagtgaagctctgtgagggggtttggaggttagaggcattggtgctctgacagcgatgtgctggttggctgataataggcaggacctggcattgggggcctctatttcccagcagcagaaaaggggaaagccatttttcccggcagttttctgccctgcaccagggagatgctttatgggtctcagcccagccagcgggggcagctcagccctgatgtaaatactgttaaagctgagggttgtgagcagaaagaaagcaattattggagaaggtcagaaggagtttgcatggtgaacaaaggggatcttttttctctcctctacctctagagcgattgacttcgaatgtaaagagcctgccaagcccaggaacaatgccgtggctggcatggaaccctggctgcctttggaagcacttctcaaatcctgccctctcccccaagggcttgacaaaggaacagatagtttttgcatcattaacgttgttattgttgctgtagttattgttgttatcaaggtttgtgggttgtgacttatgaagtctgcagtaaggctcttggcaaggtgctccgaggcttgctgggactgcatcttaaggaaaggaaggagcgtgcacattggaaaggttaaaatagactgaagtggaggagaaaggagaatgttaagtggcaggaggaaagtccccttgggcttatggggaggggaggaaagggctcccacttgtctgcatctgtggttgtttgctagggtgagggtctgtctgaggccagacacagaggggcctttcatccttccccttctcagaagcccagttagtgtcttagctctttggaccccatctccctggattctccctgatcgacctatcctgattatttttcctctctcattctcagatcctgccactctaggcaaatcctgcttctcctgtgcccactaacgcccgcacgcccccatcttcatgggatacaacttatccttcttctgaccctgtggcacttccttgcaccttcccattatcaccgcagctcctgtgctgggtagactttctctcctctgcagcctggcttccagctcccgccacgtgtactgctgacattctctccagtgttcccagggacttcacagcctttggccctgtcccagcctccccactctgactgcctgtggatcactctcttttctttagaagtgtcccctccctggtctctgtggacgcagccctccccacctccctcttggtcctgcctcctccctcactgagggtgtttcctgtctcctccctctgagcccggtccgtggggacttcatttacttggtggctcaccttgcaacctggaggaggcctgtatttgatgcctcactgtctacctgtccaaaacctgagcctattatcatcttccttaatgtaagagaaaagcctcctctgctgctgcttctccgttcttccacctttggctgttgttgcagtctcccagcccggaattctaagagtcattttagacttttttactctttcttcctcacttacctatgaatagtcattgggttttgttgtttttccctctgaggcttttgcattgatctgtgtctctccacgcgggcagccacccagcagggccctccacctccggcctccctggctgctgcccagtctgaggtcacggccagatgagtctctacaatatactgtgttcatcctttcactcccctgctaactgggcaatgatgcttcccactctcttcctgcaccaggccaggtccttgggcaggctttgaagagcccagcctgcccccactgccttctgccatgctctagcccagacaccccctgagctgtggtctgtgtggcttccatcgacccttctgggcctcccaagggctgctgtggactcaccccatcacatactgatagtgggtgacctctgctaaggccaggagtgtggtaacagtgtaatttgtcatgtttataatactggtcaaacatttcctgagggctttcaatgcgccaggccttgtgtgggggccctgccctcctccagagctcttaatcttggggatgggggtgagggtagggaggagatggatccttcattaggcttcaaaaccggattggctatgggtgatgcccagtctgagccccagtgtcatgcccagtgatggttttcaagcaaagtaaatttgctcagcgcgtttctggttgggcttaacttctctactgtgtgactccaaatgctgggtgaggggcttggctgactggctggaaggtggtttgtttaatctcattggccctgggttagatgacctgcgggatggactgggttttatgggaaggaagctgagggtgtgctgtgagcctcagcctctagtggtttctcttgtacacactttgttgtcgctgcggctcagctgcacacaccgctgcctgggcagatgagctctgggctcaccctccctcctgccttcccctttccttctccccagttccagaagcgtgggtgcctaccagcctcaggaggggctggactacaggtcagagtcctgaggccctgggcaagagcagttgttgctctccgctggtcagattatctgaggattaaaaacagcagtgaggcaatgtgtttttccaacagattattttttttccctttaatcatgtgcattgagctgtggagttttcagtctgaagtccgttagctccctgggagtagtaggataacatgtaataataataaagtttagcagactttttggtgagctcttaaggtggcttgcataagggcagcgggtcctcagacattttaccctgctctgcagggtgtgatgagggagaaatcattccttggcttcctcctggatgggtttactctgggaagagggaaactttgaattccaatggcagattatatttagaaacactagaatatggtaatgtttcagtcttcttctctgctgagatggaagtttgtgttatatattatggtaactgatactctcagagtgctttctgatttataaaacacgttcaataaattatcccatttcatcctcatatcaatcccacgagggaagtatcattatctgtatgtcagacaggagtcactaagcctgtaaaaggttgagtgacattggctaggcatcttagctattgagtgatgaggctcagactcaatccaagacttctgactgcaaaaaggcaggaggctgagaaggcgtgactcatattagaaagactgggattcagatcctggctctacttactagctatgtaattttggtcagattatttttaaaaaaattttttctggcagaaattaacactcctctcagtatgaccaagcatatcaaataagctatggttgcccctttttattgaccatgttcctccatgagctccgtcgttgctctgttctggtctggttgctctgcaggctgttgaacagttgtcatcctgggatttctcttcaccatcaatgtggtaatccttttgcctctctctttcattgaattctttgtttcctagtttccatgtctaatttttcatttattttttgttgtagtggaagacgggtcccagtatctttctgagaaagggtgcgctggtggtaaatgttatacatctgatattttcatctgttcaagtctattttcatgattggtagtttggctggttacagaattccagttagaaatcattttccttgagaattgtgaagccaatgcttgattgtcttttgtgtgctgatgaagtcttatgccaattctgactcctgatcttttgtatgttgtatttattttttctttgaaatggttagggtctcccctttgtcagcagtgttctgaaagttttcagtgatgtattttggtaagagtctttttattcatgatgctgggccctgccaactgaagactcatatccttcagttttggaacattttcttcaactattattttaatttatttgcttttttagagattgagtctcactgttgcccaggctggccatgaactcctgggctcaagtgattctcctgcctcagcctgctaagtagttggaactgcaggcatgagacgttgtgccaggcttcaaattaattttttgataattgattttcctcttttttttttctttttctttttctggagtctctttaatttggttcttgtgcttaatgggtccattctcttatttttcttaagtccttttttatttcttgatctttttgttgtattttctaggagatttttttttttcaattctacttccaaccctaattatttctgtgatagttttactttccaagagattttcacgattctctgagtatttatttttcttcataacattctattcttattttatggatgcaccattttatttctctgagaataataattttcttgttttcttctgttcttttaattttctttttcttctacatttcatctttccattggtttgttctggtctctgtcttttgtaaccggtgaaccttgattatctgtctgttttgaagagcaaggcactagcacattgactggcagctctgtgagtgtgtggagggagtggagagtgcttgtttactgggagagcctcacagtggagatttgagcaggaacccagctgtttcaattgaggatctccaaatcactgtctttaggttgtttttcttatgctcctcagtttccccagagggaaattctctaatctgttgcctggggaataagactggcaggtggcattccagagaagggaagggagatgctgggggctgggagcttggaggaatgagtgatctcaaggttcagtttgtagactttctttgaatccccctgtcttttctgagggccatcctcccaccctctgccgggttatctcccagtggaacttttcttactcaatctctccatatagtaaccctcttgctttctgacaggtgggcaaggggctgttgcccagctgtgcaatctgggcaaggggatctgctttgtgtctactccttattcacacttttaataaacccccacccattgcttttagcccacccttcattgtgcctgcagaggtgcctgatacctccagttcccgaagttttccagggttctctgggggagaattggctcatttcttgttgactgacctcctgagatcacttggctgagtaagaaaagctaaaaacctctcacccatccattcccatcctaagcattaagggatgatcttatttctctgtgtattttatgctttggtgcttctagatgggatggagtttttactttgccccagcatatggcattgtggtaacatgaggaatatggacagacattgacctcccagggggctctcgactgatgtgtaacaatgcagaatgtttatacaaacctcccttggtatccttgagggattggttccagcatcccgcctccacaggataccaaaacccatggatgctcaagtcctttatataaaatggcatggtatttgcatctaacctatgcatgacttcctgtatactttaaatcatctctagattttttatgataccaaatacaatataaatgctaagtaagtagttgttatactgtattggttttattgctattattttttactgttatcccgttattttttatgtttttcaaatgttttccatccatggttggtcaaatctgtggatgcggaacctgcgagatagagggctgactgtatatatctgcagtccatacagccttataaaagtgcctggaggggaagggagactgggagtgggctggggagtgtccctagaggtgaagaagtaggtgtggtgcatgagatgtgttggtttgccctcatcctctggaagtaaagcagctctaggcagcacatccatgggcaccgattcttctggggcccagccagaagctggaactcacagtcgttggctccttgatccccaggtggtcctgccatcatggctgtcctctgcaaaggtctcctcgctcattgagagaatctctgaccccaaggacttgaaaaaactgctcagaacccggaataatgtactggtgctttactccaaatctggtgagtgtcccttcctggccttgaggtcaaccatcggggtaggatgggattcaggggaaggagtgggaggcaggagacgttaggatgaaaaccacttagggagggtccaagggacatggggtttgtcacctttcctcagaagacagaggcagaggcacacagaggcattggctctgccactttctgatccgagggggtggttccatttcttttttatgactgtttgttgggaaagtcctctggagcccctcactcctcaagagggagagggcgtgtgtgaagtaggacagaggatcacagtggcggacactgggcatggatgtcctggcttcctgcacaggcatggggccgagccctgccagggcatgcttcaccagagctgttgattaactggccaggccggcctgttgccagctgaatgggtcccaggcttggaagtactcaccccagctggcagccctggccctgcccagtccatctgtcctgctctggggtcagatgcaagactgaatttggagtgggctctaagcttgggtcacagcatttcttgggggcaggagcagcggcctgcctctcttctgaccttgaggctggcaaggacatagcagatggagagaggtttgcttggctcttggcagtgactttgggggagggtgaacgctgactctgttgaagttgttccagcagagttaagtgttttttgctgcttctaaggatgccaagttttctgtggccctggagaagcagcagccagtggctggccagttccgggcaaagttttccccggcagctcggcctcagcactcactggcacctgggggatgatagaggctccagacgtgcctgcatcctccaggcatccctggcacgtgggatgtgttcattgccacttgcggctgctgcttccccttctggcacacatgccccgagtgcattgttgggagcccagcatgtgactagcattcctctgctgtcaggaataggggcgaaatcaagggaaaggggaagcagtgtcctcttgaggcctggggcatagggccctgaaaacgtgtggcttgctgccttggatactcccggagttggaactaggaggactgtcagtgatagacacgctccattccttccctagggtagatcccatcatataagctcatcataatacagtctcattggctcctttgctgtgagggaggcagtgcaggttgtcagaggacatccagtatacaaatgaggaaatggaagctgggagtagcggacttgtttgagatcttccagcagcaggtgggagctggtcccctatgccccgctgtctctcattttctctgatggaggatgggaagagagtattgattctgcaatgacagaagggctttgagatcaggttggggctgaggccggaaaatcattatgggaagttagagagtggaaaggtggggccctgttgtcaggcgcttgcagggcaggaggtagcacctaagctctctttccctcacccgaccctgtcttgagccattgagagtagagcccctggtgcttcccacttgtcagcctacctcctgctttcattgcctgatggggcctgggcaattattttaacttcctgcctccttgcctaggcctgctgcacgagagacatgtgaccttcagtggggcttttgaacagtgcagaaactggattttctttgctccctcccatccttccaagcagtgcctccctttccatggctaaaatgcaggttagggcagggggtactttatcttgctgtagtttatttctccccctcccctgcttcccagaacccagtcccagcagtagaacaatggctttccccacatcagtggctcgccctcctcctgtcaccctggctgtggtttcctgggagtgccttctccgagtgactccatgcatgtctcttgagcgatacttttgtttgcttctgtgaaaggctcagcatgctctgtattcacaaacagctaccattatccacactagaaaaggcgatctgcggaggcacataattcagacatcatttctgcttggcttggggatgtatcatatggtttttggcgggagaaagcagcagatcgctctccccacaagtctttgtctggcaggcctttcaagtgagctcacaggtgtcgcctaggagaacgtgactcaggagcctgctggccacaggaatcaaacactggccacagccactttgcagtggatcattgcaggctggcagtgctgaaatcctggccacagaggctctgtccctaagaccctgccctcccacagtagtatccgggtgccttgccctgacccatcaggattgacatctgcaccaatgagaaagtcttcctttcttgtgatcactccatcctgtcccaaggcatggtccacattcctgcaattgacccctggaggtgctaccaggaccagctcttgccccgtggcttctggggaagtgggctgttaaatgtggcttaggtgtctttggcattggcccatcagagcctagtgtcacttatagacctcattttatcatcaggttgtactgagctcctagatgagcgtgtgctgcacaagtaaaggaaggatctgatcctagctctcgtcagctcctaggtggggcatcaggacagatgaatgtggagtcagcaacatcattccctgctttagttataggattgtcattgtttatggaattgtcaaaatgtatcccagaaagacatgagtcggagactttactggccttgaggatctggctgagagattcttggaatagtaaggtgtgaggtgtggattaaggcagggtgacttgggggttctgtgtccaagaggaaggcccctgagtatggtgggatcaggggtttctgagaagagccaggaccattcttgcagcacaggccctagcactgttgaatgcagggatgggtgttttacctggtgctcaggacttctccaccccctctaggattggtctccatccttcctcacccctgagggaagatagcagacatgacccagtgcccttggtcacagatgtttaattttttgttttttttttacagaggtggcagctgaaaatcatctcaggttactgtccacagtggcccaggcggtgaaaggacaagggaccatctgctgggtggactgtgggtatgtgctggggccatgtgccatggtggctgctgggcagaggggcacttggggctttgattggtggggacaggaactgtctcttgattaataatctgggagagaggatgcgatggaaagattccatctagtgatacttcgaggtcacctctggactggaagagtggtgtctggctttccacccctttcttcccagcccagccccatttcttccctttttccgtagagctttcactttcttctatttccatgtgtttctttcttctgtcttcccagagggaggtgagtggcagagggggccttcctgtcttacagagggtggccttgataccccgagaggcaaggtgattttcaaggttacccagtgggtttgcctgtggtgggtctgcagcaagaaccatgagctttacccccaacccaggacattaccactagacgcctctgctgcccaccatgcaaaggtagaatcagtgggtcaagctgtctatgccttggcttctgagggggcccaggcctataaaggtcttctaaatctttaatgtagctattattgcctgagtcataagccctgttactaccctgcaggttaagcgagcttttatggcacccactccagtgtaatcctcttcctctttagtctgagttctaaatggttacttttcgagtgaatttttgggacataactgatttataagttgatgacctcaagtttgttctgcctgtgattagagagcattgaaggagattcatattttgacaaagcactgagtgaaactaggataataagtcttagccaagtggtgtgtgctgtagagggtgtgtgtgtgtgtgtgtgtgtggcctcatacttccagattcattcagatactaactgaacagaaaaggttgctcaccaggcagtaggtgagatcttagccattggttaattctagttcatagttggtccaaaagtgtgcttgccttgaccagctgtgctctgtgtgactggcaaagtaaaaagcctattaaatgaagacaaggcactttggaatttccatatctgaagatgacagcagttctgccaagctgatggaggcttattgtagggagtgcttatgaggcttgtaggtggcagaaatgggcagaggagctttgacttagttgttgtctccacctgggtccatgtaacagacattactgggcatttactatgtgctttgagaatacgcagatggataactgcatcctcaaggagctcagtgtgtgaggagaaggcagacacttagcccagcgattacaatgtcaggtgaacagtgccacaaacacagactatatgcatggagggaaagcccctccattcttcctggaaaggttgagaaaagcttcacagaggcggtcgagttcacatttggtggcaaagacctcggagcacaataccacgcgctcacagtgccctggctttccctgcaggcagccacctatggagtgggcccccagaactgcctgtggaggtgaaaggcctgctgctgtccctgagcggcctggaaaacatgcagcgcagggtgcctgagtgaaatggggtcaggagtagtggctgaagacagactatggagattcaacttcaggactcaagtttggaaacatgatgtctagagtcaataaaagtgccaatgagaatatcctgtgaatttcgatgtgctcaaattaaaactggggcagggaagcaccttggagcttgaaagagttaaccttaagacagaaggatggactattccatgtagttgcctcgctgtgttgaatttattcctgtaagaggaaatagaaactgaaatgttagatagcttttaaaatagtgtggacaagtaggtgaattatggagccaaagtagattaagttggactcaggaatatctgggtgtgagtttgaaattagagtcagggtgcaatctttctggagtagcccaaggttcagaactctgggctgtggcccatgtaggccactctaggcggcagctgtcacgaaccactgttagaaaaggagatctccaagaacccagctcctgccctccagttcattcactcctgctcctagacttctaaacttgcctgtaatcatcagggcatggggagcccccgtgtcagctccacagagccctgcgttgacagctctcgcagttttcctaagtgtgtccagtccgtgtctgtgggtctgtgaatgagacacacccagggatgggcagaagtggtgctgggaactttgctttctggtgctgtctgccgaggaacgagtaggtggcacggggccatgctaccttctttatccttgtcactgtgaaacagcaggtagccagccagagcttgcctccctcaaatgggccctgctgaggcacccatctctcatcctttccagctctacttccttccctgcccacgaagggttggtggctaggatggggacagggcttggggttggggtgaccaggaaggtcaggagtgcacaggccaccctgcttttccctttaaaaggcaggtgaggggaacagggagcatctggggtgagagaagaagctgctccagtgttgaggtgtctttgcaggtgtgtggaataagggagaaagccttgggcttaggagggggcccgggctgactgctaactagttagttagctgcgctgctcactagccctgtgacaccgggcaagtcggtcactctgactctgtttcctcagctgtgaaatgggacagcgatatgcgttctgccttctttccaggtctgtgataaggatcgggtaaatgaaagttctttataaaataggaaatacaatttaaatgtgagacaccattctcctagtgttgtttttcatctagacaagtttgttcaggagaaagctggagggggagaagtggtatgcttgttcactcagcaactgtttactgggtgaggatcccttggttcttgtaaggatgaacctgaagaaggttttgggcatgggagtgagccccaggccatgggtgttttgctctgacccttaagaagtacagggtgcaggctgggcacagtggctcacacctataatcccagcactttgggaagccaaggcaggcggattacctgaggtcgggagttcaagaccagcctaaccaacatggagaaaccccatctctactaaaaatacaaaattagctgagtgtggtggtgcatacctgtaatcacagctacttgggaggctgaggcaggagaatcacttgaacccaggaggtggaggttgcagtgagccgagatcacgccatcgcactccagcttgggctacaagagcaaaactctgtctcaaaaaaaaaaaaaaaaaaagtacagggtgcagtgcagtggaatttgtaggactaaatgtcagaagacccagctttgagtccaggctctgacatcaaatagctgtggggcctttggcaagtcactgcccttctctgggcttcaattgaatcttctgggaaatgtggagttgagtcttccaagttgctctcatccctaaatagcctggttcagaaaatgctggaagctgccaggcttggtgtgtgtgttataagcgtggctgtgggcgtgtgccttctagtctttcaggggggtctttttgtgcccctccctccccattccccattttggaagggtgcctatccttctctctgaggttctctcctgtctccttcttttctctccccttattaggtttctattcccttttcccaatcctgagtccaggactccccctgcaccgccccattgcatggccctttttgtttttgagatgaggtctcactctgttgcccaggctgcagtgcagtgtcacaatctcggttcattgcagacttgacctcccgggctgaagccatcctcccagctcagcctccccagtaggcgcgtaccaccacgctcagctaagttttgtattttttttatagagaccaggttttgccatgttgccccggctggtcttggactcctgggctcaagcaattcacctgccttggcctcccaaagtcctgggattacaggcatgcgccaccgtgcctggcctggccttcttttggcctcttttcccctttctcctttctatatggatatatattttcctttttttaaaaaaattttttgcttttctgactcttcctccctattcctttatgtgcacctataggaacacacaaacacttctctgctggttttctccccggtccaggccctgtaacttgttgctctggggtgtctgtagggcatctgacttctgtctagggttttgtcagctttccttccccctcactccactcttggctcagacctcaacagccacgctcagtctggctggtgatggttgtccggctgttaagcgggttgtgtgtgcgggagttggtattcccctcgtgccctgccagctgggcgctggggctcgggcttggcgtggagtgctgctgtctgggaagctgagctggagccagcatggagctgtgcctggtttgctaattcccgaggctgcgtctcacagggggcaaggctgtcctatcaggtgcttgctactttcttttcctcggggcttaaggtcattgcttaaccacatctgctttctttcctgctctcctccccatctgcttgatttctctggagcagtcacagcttcccagatgcaagactgggggcctgccagagcaggcataacatattttaaagacttatgttttttcctaaaaactatttgaatttagcatttgctcctaagcatgttcaacattacttaccagggggtaaaacagactcccagaagaactgtcgtgtttatcttgtggcttcagataccttccagcacaccaccatgcacttgttggagtgacacatccccttgaggagcagagacttagaattgctgggctgggagggcagcggaggggaggcaccttacatgtctgcagagaagccatgttcctctctctttttcccgccactcttactaactgtactgtgtaatccagaccttgtgatgtaccttcttgaggcacgtaccaagggaaacagccaactcagggaggagccctgttgtagggaatccttccttcagagagtgctacgtgaccaccacgacctgtccaagttcaaggttcagctcttccaggacttctctctcattgtctcctgccttgtatcctctagccacattctttcacatcatccttggtacttggcatcaggcagtcactcagtatttcttgctcagcactcgcccccgccccctccccctccattttcttcatgtccttgaagtgagggcactttctacgtttcttctcctacctgtccccagggcatcacaggtccacctggccagaagcttgccatgttagaccagggctggtgggaggaagagagttatcccttctttgatggggaaatggaactagagaggctggggtagtcgtgggcacaaagttaatgttaaggcaggcatcagccttccttctggtcttcagtgtagtcttctttctaccccaccaggaggggctgagcgtggtctcccgtggacatgagaaccccaactgtggctgactgaggatctggttgggaggcgaggagagaaatgacaggggtttggaggtttttttgtctccatcttttgccccaggttctggctcctggttcatgtgtcaggatataaggcagcctgtctccatgctttatttagtctgacttgaccccgtagagaaatcaagctccattcagcttatgtggataactccggcattttgcagctcaggaaactaagggtcccgccagaggtcgctaatggcagagccagatgttgaagctgtcattctaatgggctgtggtacttaggctggacttgtgaaagacctcagacccccaccctccgaccccgccgtctcccagaccttgttttttctctttcttcctgctctcatccccactttgatccctgggcctgactcccaggagtgtgtctcgagtctcttggatagtaattactgcacaggaaaatccaataaacatagcactgtgtacctgcagcagccactcccgactagcagccagctgtcccatggcagattcagatgaaaacacccatgcccatgtgtctgtctgggtgtgggggtgtggggtggggagggaagtgtgtacaggcatctgcaatctttccttccacattctccatggaagagagccaagtgaggtggggagggataggctggagcagatcagtggccttgatgcctcattccttggaacagtggtgagtaaatgggcagagggatggctggttcttgcaggacaggggccggggagtcaggtgagggtctttgcactgccagccctttctccatgacccatggtgcattctccattccctcaattcgagcaaagcatctcgttttcctgctcactgctttgtctcctttctcccctagaacctcagtcattggctgggggagggaggtaggcagtagatcaattaattgtacttaatctctcaactcagatccttttaagtctctgagcttaggtaattttctcccatacttgaactcttctgatattcattgtctgcactgcacaattagtgtgtgcacacatgcttgcgcacacacacacacacacactactcacacttatacattttgagagacacaactatgagaaggaggggagcagtgctgagagaacattgtcaggaatttcaggaattgtcacctggcaggattcctggagctcaatagacagagcccagagatcccagaaagccagaaatgcagagcctcatcccagcagcggtaagacagtatcattcatttcagccattcagccattcagtcaggtgatttatagagtgcctactgtgtgccagctgctgttgtaccactggggagatagctgtgcacaaaaccaagcccttggcttcacggagcacatgtttctggagccagtggccctttggtgtgtgccagaagtgtgctcagatgggacaggaagcctcctccccactcacccctcagggagagagagagtgcaggggatggggagaggagagaatccttaggaatgttacataacctaacaaagaaggtggcacagagtctgcagtgagggctcgtggggcgcttgctcaggtggagtgaggcaggaggctgtgcaccgggctgaaacttggaggccacgctgaagaacaggcaggggtgcctctgtgcccccagctctaccagccaacttagttgttttggagtcttggtcctaagccttgcctgggccctcagggaacctaagactgctgtcgtgggacttttccatggaggggtttcccacagagtggaccaggattggcgtggaaatgaaccaagcccctgtttcctccctctgctttgtgatagtcacaggcagaggctgccagccaggcttgatggaagagagaggagcatggggtggggattctcctgtccagttgctgccttgcagcgtctgagcccccaggcaggaactgcagtgtgaacggagaggcaatgagcaagcccttcgcagctgctggtgtcaggatggggctgatggggctgagggaggccatgcacatcccatcccagccttggcccctgccccagctgctgtttgttgttgcagttgggtggacggtaggtggtcacagaaacagtggagcatagcagaacaaaggccagcgaggaaggtgccatgtgagtggttgtaaacatcctgagttgagccctgtgtcccagggaattaactcaaacagggaaagggcacctcgttcgcagttgttctcaaacagacccaccacctgtccatgcagcttcaccacagagtccctgcgggacggggcacacctgaactgtaatagcagttgtcagaagaggcatgcgtggacctcagagggcttaaggataagaaagttttcagcgggtgccctgggctgccttctccatttggagagcccactcccagcttgccccttctctctggactctatcttaaaatgtccttgccaccttggggtaggaactattgcagtgtcattagcctttcctctctggattcctcatgcatttcatgagtccccactgtttgccaggcccatggctggaagctgcagtggctgcagcgatggctagacagctgggactagtagggaggaaacccctgggcctgggggtggaagggggcagggagacactcctcctctctgaccaccacacacctctccagtaagacatgcttcttgagttgcaaattgcatctttacacttaaaatgaggtccttcgttttttacatgtccactgatgagtgttgcttttagaattgagctgagtggtttaattagtccatctgttctgggctggtgcacagctgtgtgaagctgatggctgttggtggaggtgaggcatgtaagcaactgggggatacagcgccttgcctcaggtggctgtcgtacctgtcccaacaaagttccccaaaagatgactccagttgtgtagtcagtggtgaccagtgggcattgggtagccgagatgcccttactgagtcctttcagggctggggagatggcccccaggtaacaagagctctctgactggctgagtgcaggcaggatggggaagctgttgagaacaggtcaggtctctaagggactggtttagggcacaggggagccaaaccttatggaggtaggggagaagaacatgagccagtgaaggagctagtctaatgcaatgagtggtttccaaacttgagcacacatcagaatcacctagaaggttgttcaaacccaattgctcaggtatccccagggtttctaatttagtaggtctgggatggggctgataatttgcatttccaacaggttcctggatgatgctggtgccactgattcagggaccacacattgaaatccattgttctaacaggcagggcaccaagatgagatgaggttgtgcgtgagtgctttgtaaacagggaatggcacctcacaggcatttcttattggaagagagtgtaatatcccagatgccaagggaggggctcctttaaccacagcctggccctttctccttttgtcttttgtcaatacctggccagatttcataacttcttcaacatggtagcatgttttcctcttaccttggtcacgtagtatatagcagatagcctatgtcagagctccaaaaacaaaaatcttgcttgtccacccccaacagagattccaaattgataatcaggggaaggccagggcatccatctttttaaaaacttgcctgataattctaaagaacggccaggattggagtttattttcttgttaccatgggctgtccacccactaagcttctgggtcacctcctttgtctggacctgtctgtgttgccacccacaagttgtgacacacatgctcctgtctgcttttccccttcctttcctttctttcttgctttttttttttttttttttttgagatggagtctctttctgttgctcaggctggagtgcagtggcatgatcttggctcactgcaacctctgcctcctgggttcaagcgattctcctgcctcagcctcctgagtagctgggattacaggcacgtaccaccacacctggctaatttttgtatttttagtagagacggggtttcaccatgttggccaggctggtctcgaactcctgacctcaggtgatctgcctgccttggcctcccaaagtgctgggattataggcgtgagcccccacgcccagcctctgtctttcttgatcagcccctagcctgctagttagtctccaccctctagctctcacagcccatctatagtaaggccttcatctgctattgagaattccaagttacctgacttatttcttaggacaccagcagattttgctgtcaacacctttgtgaggacttcaggtaataaatggttcccaacatttgtgtcttccagtgatgcagagagtagaaaattgtgcaagaagatgaaagttgacctgagcccgaaggacaaaaaggttgaattattccattaccagtaagtacacatgggcatttccaatttccaagtaagtgccaaatgctttcattggtattttcagcgaacagcaatttttagttagattaattttatttcagaatggttttcttcctgtgtttacaattatttcttttaaaaaaaaatcctgaactccgttcaaaagctgaatcttattaagatgctgcaggaaaccaaaggtatgtatcttcacaaccattcttaaagttaacacatttttctcctcatttgacagggatggtgcatttcatactgaatataaccgagctgtgacatttaaggtaaatttacctcccttgttctcagcaatggtggagtctaaatggacgcccaaagtctggcaggttttctctctgagaaaagaaagggcagattgcacaaatagctcttctaaatgacctgagagattcttatctctagagcatatgtcagcagaatatgtggaaaagtttgtagctcttaacacaacagattgacccagctttggaaataggtttgtgaatgtatcagcagttgtccagtaaggcaggtgatgtcacctctctctttgccaaaggcctgggcctcatttcgttgtagcttcaaagtcctcccctcatctctgtggtagtggccaccctcaggctggatgcccaggttagcacagggtattgcacatgggcaggttgacacctttgggctgatgcagcttgttccagatgagatatgggtatcattgaggagttccctgctatcaatccaatttagaagtagatggaaaagcataaatggaaagaaatatgagatcctgtaatctatacatgctttgtaatcacaaagcggctgccccagcccttagtcctcctgaactgcaactctcctccttcagggtcaggattcccttcctccagcctgtcttctgttttctggtcctgcgctggctgaagccatacatttctcctggtcctgacgtgtttgaactcacttcctaaccctcctgtttcccacacggggttggaccctgtgctcctgtctcttcatctgtccctctttctccatctgtgtctcttccatttttcctatctgtccatctgtctgtgcagctgtcagtgtccctctccctctgcccttccttctccctctgtctctccccaccatctctccaggtcattcttgcttatccactaacactcattctttttttaaattgctacagcgttcaccttatatagggactcagcctgattactcatcaccttaacacctacttagacacttagaaagttcttccaactagagttgctcagcccttcttattctatgttaagacgtcaaccgaagttcttggagagaacacatgttccccaggaacaagatttagttgggtgggatgggggaagtgcttatgcaatgatggaaagagggctggagttttgttttgttattgaaggctgtgtatattttatgtttaaccgggacctctgaggaatctgtcttgggcttatggagcagggagttctgagcggctcctcataattgtggtagcagagaagaagcaaggagcccaggtggccccagcatgccactgggtgtctgggtgggagaggcagaatcctggcttcgccccacttcttacaaagaccagacgtgtgaggtcagcgttctcttgaccttcccgtgatttaggcatcaacaaggtgaagaagtggctgagcatcgtacggggccagagtcttcagtttcagttggagagagggcactcttagtcccagcatccccaagcaggactggggcagaatccctggagttcttcagggcagagggaaggggacaggacagttccctgactgctgatggcttctgctttttcagcttgagacagctgagatcagagcccacctcagtcactaattaactttccattcagggtttctcctgggaccctgactccagagagatggaggaccccccgacaggaggggcccatcacctgcaggcccatgttctggctgtggtttttgtcaacccgcatggttgggcagaagcctggtcacagacgctgtgccacggcacctagagaggtcataggccagttaagtgagaacttatctccccactggcaaagaataggaaactcgaagtggggaatgtcccctttaagctgccctttccttgttagcacatactccccaaatccttactatagaagtggtaagggccagaggtgcctggcagtctggattcagatgactcactgatgacctcagggcccagtagctgtgagccaggattacagctatgaaggccagatgtggtgtcagacagtgcctgggactcagagcacccagaataggacagttgagggtgggcttccaggtgctgctccctgcagacttttgccctgaggtcttgtccagttagatcaacttggagagaacctatgggtggggttattcagcttcagttaagtgagaataatcctcacctgaaaaacaaggttgtgtgtacgaacatgtcagttgttacgttaaaaggccatttatctcctttttccatccactgctatctttttttcttgatgctgaggtggagaagggggaggagggctgggcgtggggccaggacaccccccagagcaagcagttcctaacttgttctggagtcctgatcccactgagcacctactgaactccagaccttctccctgaaagcgtgtgtgcatacaaatcaaagtcaatgttttcacatgagtctggggcttcaccgactcctgaagtcccttgtgcaccctagattaagaacccctgcaccaggtatttctggaaccccaggcaggtgggtgcctaccagcatctttctcacatggcctggtggacaggtgcctctgcagctgtgggtgagtgtgggtgtcgggaagaccctgccaattccatagttccttatgttgtcatggcaaagccttgacaagggactgagaaagggtggatccgccttttgctgtggcagaaatggctgttcttttgccaggaggcgtttcacagctccacttggacaggcaggaagcactacctgaatgaaatcctatgaagtcttggctgtctcccattctcccgtagtagttctttccaaatagagtttccagaaataataaggtcctctccgtgtgtgaccagtggatgggctgaatgcacacccttactattatagaagggcacttccctttctcatctcaggccacacacacgcacacacacacacacacacacacatacactctcagttcagcatctgctcgctggagcgtggtcaaagttgacagaagtaacagaatctggctggggtctggttcctgatcctggctctcagactttgagcaccgtctctgagtgactgaagggaaagggaatgctgcttctgccctggaccagtgagagtggcagaggatacagaggagggtggaaggacagtgccactcttccctgcccctgtgcatcttccccacagggagtggagatttgagtcattgtacacataacaaaggccagcgaagccctttatctgtaagaacttggtcagatcttcaatccaggcagtctagaagaggggccccagcatgagaagtatagcaacaagggtgaggccacattggtgcccaccctgccctgggggcttcccagcctggacctcactcattcatatacagaggcggataatcaggatttaatccactccaaaaccagtttagatcatgaaataccaagcaggtcataagtaggtatgatgatctgcttatgggatgacagttttagtggctgcaggaatgtggaaatgtctcctttggacaagactgagaccattattccattagtcagaaagacttcttggaggagatgagatttagtagaagcactagtatgtctctggtttgaataagccaactcattgtctcaaattttctcttttttgtccttgaagatgcatagtaggcatggactacctggctggagtgagcaaggtgtcttgtgattgaaaaagcccgatgggagtggtggaggtgcatttttgggcacttatccatgatgtcagtggacagcggaaataacacaccctccaagcttatgccacatgcagtcctgagctcagcagctggtgtgcccaggtctccaggcagggaaagaggacaggttcctgattcccccacctccctcttttcagggctaaaatgcattttctcttctcttttttttccctcagtccatagtggcctttttgaaggatccaaaagggcccccactgtgggaggaagatcctggagccaaagatgttgtccaccttgacagtgaaaaggtaatgtattccccgtcagttctgatggatgctggaagcttccctggtaccagggcctcccaaggaaaggagcccaacgaactgagaaatgggactattccaggatcacttgtacttttcctctagggaagctaggccaggaccctaatatttgactccccttcccagctccatgttgtaaccagcggtgatcacaggttgcctgagaattttctccattcttcaccttccttatttaatgcatttgaacacgtttagattttccatacattaatgtagatttaaatgttctctctctattgtgtaatccagatgttgttaggattggctttacatcttgtttttttgtttttgttttgtttttttaaagaataaccttagagatttgggttagatttccagagacttgaggcagatctctacaattctgggtcattctatagctttcaaccaattatttaccttcttatgcttcaatttccaaatttggccaggggtggaggtagaagggtagatctagattatggtgtttattagttcttaagtatttaacaaaagctatgacaggccggttgtggtagcgggtgcctgtgatcccagctactcaggaggccgaggcaggaggatcgcttgagcccaggagttcaagggtagcctggtcaacatagtgagacccccatctctaaaaaaataaagaatgcaaaagctgtgacacacattgcccctccatccacagcctgcccacctgacctgaatgtgcatctttagccatgtgcatccgtgtttgtatgatgccttcacttgggatgggcaagaacttctctgtgatagtccagatggtctgtgaggcaagcagtgctttttgtaggtagagggagagggttcattcctatctcaataaaataaaacatagctttcatctttctcttcctcctctcccctttcctttaaaattgttgactttttttgtttttagagacaggatctcgctctgtcacccaggctggaggagtacagtgttgtgatcatagctcactgtaaccttgaattcctgggctcaagcaatcctgcttcgacctcctaagtaagtgggactacaggcacatgccaccatgcctggctagtttttatattttttgtagtgatgggctatcactgttgcccaagctggtcttgaacatctatcctcaagcaatcctcctgcctcagcctcccaaagtgctgggattacgggcatgggcctctgtaacttgcctattgactgtactcttaatgcttgttggcccagaagaaaatgatgcctttttttaaccttctggaggaaggtaaaatatgtcatcattgtgagccaacctagtggatcagtggtgattcaaattaaggactgggcacaacattctctgggatacaaagagccagtattgtcatcttgaagatgtctttttttttttttttttgagacagagtcttactttgtcacccaggctggagtgcagtagcgtgatcttggctcactgcagcctctgcctctggggttcaagcgattctcgtaccttggcctcctgagtagctgggattacaggtgtgtgccaccatgcctggttaatttttgtactttagtagacatgggttttcaccatgttggtcaggctggtcttgaactcctgacctcaagtgatccacccgcctcggcctcccaaagtactgagattacaggcgtgagccactgtgcccggccttaaagatgtctttttaaaaagcatgtgggcccggcactggctcacgcctgtaatcccagcactttgggaggccgaggcgggtggatcacaaggtcaggagtttgagaccagcctggccaacatggtgaaactccgtctctactaaagataaaaaaattagccaggcatggtggcatctgcctgtaatcccagctactcgggagactgaggcaggagaattgcttgaatctgggaggcagaggttgcagtgagccgagatcatgccattgcactccagcctgggtgacagggcgagactccttctcaaaaaaaagcatgtgggggcagggaaagaggggcaagtgccaggagagagtggcacatgtgcctagacccatggaaatacaaacagcctaaacggagtgctgctcctgtaatgatgaatgttgatagcttctctggaaagtgattgcctggtgccttcctcccccagacacaatgtcctgaccttcctaaggttgttcttctgtaactgtaggaatatcaagcggaaatatttctttcacacctgtagggaatcctcttgttctgctttgtgctcttttctctcctatggaaataagaagtatagctggttctctgctaatagaatgtccacataaataatgaaaagttccaaattcaagtttgaattgctgattcaatttgtaggcttggaatttcatactttgtgaaggtaattaagcatctttgaatgtaatatctgttactactcagggtatgaaaccaaattgctataggctcaataaaaatctcttctcaggtcttttactagcttttatctacagaaatcccagaagacaattttagaagtgtttgcatcctgtacccgtagttagggttaaatatcttggttactaattttgtttggaaattatttcaaacaaaatttgtttgaaaattagtgccttaatgctctctctagttacgtaaacaaaggtaaacttttccagaatttattctagtgttttggatatccacaaaaatttaatcttttttttaatctaactgaaaaattttaagttaatgcacattcattgttgaaaatttagaaaatgcaccttcagcagaaagaaaaaaaaaatcacctcatacctttacattgagagagatgcctgctgatatttttgtagtcttccaggctttcaagataatgtgtatatgatgtttttactcacaaagatgccattacattttatgtgctgttttgtaacttgcttcccccaccctttagtgcaccatgcacatctgattgtgacattaaacactcctctttatcggttttaatgatgcagtagtatcccattgtgcgggatgtgccatcatttatttacctaatgccttcttgctgccagaaagctgcattttgaaattttcttattttccttattattcaaaagagaaaaccctctcattttcttctgtaaaatgtggttgagcagcttactttaatcgaaatatgctcttatcatcgtgcttcactgcagtccttgatagagttgctttttcccatccatcattggctctcattggaagaaaagtctctaccctgttcacacactcaagtctttacatgagcactgtgtggccatttgtctttttgcctttattgtatgtatctaacaaatcattatgtattgcttaataacatgcctggcactgttctaagggttttacaaatctattttgcctgtaacctcctggagggtggagcaggccccctccttctgccctgtgtgctccgtggactcctggggataaggatggtggtggcagagctggagcctggggagagattagcgagagattagtgggtatgggttaacccgtcttcccacagtgagcggatccccatctgccaagtcaggcacacatgaaaacagccacccgcagcacaacaaaaccgctgtgtaagtcacaggaaggggcagcctattcaacagcctcacgggacaaaaaccgctctttgccatctttgaactgttcaggtggagctgaaaggaaagccagcagcctggtcctcacgactccctctcaccaggcggccaaagccatttgttagcttggggcctcagttttcccatctgtaatacgtgagggtggtctcgaatagatcatctctgaggttcttccagctcctggcctgccgcggctctgcccccacccgcaaatcagctgccagcgtatgctttctgaagtgctcactccccctcccctccccatccctacccttcaccctgctgtatgcaggaggggcggggagggggtctcatcctgttactgtgttgtgtgcgagctgctggtattctctttttgtgcctcaggacttcagacggctcctgaagaaggaagagaagccgctcctgatcatgttttatgccccctgtgagtgaactttctcccttgggccagagctagttgtttagtctctttgtgggtgggaggcaggtgggggttgcgggcggggtctgggggattagcctgggtgcctggcttagaacgctgaatctcatctctccatctgcgcctcttttccttcatctttgccttttcatctggctcctcccctcctgctgtctgccctgcattctgtctccagtagaatctgtgtccttctaccctctttatccagagcttcaccctgtttggtcagctccaccttcccccaccatgtcccatttcctgctggtggtgccatgcctcagtggcggtcaccttgtggctgttctgccacccctcgggcatggcgtcatggtccagagcctggcccgcctctgggggcaacagcttgcctagctctggctcccgcatcctctgctggcatcctctgcaggtgccacctgggaggagcgggggaccaggagcagagagaaactggttccaggatttgggctcagtccctgtatgaggcaggaggatgtgggaaatggcaggaggatctttcagatgacagccagaacatgtgggtttgaatcccagctgtgccactgcaagccgggtgaacttggccaagtccttcctcactaggtctcagtttccacatctgtaagagaagggactggatcacagcagtggctttcaaactttttgactgaatttcacagaattaaaaatgttttatattgcaaccagtactagaagtatatataaattatatgcaaataagctgagacaaaagtttcgcaaaaccactcttgcccttactattgccatctgttgtttaccagatgtaatgcccactattttctgttctgtttttttaaaaaattattggttctacgtactgcttcataaccctctgacaaagggtcagcaaattatggcccacgggccagctgcctctttttgtaaaggtttattagaacccagccatggccatacattgatgtggtgtccgtgggcgcttgcgagctataccaacagagttgagtcttgtaacagagacggcgtggcctgcaaagcctcaaatattcactgtccgggcacctccacagtctaatggctcccaacccacagattgaaaataaccctggatttgagcctgccaaggccctttgtgctgcacctctgtgagctgcatcggcccttcacgaagccagcagtgtcagtgtttccctgaaggctgagcaacagaggggttgtatatgatgcaaggcaggtgtgcctaggtgtgtgtgtggctcaggagggtgtcataggctctggtttgtcatagcaaaccagagttctgtttgctcatgaaagcccatctcgaatcccacttcctgagaagttctttaaacaaaggctcctcccatctgtgccctggggatgacgccccccagccggatgcccctctgtggcattctggtggttctgcctgacttgagccagtagcttattcgccatgacagcagcctttccccagccctattcttttttttttttttttttttttttttggttttgagacagagccttgctctgttgcccaggctggagtgtggtggtaccatctcagctcactgcgacctccgccccccgggttcaaatggttcaaatgattctcctgcctcagcttcccgagtagctgggactataggtgcccgccatgaggcctggctaatttttgtatatttttagtagagatggggcttcaccatgttgcccaggctggtctcaaactcctgacctcaggtgatccacccacctcggcctcccaaagtgctggaattacaggtgtgaaccaccgtgcccggccccccaagccctgttttgattgctgggtgtcctccagccccagcctcctccccaggcctcctcgctggccccagggctgtgcttacctttgggatgaggccctggtgtctcacttgctgtagatccagctctgccctgaatggtagctactttaaccctcgctccttctctttattaatgttcattagttggtttcacccctttttgtttcttcttggaggaatattactaactacccagctgtgaattgctttaggaattattctgtccacacagcccctagaggatgggcctcctttggtatatcttaaagcccttcaggactcaacacattggttaaatgaagctgtaaaatggagtgtatatcaatatgcagtgcgtgccacaagacggcatccgggtgtaaccaggcaggtctcagtgtgatgccattagtcatttagaagtgtgcacgggcagtttgcgcccgtgtgctgtgccctctcccgccatgcacccaggctgtgtggcagtgtgcccatcccatccttcacgacagagaggtgagcacagttatcatctttacagaagagaaagctggggcaggggaaattaggtacctcacagagtcacaaagcttattggtggtaggggagggaggagaaaactcggaggttaagttcaacttttggtggagggtcagatcggttgcactcctaggtcccaaggaacctcgggaccctttttttgattatgcacgtgtgtatgattttttacaaaatgaaacaaacttgtgcttttagcacactagtctaatcaagtctccatggcatcataattcagctgattcctgggatacacagcagttccctaactgggacgtctgttaggactctgtgaccctttggtcacatgttgggtgaatgggcccaaaggcagtgagaacctttggtggtgacaaggaacctggctccccaggatctaccgcttattcaggaaatgtttgctcactgaattaataagaaaataaaaaggctgactactctgacttttgaggtttgagaatgataattagtcttacctctccccctgcctcccagtggaatcagctggaagataaactcaggaagcacagggccagccctatttttggtaaagttaaattggaaactggcttggcctgtggtttcctactcctcctgcatcacctctccccaaccaataacttctccacccagcaccactggccctgcccacagggacaactggccgacttatcctctgtttcagggtgttattgctgcaggctgcaaacaggcgaaacaggaagagagaggccacactgtggagacagatagtaaataaagttcttgatagatgaatgtggcccagtgggggtcagactgaagtcactgagcgaagaatgagtgaaaggctgcaggtgtccccccttattttccctcctggggagtgcagcgacatcctcttccctcagtggaagtgtttcccccaccatggactgggaagcacccccccaaatcctggcattggactaagatgtctctgcaggcactgaatgttccccggctctatctaacacctgcagggcacctatccccactgcacagatagggaagccgaggcttggagagcccaggccacttgcccaagatcacccagccagtgggagttatggggagatgcagacctcggtctcagccttgttcttcccagagctgagctccttcctctgcgccatctgcagcctcctgttttccacccggtgcatttccccctgagcgttgttcctgcttctgttctcctctttctgaatccccacaatggaaacaatgcccctgacaagtgtcatattccttccttcatgccactgatggtgttcgcactgaggtggcaggtcctgaggagaggtgcctcttatcttctgagggcagattcggcgggctcgcgctgcaggctggcctcgaaacagctccttttctcctgccaggactgatggcagaacttaagcccagggttcgcgtactggggtgtgtgtgagtccatctgtcagacaggaatgtcaggagggggctgtggggcagttttggagcctcatggccaaatgtcctgtgtctgcatcttgtccggtaggcttggtgctggggaggttctggtggcccagaaggaatgttggccttctggcttcacggcctgtctaggcgtcagctaagcatggattggagctgggctgcctgtcgccacatggaccctgtgcccgctgtgccaagctgagatcagcctgacacatggttccaggcagctttggttctgtgctcttcagatgcatcttaagccctgttttgtagcagagaggcagtcggaaagggtaatagcctggcacttcagaatccctgctgtctgaggaaactgctcatgtcctgtgggatcagtgctgaaatgtggtctgctctggtttaagggaaggagtttaaggtcactctaaagttttagtggatgtttgggacctggccttcctggtcgcttgagtccaggagttcaaggccccctatcaaggctgtgggtcttcaccactaggagaggagtgtgaccatggtagaccacagagccccggagggctgagccaaggccatcgcagacagaatcctttgctgtcagagctggaaggggccttaggttgtgtggtccagcctctctcatctgccagaagaaacagcccagagagaggaggtgacttctccaaggcctttagaaagttgagtgaagatcagagtccgcatggcatcccgattcctggcctgacgctcttcccacaggccagagccagcactgttcaccatcagcctgcctctggtcattgcttaattatccttgttaatgaaagagaaaggaggcatggacatcccaaaagtgatcgtattcgtggtcacacatttttcttcataatggcatttgactccagctcatttgcaggccctgcctgggcagtgaggggtggccttttgctgtgcgtgcagcagttgctctcttgacacctgttctggttttctgaatctctgttgaattcattatcagtgctgaagtattctgggctctgctcttctcccatcatgtcatgtttgtttctttagtccaacatttatgagtggctgctgggcagtgccttgttttgcaccactgatacagtaagctctttgggggctgagacgcccacctcctgttccttttgtgtccccagggtctggaatagtcctgagcttctcaaggctggataagtgcttgttgggtagaggatggccatggggaggcagggcagggtgcaagggctcagccatccctgtaaccggatgtggtctctctcctgcctgtgaccagggtgcagcatgtgcaagaggatgatgccgcatttccagaaggctgcgactcagctgcgaggccacgccgtaagtgaggcgccattgcctggcagggctgggtcactcttggacttggcggaggaagggtgccaggggtggggtggggacaggttttgaaatggtgaggatgactgaccctgctgcctgggccgttgctgaatcgcagccttgcatggagctcagagacctgttctctgtgaaggttgagaactccaccaagttgctgggaccaggagagtttgacacctgccaaaggccagtgatgaaataggacaccagcaagatgcacatgtggcattgtcagggggccagggaccaaggtcggaacatcgtgggtccagaattttgagggctgggctctgaagtgagctgaggcagctgctatggagcccagtggcaaagaagagggtgtgatgaccttaggggtggaccagaagcataaagggggctcacagaggcaaaggcctgtcccggcttcccaggctctgtggttcctgtggggcgggaagaacggtgggaaccagaggaggaggaggtggggctggatggggagcgaaagacctgggaatgcaggcattctcccagaaggagtgtagggaaggataggcagaatggagacacatgtgtcctagggatgcccacctctacaggaggaggaagaggagccactaaggaaatgggccttcagagaagtaggagcagctgggatggggcggggaggtaggaggggagcctggagtgttgtgggggagaagagagctgggaggggggatggacctcacacagaagggccgagggtcagtcaccaaatgctccctggtacctctgtgttcccccaccctgccaggtttttttgttctctgccttgtgtctattattttttcaatgtggtaaaaaacacataacattacattgactatcttagccatttgtaaatgtacagttcagtagcattaagtatatttacactgttgtgcaacctttctctagaactttttcattttgcaaaactgaaattctgtacccactaaatatgaattctgccttcccaccccactcctgaccttgataaactgcctttctactttctgtttctatgattttatatatatatatatatatatatattctgttttagagacagggtctcactatgttgcccaggttggacttgagctcctgagctcaaccgatcttcccgtcttagcctcctgaatagctgggacttcagatgtatgccatctagccaggcccatttctatgattttgactattttaagttactcctatgagtggaatctatagtatttgtccttctgtgactggcttattttgcttagcattatatcctcaagtttcatccatgtagcatgtcataggatttccttctttttttagggctgaattatattccaccctatgtacataccacattttcttcatacactcatctgttgatgagttgcttctagctttcttggctgttgctcataatgctgcaatgaacatgggtgtgcaaatacctctttgggatcctgcttctaattcttttggatatctgtttatccatttttgcacttaccccgagtagcagaagtgtcttgatggcaacataaaaacagctgccggctcctctagggagcgtggaaaaatccatccatctttcatgaaaggttatcaagaggagccatctcaatagtgtggccaaagccccattaagggagacctgaggtcctgaaactgcatcatgatctttgtggatcaaattaagtggtgattagctcaaagtcaacttaaaaagtttaagtggcagcacctgggcatggagacggccctgctcgccaagctgcaagatggggctgcagagagccaatgctttctcttttgacctcattctggggtgacactgaggtcctgcttgcttctcactaatgaatttttagtaacttgcctggagacattggccttggggcacacatacatcaccccagggaagtttcacttcacattattgggacctcaatagacaccatattttgagattatttagcctggagaaaagacttaattacccacagtattctctctgcctgcacccgcatacacttagaaatctgctcagctcaacttcccgaattctgtgctgtggaaggtaagcagctcagccccaaatcagatcacaagttattccagccagacccactgaagcagaagagaacttgatgccagtctcagtgcatctcgtgggccattctcagccaatgctgcatccactgccaaactcagtattcttctaggccccatcccacgctgccacagagctcatccctgtcacgcacagccagatacgttcatctttgcttttgttccagatcactttgttcagcacttgatactaattatgatatgtgagtttcttgggcacaggagttgtgttcatgtctatttctttagcacatagcacagggctaagctcacagtagatatccagtatatgccgatgaatgaatagggtttttgctcatcactcctgggggtatgttttattttaagctctatattaaaagtgatggtcctctcttttaaaggaattcagagcatttgttattaaggccggaagcatagtgggaaggacatttgtgggacaggttataaggttaactgcaaagaccactcgtgttcagaatataagcttccagcagggcatggtggttcatgcctgtaatcccagtgctttgggaggccaaagtgggaggatcacttgaggccaggagctagataccagcctgggcaacatagtgaaaccccatgtctacaaaaaattttaaaaattagctgggtgcaatggcatacacctgtagtcaatgctagctacttgggaggctgaggtgggaggatcacttgagcccaggagtttaaggctgcagggagctatgattgcaccatgctctgcacaacagagtgagatcctgtctctaaaaaaaagaaaaaatgaattccagcttcttctgcctgggcccaggtctagaaatataaaagttacccattccagttccctcaacattacagaaaagtcaggggcgttgtctgcaaagctgggcaagtcaagctgtgaccaggtgttggctgccttggcctaagacatctgggttgtgtaaactcatttctttgtttgtatattttcttgcttggggtttgttttgttctattttccctttcatttcctagaaaagcatcttctggaaagttctagccctttcccagctacataaagagggaagggccctggccgctgcacgcatcacccacgcaggaggcccctagaggctagggcttactctgcaggggcagctccccagaaactggggacctggctggaggggttgagtgaccacaggtgtcaattgctttttgtcttcacacacagaaaagaggtgggactaataaatgggctgctattccccagaaatcaaagttcaccccctcctcgctgctgaaacacagctggattagggccttctgtcacttcttcatctctgtcatctttgagcctttttggctgggtctgtctctggcaagggtcaaaaatcttcctcctctacagattttttgggaggtgttcaacctgattgacatcattaggaaggaaggcatgccaggtcagggatgcacagcctttgccatttccaaacttacagctgcctcttttgtgctgtcattgacgtctggtgactcatcgcgtctgtcccatctactcctgctaattgacatcctcattagcagccacgctgcccccatctcagagcagccatcagaatgagccctgtctccatctgcctcttcccagccttgccagttattgacatctgcactgagcctttgagctttgcctagtctttggtggacctcggccatgatgggccagtctgggtataaacaccatgaaatagaaccatcatgacgacagatttgtacagaccaggctctagtgctggctcttgctaaccagctgggagatcttggtccaagctccttagccttggagcctccatttctccatctgtaaaatggagatgataatgccaaccctgcccacactgggttgtggtgaggaacaaatgggctgtgtggaagaagccctgtaccccacagagcactcatagacacagatgactgatcccctctcttccctacagctgccctgcaccacattccttccaccggctagatgggggtgctcccaaggttccgctttcctgttaacacattggagcaaggttttgtcttattacagtctaccttccagtgaccacatctctgtccatagcttcaacaaaacgtagctccatggagcccaagtccttcccctaagtgccagtgccacgtgtcagatggcttgcttcacagctccatctggattttttcccttgtgtctcaaatgcatgtctgaaaattcagtatctttccatctggcagactgtgaactttgcattaagtcctttccccaggggccaggctctttccccaccccccacctccacctctctttactgaggcatcatcaggcatcttcctcatgcacccttcatcctctccctgcccaccagccctgtccagtgggctatgctagctggtggccaaaggctgctgacttgtctcctgaccacagcattccctcatagctcgtcctttctgcttcgagagatacaactggtttgagggttgctttcttacttagaaaccctcgggagctctccgtcacttcctgaatacagtcccgatttcttaggtatttcaagcctttcccaaagtgatcctggccaactcactcagccttttctttcatgtcttctcctttctgtgtatcctgccttccagttagatggaaatgtgctccatttcttgggccacatctttctttgccttgcctccagttccccatcccgggacgtctgttgaaatcttactctcctctgagtgcaagctcacatgcagcccacgctaagaagctgccgtgatggttcctggcagcagggctgaacacacagaagagcatgtcacgccagctgagtggccccaagcatgcagatggcagtggggagcagggaggctgtgttcttatcttctccacaggccgagaccaggtgtgtcacctcatttgacttcacaaattctaactccagaaagtgtttgtatgtagtttttcaaaaatttttgcctcattaactaatagatgcccccaaaatggcacaaaagtgctacagaaacttggagaattaagagctcaccccaagcgaaggtggtttgcaaaggctgcccagagacgtgaggtttgatttgccttaagggatgggtgagtctggagggtcgccaggaggcgggggatgggcagcctcagtaaggggactggaaggcaccaagtgggggccaggagagaacagcgagtgttccagaagtgtgggcagaaatagagcacctcctagtcctagtaacaaaaatagctaatacattttgtgttattgattatcttgtattatttcattgaatcttctcaacaaccacatgaggtggctgcagatgaggaaagtgagacgcagagacaactgtgactcattcaaggaaatgcgcgaccccatggggagttgggactcaaacccaggcatcctgagtccatgcttccagccactgcatgttgctgctgcactcagcaagatgtctgagaaggcagacagtccaacttccttcctgtgcagaaatctcagactgtcttattcctgggagaataaaaaatctagaccctaacaggtgtacaatgaagagttttgtaagaaagaaagattcaaaaatgaaataggtaacatatgggcattgaatgtggagctggattttagcctatattcaatggaattggaaggttttgtgcagggaagtgatgtaatgagcgaggaggacgtgtaagattaatctgtggtgaatgtgcactgacactggggagatcaattaggcagaaaaaaaaaggacttttaaagaagacaaatattactggaacaggccgctggagcagtctgggaaatgagcagaatgacttttatagagcgttccagggcttcaagtaaattcgaattcaaatttattcttcctgtattatttgctgcatcctaaaatgggctaggaaaaaaaaaacagtgaatttagtgagcatttattgtgtccttgctgtatgtgaggccttgtgctagggacttaaaacaattggaaagatatccaggtgcccctaggaatggagaggccagaggcacagtggctcccatcaccaggaagacttggtaggaagatgacagttactgagctccagttttgtgctaaaacctctcatctcatttagttctctaaagagccctttgatggtcacatcttccagcaagggacctcagtgagggtgagtgacttgcccaaggtcacatgactcataagtggaagctgtctttgcaatcaatttattgtccactgaaacggttatttattttcctctctctctgtgtccttatgtattattcagtaaagttcagcttcctgggtttcttctctctgcttctgtaactactgctggctttttttacttacttttccctcgcttctatgccactctgctttgtggaacaacctttgtgtgtcgggccattctagctgtgttctctggtaagaacagattcaaagtcctggctgggcatgctggctcatgcctgtaattccagtgctttgggaggttgaagtgggaggatcgcttgagcccaggagttggaagccagcctgggcaacacagcaagacctcatctctaccaaaaagaaaaatatactagccggacatactgccacatgtctgtggtcccagctaatcaggaggctgacagcggaggattgcttgagcccaggagttagagggtgcagtgagctatgatcatgccactgcagagggagttttaggggattccttatatgagtcagtcttagtatttagctacatcgtcggttacccagctactaaaatactctttctgattcagggatagtggacatgtggacccctggagccagaatatgttcagaattctgagatgatgatccagccaggctgtgggtaatggtcaccaacaggaggaaacactggggagacacagcacggcctggaaggaggagagttaggcaggtgcctcgtttctcatgttgtgttatgagaaccacacggcctccctggccacatataagctgtgaggtttggaaacgtcacactcaagcctaggtgagcaaaccgtgaggtatccaggaaggtgtctaaggacgttgtacagagctgaattggtgtatgaaagccacttatttccatagcctaggaaagagtacaacccgagttgacatgaacagagaaataggcgtaacacatccttggcagtggcccctctctgagagtaatgtgaacttgatggcaaggcccggcttcttctgcaaccctcagaacgttggttttgctctggggtggttcttcctgcagggaggcagagggagcaggcgtgcggagtgcagcactcggcccagctgcctgacttctccagcgccaggtcatgattcccggctggcttcgctggccttgtttctcagcagccctgatgcacatcagtctgtggggctttgtcccatatgtctttctggtgggacagcagctggacagatggcgtgtggactagagggtgtctgtggggcacaggctccacacggctcttctccgcttcctcccaggtgctggccgggatgaatgtctactcctctgaatttgaaaacatcaaggaggagtacagcgtgcgcggcttccccaccatctgctattttgagtacgtcccccactttccttctaaagctcacctccctccctggtgattgaccataatctcagggtggcatttgcatccgtgactgagcccacgttgtttctccacgtttcacaggaaaggacggttcttgttccagtatgacaactatgggtccacagctgaggacattgtggagtggctgaagaagtaagtggggtgtgtgtgtgtcagtgggcgtggacccagagggcggggcatctgccgggcctgagggtcgcagggctctggctggaggttgggggaaagaatgaggaagggaattgtggtactgcctacacagctgtctctggcttgagtctaggccactgtggggattgtgggaatttaggttgcaggagccatgaggatttggtgtgactttggcctgtgatgatcagacctgcctgggtgttgggtgtggagtctgtctcccctacctcccgtctccacgggttggaactggggaggggctgcctaagcctgtcagctcttctggaatagtcagggcctttctgaattcttcccacatttcacatcaagtttctcctcaacacatctatctgatggatagaggtatttctcacccaggctaccaggtttgagagaggttccactgcaggtctctctgaaaatagaattgtcagttgaacacttatttcaaacacagcactgtcttaggtgctgtgaaggtactaagaaatattctaatgccttaggtttgctgagtgctttactgttcaacccccacaggcattgcttcattgcaacctgtgatccctgttttataacatgattagatccttgtaatgccaaaccccaccaccctgttggctcctgcctccttacctggagcctccactgtgctaggcctgctgctttgtcctgccagatcaccccattcccacttctcaccagcacttccacgacaggctcacgatgtccccttctggaagcctccccaggccaccctcgctgagcacgcaccctactcaggctgcgctctgtgtgtcacgagtttggcacttaccagccactgctgcttcatgagtatttgtgcatatgtgctggagtaacaacagccaacatcttttgggctctcctttgtggctgacattgttctaagcactttacatggattctcatttaatcctcacaacagcactgtaaggaagatgttaccgttctcttcattttatgaatgaggtccctgaggcacagtaaaggggtggtgccggtaagcagtagcagggccctgatgggtccccgccaccaacccagctccctgcagccccgacagtccaacttagcctcctcaagttctgctcggagcccctcccctcagctgccggcacagtggacatttattgacatcattaccttaggaacacagtgtgcaaaccccagggttaaagaattagttatccaagatatggaggttgaaaatgtgtattttcaaaatgggaaagaagggtgggttttgtaccaggaaaaaaatgcacatgaaactaactgttagatttctaaaggtggagagtctccatcttctgttctgcctactctcgggagataaggcacaagtgctagcacatgtttgcatcatgtcttttatttcttggaagcattctcacatctctgtccccatcggctacctcatttccagcccctgcctgggaaggctgctgcccattatcatgtgttcattgtcttaacctgggcctttgctttcctgttttcctttttcatttgataataagcgtgtcctctcctctatccagacacatctcattctgctttgggagaaggtctcaacaaatagcaatctcatttgtcactagagcataaaatctgtctgcttcccttcccttctctaaccttttctgatttcaaaacaccctcatatcttttttggaaggataaggtttatgtggttttttttaagtattcagaattacctgctaaccctagacaaagggagcacatcaatggtgtttctgaaacaggctattatctccccgctggagcctcctactccatcctcccacccctctcctctcggcacaccccatcccggctcccccacccgcattgctccggctggcctgcaccccacagctgcctccagtctctggtcctgggtaccccatccccacttcctacttccccccatcccccgctgtgggagagaaggagctcttgttaacggccttatcctctgcaagagctagtaatgtcattctgctaccagctggcttaattttttaaagtcttttctgatttcagagatactcaactaagataggcttattatagaaaaacctaaaagtgtggttaaacaaaaagtcctcccccaccctattacccaaagatagcatattgttattatttcccctacatagatctagctctgcatgtgggttttcccggtcccacatggattaagccttttccagtttcccctcacatccttttgggcagtagtgacctcatctttcctgcttctctaggtttctccattggctcttagctgctcagggcttctgtgcagccaagtatacaaagatgagggtgaagccagcctagctaattctccaaatggctctcaaatgcctaggagagaagacctaggtcctgcccttcaatgcgtgactctggtggttggaccagggaagggtggcaccaggtgaggcagggcagggagtcagcccctggcatctgagtgtatgagggctctggagtagatgtgttgatcgtggcactggtgtcttttgtgttcctaatggccacgtatctcattggccacttgaagctgtcactggtgagttgggctagcagacaggtggaggggtacataagcagtgatccattttgggcagggtcattttggcctgtgtagctttatgccaaccagaagtgaactgaattagcaaacaccaagttttctggactcgtaatgcttagagttgcatcttctcatctatggcacatgcatctcccttagatgaggttctgattgtgtgaccctcccagtcctagagagcctggaacaattgctctctccaaactgcagagctcatgaaatcagtcgcatgaaggcagatcagaagggaacatacaagtcatcaaatctgcaccagcaattctcctttcaatgtttgcatttcctcactcccattggactcattctgaggttccccattcatgcttgaatgactcttatgatttaggtgataaatgatatctaggagcatttgggtagtactttataaagttacaaagcatctcacatccattctcggcctatatgagcctgagagctaggtgaagaaaggaccacaatgcactatcttgtcactgttttaagctgtttgattgtggctagtggaggaaacaggactcaagtcaggtcttctgactcccagtttggccttctttccctctcctctgctgaagacagaacattcttatttacaccgaactggagtttctctggagcttccacttgttagtgttggttctcctcttcagggccctagaaaataaatcttaatttcttttcttaatgcagtttggaatatttgatgatagccactgtgctctcttatgtcctttctccgaattaaacacttccagttccttaagccatttttccctgaatgaggggaatgagccttccctcattcaaggaatgctcctgttcaacgagcatgtattgagtgtctgctgtgtattgggtgcaggagttagtaaaggggtgagggagagcccagtcttcaaggagctcacggcctggggtaggcggggagtgaaaagcatcattcagtgttttgggttcagactctcactcagtccctctcttcccagtacatcctcttaccacggtgcccagttctccagtcctctcccaaaaagaaacttccagtcatctcctgggtgggagaggggagagccctaggatctgaggatctgaccactccagtgaccgctaaaccctgttttcagccacaggctatagctctgcttcaaggagtgggcccctgggcccttcagagccttgtcttctgtgtgcgtgtggttcttgggcccctactctgctttttctgaccagaaagttttttgttttttgttttgaaactcctgaactgttattttagcagttttagagtgtattcgcctctgtgtttaactagaagttcctcccgttctttccttccggtgcctgtactcctgcaaaatatagccttctccatcctatatttgtgcacttgcttgactttttaaaaatttagtttttgagtcaattacattcacataattcaatttattttttattttttatttttttatttttttagataaggtcttgctctgtcacccaggccagagtgcagagggtaccatcatagctcactgcagctttgaactcctggactcaagcgatcctcccacctcagcctcctgagtagctgggactacaggcacaggccaccatgcccgactaattttttttatttcatatttttgtagagatggagtctcactctgttgcccaggctggcaaaattttaaggtgcttaaaaagaatacattcaaaagtctcgctttcacttctttcctccttatcctccctcctataccctagaatttacaacttagaccagtttcttttatgttcttagagtgtttctgtatgtagatattagcaaatgtgaataagtatattttatctccccccttttaatgcaaaagttagcaaattctagactgttccatccatctccagcagtttgtccacatcagtgcatagagaacatcattctttgcagtgctcagccctccctcgtgtagatggacagcagtttacctaacccgtccttccaattttcgctatgacaacctgcagtgaatgccttcagatgcacataattttgtatgtgtgcaggtgtattgtaaagataaattgctctgaagtgtaattggtggtgttttgaggggtcagtagtttgagcccaagtataggaacctagattgcatgatgtttgtctaggaccattgtctggctggtgactcattctgaagcttgattttgtcaccagtcccatctgacattggatatgcatggactgagattgatttgccctctccctgcctccttccatttcttgggacctgggaggccatggtggccagtggggcccagtcagaagggccagagagggcttctgaaggcgacatcatacccggctgcggagggaagtgggtggcagagttccattgtgtcagccacttcactccctctggattttccagccctggctgctggaactttaaaatatttcctcctgtaggctctcaaaagtgcgacacaatggttgtcttttcacatttgtcatccttgagggttttttcaaagctgcaattaaggtgctctggcaaaggtagttgtgacagtaaagcagcagggagactgtgtcaccaccagccaccttgtcctgaactttggggcaagggagggcccctgcgagcctccctcctcctagcagatgatgacctaggactggcacacagtcacgctgcggaaacaggctccagagaggtcaggcggctgcctaaggttttgcagctgatgagtggtagagttgatttggcttctgggagaactaaataagttggttgttggcctctgggaaggattagtgatgtagcatacacgctgtcgtagttaggatacccccagccttacttcccttgctgcaaccttcccctgcacccccatgtggcagcttccccttgcatggcctagatctgatctttctgagatacctggcctctctctctcctcctcaccccctcctctctgtaccctcttcctcccctccactgcccagtgggcagttttaaacacaacagtgagcttttccaaaggtcaccattcactgttgctatttattctttccagtttgctgaaagtttgaaataggttgagaaagctaacaagcccctagattcccaggaggaagtgagatttcttaggctatctagagagctgtagccagaagccactgtttgtaacaggatatcagctaagtacctgtctggggctttgcggggaaggtggaggtgggcagggccacaccactcaccccacggcacctccatgagggcagtttctggtttgttaaaggctgagcccctggagtgggccgtcccgagcccatggggagctttgggtccaggggcctggaattagaagggctgccaaggccccagggcctgctctgagctctgcctgtttttggtcttccagtccgcagccgccacagccccaggtccctgagactccctgggcagatgagggcggctccgtttatcacctgaccgatgaagactttgaccagtttgtgaaggaacactcctctgtcctcgtcatgttccacgccccatgtgagtggaactttgctcctccccctccacaccctcccctctctcagagtaggatgagtgtggcgctttgcaatgtgaacccaggaagcacttattttttggatgccaggacccatgctaagccaggggatgcagtggtgacaggcgaggtccccaccctcgtagtgcacatggcctaccccccattgccatggaaacaacacagaagtcctgatcaggctttacttgtcccttagctagagctcagtgagtctccaccacccctagctctgagcatcttcctcccagtcagcatgaattggagaaattaagctggaagcaccctgagatgttacctagaacagactgggcctggaaataaaattagggctgatacctcatatgggggctcatacctataatcccagcactttgggaggtcaaggcaggaggattgtttaaggccaggagttcaagaccagcctgggccacatagcaagaccccatctctacaaacaattaaaaattagctgggcatgtggtgcacacttgtagtcccagctactcaggaggctgaggtgggaggattgcttgagcctgggaggttgaggctgcagtgaactgtgattgtgccactgcactccagcctgagtaaccaaacaagaccctgtctcattagccgggcgtggtggcgtgcacctataatcccagttacttgggaggctgaggcaggagaatcgcttgaacctgggaggtagaggttatagtaagccaagattgtgccactgcactccctcctgggcagcagagcgaggctccatctcaaaaaaaaagaccctgtctctaaaaacaattttttaatttaaaaaaaaaagatattatctagggcagtagtcacctcttaccttacaagtggtcgcgggctgaggccccaggagagcctgtgcttgcccaggagctgagagggcatggggaggccaggctggagctgcagatcatccagcatctagaatgccttctgtctgcttcacctcattgcattctcattctgaaatgaccacagtgaatcaaggaagtaaaatcctgtaaatgctatcaaacgtgcttgcgataagggctggaaggcctgtggcccaggagttttctggagcagtgtcttcctactcccatggagagtggaaaattgaccataggtggtttccaagagggacaaggctgcccctgggaaggcagacaaggccgcgtgagagccaggggatggcaggtgtgggcacagagtgttgtgagtaagagattgtggaggaaaagcaagaggtcagtgcctcatggagcagggctgaaatcgtgaggtcacagtgcatgaggatggttagtccatagaggcatattctatcaggaggaaatgttattactcctcttaatcatagggtcctcatgccaacagttgtgtgtcaccctacagtggtaacacattgtcttcctgaagggtcatcttttgttttacccagcgtgccacaaagtgagtacaattagccccattttacagatgagaccgtcacacagagaaatgacatagaccacccacggctccgtgagtcctgagctgcttcaggcctcaagagccttaggttccaggaagaacagggtcagagcctgagccccagtctcctggccgcctccccttcccccacagtatccatgagtttggctagcctgggaattgctcataaacatactcttaccatggattttcctaactcattatttcttacaagtgctaaattcttaggagactctaaaggaatagctctaaaggactctaaaggaatagctctaaaggaatagtttcctatagctcttctgagttcctagaaaagagaccaaaacaagcccccaaaactaagtttcaaaaaccctctagtcttgtgggcctctcctgatgaagcgcaatgaagggcgtctgcctcaggtctgctagggccttggtgagggcatccccgagggtaaaggtactcaaaaaagtgcccgccatgaggccagccaggtagcactgcagtgctcttcctagctataaaatacactccctggccagcctcagagctgctgctggaagcgagtcttgcaggaattgatgttgaatctagagccgaaatcaccatccttgcacccctgtcccagccgtgacagcagatactggctggctgtttccagttcctccttgggaacctccagggtcttcatccccatgtgtctgtccttccagttagggttgggagaggtcaccagtcccctgggcattcatggttgtgcgcatgtgggtttatttctgctgggctggcagagtgagagggatcagggcaaaagcatgtggttagcttcctgatatactgcccgtcaatgttcctgtcggatggtaatagctctggattaattccctttctacacacttcttcattaagagcatggtctttagcctagggagggatggaatgtacatgctttagggagtttggagctcaggacaggtgaactgagagcagagagctcatagctgcctggctttgtatctcatgccagagtgcttctgagaatccccagtgatcaagaaaccacttttgcagtgtttgagggacctggagtaaaggacaaatgtcaagaggccagagaccagcagtgtcatcctgcgtttcctaagtgcagaaagggtgaattctggaaatcacagtgttccaggtgtcagtcccaggccaaatacggagtgatttggagacagaccattttagagactcacagaaacaaattgggatccatcaacatagcagaccacagcttctactccagatcgctgaatgcgccgcttggtttgtttcttgggataggattgctgagcttgatgaattagcgtgtctttcttttatcaagacatttgacaaaatgagttgctgttttcctcactgtgatggggagaatcagacaggatggagctaccctgaggggaagcatcccctggatacattgtgactgtgaatctggcctgagtctgtctagagggtatgtacttgtttttaatcagcaactttgttaatgctataaaaaggcatactttcacatttggcagggttagccttgggaaaaggctgaccagctgaaatgtcagaccatgcattgacattttgaagtaccccaacaaaccgaaatagtggggctcaaactaaaaagctgatttattttttatgactctatgctaattataaaagtaatacatgtacattttatcaagggataatataggaaagtatagagaagaaaattaaaatgcttcctgatactgattcccagagaaaacctggtctttctttgcagtgttgtttgttttcttttcttttcttttccttttcttttcttttccttttcttttcttttccttttcttttctttctttttttgacatagagttttgctctgtcactcaggctggagtgcagtggcacaaacacagctcactgcagcctcgacctcctggacccaagtgatcctcccacctcagcctcctgtgtagttgggactacaggtgcacaccgccacacctggctaatttttaaattttttgtaaagacggggtctcactttgttgcccaggctggtctgctttgttgcttctatgcctgtagtaagtacccagtcaatgttagtttctttcccggtcctgcttagaaaggccaggaagggaaagggtcttcagctttcctctgacctgtgccaccccaggggggtgctctctggcacctgtgggttccagaggcaaggcacttgcttctctgcctggaactgatgggatgcttgtgaggctgccctgctgggctctcagcaggaaaggcacacggcacccctccccgttctgtgttacccatcaccgtaagtgatgactgacctggagacaccatgggccctgctcctttaccctcttcccagcactcctgccactcacttcccacctcatctgcccccatctccccattgtctttcttccctctctctcccagcaagagcccattagaaaccctccacagatacttcagtggcctctccaactgatgcctaagttgtcactaaataaatgagcccagggcagccacggtgctaggcccttcatatgggcgatctctattctgccacaggccacactgagatttacagccaggtttgccccacagccctgtcccccaggagctgggccgggcctcctgggcaggacaggccgagtgtgagcagagggctctgagaggggtgtgtctgtggtgctgcctggacccaaggccaggagccgcctctcttgctagcacttggcttcccgtttgtagcaaggcttcgtgcctgacctccctctggtcctcacagtggggcctcacatgcagccccaggcccggttttcccaccctgcaggcgacggagatgctctctgcaaatggtgtgtcaggaggacagtggctgctgccacccgtggcacctttttgtttgtgtttttctgcggcgttccatatgagagaagtcagagtgtgtgtggccactcatctcctcttgtcactgttttttgtccctctctagtaacttcaggtctgcattagcaggggaaggacaagctgctgtggcactacctgagtagacatcatttatatggggatgttcaggggagcaaggggggcatcccagagaggggtgttcctgagcagctcgtctctcctaggcctgtggacacccatgcaggttctggggatcctgaggaccccctgctcttcctctcccctgtgctacagggcttcttgggggccacgtggctctacccttgcctaccccctgactcatcgacccattttccttagcaacaggtctgagatgggatgttttctttgccatatcttgcctccagcatgtatctgcactgccttccaggagccgggctgtttctggcagcaggtccccatcagactcaagattttctgctgtcatctttttttttaagcttttaactgtatttttgtcttattctcaaagcaatatataacctttgtagaaaatctagaaggtatagtaaaatataggtgattaaggaaagaaactacctataatccccattatccagaggtaacaactttttttttttttttttttttttactttttggcatcattcttgctagtctttttcatttttttggtcttatttttaacttttattttttaaaagaggataccataaaatcgaccttttttttttttttaatcacatgtatagatttgtgtaactatcatgccacgaagggccttcatgctgtcattttattttattcatttatttatttctgttttttttcttttctttttttagagacagggtctcactatgttgctcaggctggcctcaaactcctgggcttaaatgatccttccacttcagcctcctgagtagctgggactacaggcacgggccaccacacctggctaattttttggatttctttttgtagaaatggagtctccctatgttgctcaggctggtcttgaactcctgggctcaagtgattctcctgcctcggcctcccaagcagctgggattataggcatgagccactgcacttggccacttgtattttctaattgcacaaataatttaagaataatattaacagcattcttgttatcagcagtgcaaggttcaagggatacataagaatatagtgcagacagtgaaaatccctcactctccacgccgtgccccttctcagggctggtcaccactcacagtagaggatggatccttccttctccttccgcagtgcttctacctaaacaacagggggttggttggctgggcatggtggctcacgcctgtaatcccagcactttgggaggccaaggcgggtggatcatgaggtcagaagttcgagaccagcctggccaagatggtgaaactctgtctctactaaaaatacaaaaattagcagagcatggtggtgcacgcctgtagtcccagctacttgggaggctgaggcaagagaattgcttgaacccgggaggcagaggttgcagtgagccgagatcatgccattgcactccagcctgggtgacaagacaaaaaaaaaaaaaaaaaaaaaaaagggggttgggttttttgtttttgttttttaacataagtaggactacttcctatccattcttctgtgatttgctttttttaacttgtcaataggtctcgaagatattttcatgtaaatgtagatattggcacataaatctacctcaatctttttaaccattgaatagtattttataatttggatatgccagaaattttaaaccattcccctactgataggtattgtatttatctccagtttttcactattcaaacaatacagtgagcattggtaaacatatataattgggaaaatgtgtaaatatttttgattaattcctaaaagtgaatttccttggccctggggtaagtaagcttgagctttggcagatgctaccaaattgccctacagaaaggttttcccaaacccagcgggtgacagagcctttgtccttgcagccatggatactatctgccttttatatttctgctaagctcggcaaaacagcaacttgtctgcagctatctgacctctagggaagctggacatcttttcatgtgataatcagcttttcatgtttcttccatggaccacctattcatacactttgctcatttttctgctaggtctttttatttatttgtctttttattcttgacctagaactctacaattatagatattaatctttatctgttttctgtgttttccatgttccattagtctatttcttgctctaattttgtttatggtgcctttcattgtacaaagctttacatcctttgtagctgagtaatagctattatatttattggtcactgatcacacttactatggatcaggcgttgttctaggtactttccatattttaacagatttagtcttcataaaaaattcgtgaatttgatgtcatgattaattattctcattttataagtaaggacggggagacaccaagaggtcaagaaacgtgccaaaggtcacatagccaaaaagtgcagccaggatgaaatcccaggctgtcccagaggccacagcctaaccactgagccattctgcaagtctgccttctcccatcctgacctctgggatttgtgggttgtttaggaaattctcccttaggatattaaaatagtgccctatattttgttataatgtttttattttttaatttctttctttaattcatctctatttttcatttgtctattgtgccaggtgggaggaagggatttgagacagggtctcactctgtcacccaggctggaatgcagtggcataatcatagctcactgcaatttcaaactcctgggttcaagtgatcctcctgcctcagcctcctaagtagctagtactacaggcacacactaccacgcctggctaattttttaaatttttatagcagtggagtctcactatgttgcccaagctggtctcaaactcctgacctcaagcaatcttcctgccttgacctcccaaagttctaggattataagcatgagccactgcatctggccctaattttatttatttaagtcttttctatgcatctttttcctttacatagtccccttaacattatcttgtaggtattttcatatgttattaaaaatgcttttttttgtacgtgctttttgtggccacataatattctgctgtagaatataatgacactgtaaattggttaactagcatcataatgttgaaggtttgagttgtttaccatatttcccattataaatcatgctgcaaagaacattttaatgcaaaaatatttgtctacatgtctgattatttccttaggataggaacctagaagtaaaattttaaaagcttgtttatccacattttgtgctaacataaaggaaaaaacaaactctttgcataagaagaggggtcatgtgatgaatagaggcatctgtgagtgtgtgagtctgccccaagatgcctgtaactgtcaaggagtccactttggtgcttatgcgtttggaagccttaaaagagctctgaggtctctgtaggcccctccacgcccgtatttctgctggcatttgtaggaaaccctccctccctggcatgccccaagccaaattccaagcaaggcaggaaccaggctcttctagaggcccaagtactaccccagtaccctggctaccagggagctttacagattaatctggtcctctgggaaattctggttccagcatccaggaaagccctatagctggcctgtagtaaaatcataagtataattgaatttaatgaaatccagacgaatccgagggctttgggttgacaggaagccaacattcccacagccagaaaagagcatgatcaaggagttgatgtgcagacctctatgccagatcacggaaatcggagtaagtgcacttacacagatgataaaagcccaacaaggaagtttagcaataaaacttaatggcctctcaaatcacaatcaggacacaaaatgcagtgggccggagtcccgctccctgcatgtaaccctcctcctccaactgtcccacagccagggacatcatgaaggccaggcccaggaggctggtcctcaggtcaccgccagctctatccatcacccacggctccccaagacaggagggtgtctggaagggaggtgttttctcagccagacctttctcctcctctgggcctggccaggctcctcatcttaaactctgtttgcagaagtttattgcttagccttagtgtcttattcagggtcagagggaattgatgctagaattgaaaaccttaacaatatcaagagaattctagggtatgtatgggaaactttagaacagcatccttagatgttagagattttgggagacacttttctcctagtgaggtgcagaggaggcgcaaagatggtagtggggaggagaggagaggggatgtgcatagtaactggcttggttgccagttctactaattagaggtgtttagtcaaattaacgactatttgagtgcaagccatgacccttgcccataaagaatttagtcctgccaaaccttgtgtgtacaggtgtaaacctaacaacctaacaagtcatgaggctaattcattcagaaagcgtgtggagcagcgtggtcagtatcaggaatatggtggccaattagacaagacagccgagcccctgcctgcacatacagagcctccattccagttgaggggatgggcagggaacaagtgagcagattactccagctgctttgagtacaattgagaaaataaaacaggatattgggagagggcatgatagcatgaggcgcctttgggataggtggtcagggagggtctcctagaaggtgaaatttgagtggaagcctgagtggctgatgtaaagaggggtaagccgcatacagacctgggggaagatgttggtatgtatgctccaggtgggtaggaaagaacatgttccagggccctggggtagaaatgaacttggtgtgttgggagaagaggagagccagaggctgcagtagaagtgacctgagttgaggttgaaggtaggcaggactcagcttgtgtggggtctgtagccataataagtttggatttgaatctacctgtgataggaagccactgtaaagttttaagcaaagggatctgatctgattgatgttttgaaaatataccccggctgcccttaaatatcagaagacagcaatatcacagtcacaaagcaacacaaaattaaatgccatagaaatatctgaataagaagtattttgtaattagaagagagacagatcattcgatggggctacagtgaactgggaagactcaaagcaggggccagaacaaaggtaggattgcgaggggttgtccagggtggatgttgcctatccatcagagcaggggctgggaggaagaggtggcaggtggtgatggccctgggggatttgtcacttcgtcttccagagctacaatttctggcactgtaaaacggacctactgagctgtgtcatgtgtctggtggggctgctgcgatagagtgtggaagcccagcacagacagcgagtgctttccttatagaggtggggaattctgggagctgaggccaaagcccaggagacagccatgtgtgcgagctgcggaaactggaggtctcctggtattgaccccagctggcttcccatgcctgtggcagacgttgcaagttggtcacagctcctcttcccagtgagcgagttctcagactcagcctctgtctcaggcccaccgctgatggaagctggcaggtggaatgaaacccacttgccaccctggcagggcagtggcatcaaaggcctggagcctgataaagggatgaagtaaacctccctaccagcacacagtgaattctcatcttcaggagtcctgccacatcaacagggtcactttagaaagcaacagtgattctcagtgaatggcaatggctggcttttctttgtcttccctcccctgattcctactccagtcccactgtccatcttgaccatgggccctgccagcagctggcctaacagcaccatccatatcatggagggtatggggagagtggtcaagggagcctctctttcctgcctctcccacctccctggaggccacccagggcctcatgcctgcatttcccgaggcctcccagtgtgtcctccactatgtgctgctgggctgagtcagtctgtctcagggcagtggacctttggggactttgcatggaccactcacatctctccagagcaggttgaactctcgggcgatagactcaccgccacaggagagtctctgagcttccttctcctgcagtttgttcatgcagggtgagccccctcactctgccccagtcaggggaggtcagcctgaaagcaggagagtggggggctcaccttggacaggtgcagggagcagcagcttggggttgcccccggggcagggagatccctttaagagctgtagaactttttcatcctgaccgtggccccaaaggatggtttactccactctattttagtgagaagcaaaaaaataattttttaatcttaatatacctcatattaagtcagtagaaccttctgcagattattccatttactcctgacatgtgggccagtgtggaaagacatctaagcctgggcccctgtgcatcagctctccgtgttcttccgctttgcctcccattggacagtgattggcttggagtccggtggtctcctttgtcctgggctcctaaccccagttctgtgagcaagttcaggtagtccaggatccctctggaattgtacatacatgtggagtatatgcatcagtgtggggaaggggaggagaggcttttgtgacaatctcaagaatgtcagtgcctgggaggcacagactcctgccccagctctccctggtccctcttggagttcttcctctcactgctgaggtgggggtcgctgcctagagggagcggcctgcctgctgtccccactggatcgcgggctgcacttgtcccattgggagcaggctcagggaaatacaaatagcactgcgtgcttttatgtttcaggtgcatcctattaaatgggcttttgcggttgcccctgggaatctgcatgtaatcggtgtgtaaaattgtttctgaggggaaaacaaacagccaacttaccaaaacaacccttttgtgactggattatttaggtaacacatggctcatgatgatgctaaatgttcatttctggaaagtgatattcttgtcattcaaaataatgatgaccttgatacctctacagcttatgatggggggatcccaagtggggtctagtcagaccgtgaactcccaaagtcatctaaccctatgtgcatttttctggaagaagggtttaccactttgatcatgatctccacaatgtctgactgcaggggacattaagaatatctgctgtggagaacaaggccaggaacagccaggctgtcttgcccagcccaggggcagcctctgggggggccgagctcagcagtcccagaggagcccttaggagcacttttggggctatgtgccttgctcagccctggcagcggaattctgcactgctgaattgagcatggggacgtcctcatttctctgaggctgcccctgccctcctgactgggtcctctgtcctctgtctctaacttgcccacatgtgtcctttcatctgccacctccaggaggtcttctcaagcccctggtcaacccaggagttgtctactaattatttaattaggtctcttcattgctgaccagtaaatatttatcatgtatctattaaatggtgatccttttgcttcatggggaggtacaaggtaaaaaaaaacctcaggtcccacctttagagagtcaccatctggggctgggcatggtggctcacacctgtaatctcagcactttgggaggccaaggtgggtggatcacaggtcaggagatcgagaccatcctggctaacacagtgaaaccccatctctactaaaaatacaaaaaattagctgggcgtggtggcacatgcctgtagtcccagctactcgggaggctgaggcaggggaatcacttgaacccaggaggcggaggttgcagtgagctgacatcgtgtgccactgtactccagcctgggtgacagagcgagactccatctcaaaaaaaaaaaaaaaaaagagaggcactgtctggtacctagagcccagcatgatgagtgtgtagtgtgggtacaatatgtaatagggctacaagcagctgccggctcccctggggctgccagggcaggtggagtgctcttcctctggttcatcccttgaaggcatcatgtgtgccactctattcccctctggaccaaagaccatggtcctctctgtcattatgctggaagattctaagggctgatgccttttctaccctttcttctgcatcatagcccaacaggagtaggcagctccctagataatggcagcagaggtgcctgtatacccagcagttcctcctcttcttgttgtggagcctcccacttgagggttagcagtgtctctcttccttggatccacctgggaagagctgacatgttgatgtggctaagcactgtagccactccctgggctgcattccatgagggtcagtgcccttgaccgagtcatgtctccagtgctctgtccagaggaggagcttcacaacactgcctgggagctcaaggatcagtttggttttctgttatcagttaagtggggagtagccactccggggtcccttgtccctgggagggacagggtgaggatgagctgaggaagccaggtacaggcaggagtgaaatggagagattaagaacgagacaggttcatgtctcacctggagctgagttctgcagaaatggccttggaggaggagacaggagctttcacccctgccgggtgctcagctggaggcaggaaagccgattccgtagctcagtgggaggtctcctctgattacactgtttgactttctgtcttgctttcttcttgtctttctttttcctaacaatcagtagtagaattatagcgttctcagctcccacacagtggcacacccctgagaaggttgagtcacgacctgtcatccgctgatcctagttaatgcatggtccccgcacagccaggcttaccttctgagcagcctccatcctgagccagtctgcagacccctcacctcccagtccctccagcatcagaggccagaaagtactctttctattaaaatgaaaacaatgtacaaatgtcaaggtctgtcatttacacaaagtgcttaatttctttttaatgcatcaaattttattatttctgacatcttactgtgttcatgcagctgtaagaaaagcacagagcaggctgggcgcggtggctcacgcctgtaatcccagcactttgggaggccgaggtgggtggatcacgaggtcaggagatcgagaccatcctggctaacacagtgaaaccccatctctattgaaaaagtacaaaaaaaattagccgggcgtggtggcgggtgcctgtagtcccagctacgtgggaggctgaagcaggagaatggcatgaacccaggaggcggagcttgcggtaagcagagatggcgccactgcactccagcctgggagacagagcaagactctatctcaaaacaaaaaaaaaagaaagaaaaggacagagcagtttctatcccaaaaaattcccatcatgtcatatggggacaattagaatgtaattatgtcccatacttatgcttctgtgaatttttgtgcccagctcaaggcctcagactgccttctgtccagagaagatgatgatggtgatcacagcatggtgccacaacctacacgctgcctgcagctagggcctctcaccagatggttgggttttcaacccagctctgtgaccatggctgtgtatatggccttgggcagtcacctgccctcttggtgcctcaattgtctaatccatagaatggagataatgtcagttcctactttgtggggtagttatgaggctgtaaggcactggtcagtacctggcacaccagttgcccgtattatttatgcagttgttttatttttgtgtctggggtaccttcccactaccccaacccacttctggtggattatgcaaaatatttcttttctttgagctggtgctgctgctgcttttctcaggtgtctgggaatgggactgagctgccttacagaggcggcgcaggggagcatcccgagggcctctgtgccataagaatggtttctcttgatctctccccacagggtgtggccactgtaagaaaatgaagccggagtttgagaaggcagcagaagccctccatggagaagcggatgtaagcttcctttccttccccctcaccgttctctttgaaagaatcactgacaggtggaatcattatgactttcccctgcaagccctgctgcagctcccgtggtccgtggaggccagcagtacctctgtgtgcccaagtagaacatcttagacagatgggatcctagagggggcagaaagactactggcccatgttcccgtgcccatccaggtgacctctgcctgctccctcttttctctgggaccctggctaacaggaacaggtgccaatctactcaacgtggctggtggggcagattcaaaagcctcatctcagctcataaatgagaaatgatggccgtgccaatgttcagttgttccctgggatatgggagcccactgggctagccaccccagttaaattccagcaggtccaggatgggttgtgggggcagcgtctgggctcctgtgttccaccagcaccgcatctgaggctgtaatgcatggttggcctttcccccatcccagagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaagtaagtgttacgatctcagtagcacatcctaactgccagctggcggcccctggagaccaccttgaggaggtgaagtaaactttatggtcaatgtcctgggctcatgcccgtaggagtcaagacggatctgacttcctcaaccctaaaaccaccgttcatatgctgatcacgtgtcttgatcaggtcactgctggcagtccttctggacgcagcttcatcgacgcactaaaccgtgtgttgctttttctctgtctcagcctccttaggcccagatcttattgtctgcattttattccactccctttgaataaatgaaggagacacagctcttcatagccagagctagactcatttcgtccaggtttgctagtggttggctgggcctccagtaatgtccacagggcaggctatggtggtttgcaactgaggataaagattttgaagagccccctcagcctatgtattagtttgctagtgttgccataaccaagtaacagaccaggtggctcaacaatataatataacaatataacagaagtttattttcttacaattttgttttgttttgttttgttttgagacagtctcacttagtcacccaggctggaggcatgatctcggctcactgcaacctccacctcccaggttcaagcgattctcctgcctcagcctcccaggtagctgggattacaggcacatgccaccatgcctggctaattttttgtatttttagtagagacggggtttcaccatgttgcccaggctggtctcgaactcctgagctcaagtgatccacccgcctcagcctcccaaagtgctaggattacaggcgtgaaccaccatgtgcagcctattttcttacaattttggaggctagaagtcagagatcaagatgttggcagggttggtttcttctgaggcccctccccttggccatcttctgcctgtgacttcccatggccacccctctatatgtatctgtgacctaatctgctcttcttataaggacaccagtcatgttggatgagagcccaccctaatgacctcatcttaactgaattatccctttaaagggataatttatctctagatatagtcacattctgagataatgggggttaggacatcaacatatgaattagagggggacacagttgaacctatacggtctgagctactttgttaggacatcagtcagatatgaggtgtttatttaaagcatagactctgagactcttttattcaggaagtgtgaatgggaccctcagccatggtgttctaagcaacaccagcttgtggaatggcagcaaagttgccactagattcaggggaggcctctggcaagagatgaatggactgatgagatcctggcctcagcttctcccactttgtcctgctcatccactgggaggatttggaaagtagctaggcctttgtcttagggaccagaggaaaatgatggtttgcctctgaaaggcacaaggtgcttgcttacccctcaaggccttctggtgtctgaagtaagtggcttgttcacacccacttttccagccttgctctggtgccagggctggttcactggaaaggactgggtggggcgggggatctggccaggtccctgtgatgcttggacttctggttagagagccgagggaatccagagtgtcgatcatcactaatcagtgctccagagtcttggccacaaacagcgagcatgaggggcctctgtcctttctgtgtgccactgctgctactgagagcctgaaaagcactcaggctaagtgctttcaggtttaaatactttcttaagtgcttttaggtcaagagcatgggctttggagtctgagagacctgggctgagatcgtgaccctgagccatttctttgatgcctctaagccccagtttcctatctgtaagatggagacagtaatttccccatagacttgtctagggaattaaatgagactcctgtgaaaagtgctcagcacaggacatgatgtggaagtactcaaaaaagttgaaactggccgggcacggtggctcatggctgtaatcctagcactttgggaagtagaggcaggaggatctcttgagttcaggagttcaagaccagcctgggcaacatagtgagaccccacctctaccgaaaatcaaaaaaattacctgggcatggtggtgtgcgcctatagtcccagcactttgggaatctgaggtgggaggattgcttgaagccgggaggttgaggctacagtgagctgggatggtgccattgtactccagcctcagcaacagagtgagaccctgtcttaaaaaaaaaaaaaaggttgaagctatttttatgactgattgtggacttctcatgactgacagtatcaatacataagtgatcacagcagccagcctttgcagaatgctctcctatctcttgctccatttcatcctcaagtcctgctgaggccagagtttttaattcctatttcattggtgaagaaacttaggttcagagaggttaagggccctatccagggacaaatagtagttcttccgggaacttggaggggatccttcaggtggagtgtgaacagccgatggctcgggggtggagaactgagactcgtcacccagaagcagggcgagcagacagcgccagaaaaggtggatggcatttacaggcaggtgcataggctgccaggctgtgggtaactgagatgcgcctgccagcaggccagcctggggaggcagtgttcagggaaaaggcagagcagaaaggtcagatgagtggtgtcagccatggaaccagagaagctggaggacaaagacagggaggaaggctgggaggggcccgtcttagtcaccagcacaggagaaggtgagaggcagggagactgatttgggaggaggagggaagagtaatgtgttctaagtcatggtggatttgaggttacaatgggacttccagctggaaatgcctgaaaaacacctggaaataaggagcttggatgagaggtgaggccttaagttcttctcagccatggaaatcactggagccatgcagaggaatgagatctttgagaattgcaagggctcagaatagaactggaagcacagagagggctgcactcagctggtgcaggggctgtggcacaagcccagtgggagacgtggcagcgtgggtgtagccctctccccagaaatactcccaagaaggggagctgagttatagagagggaagcaggggagcaaaagctattgcaagaccctggagatccatccttgcatgaggcagagtggagggacccagtggacagcaagagactgagaagcaataacatttatccaatgcctggcatttattagagcatctaggctctcagtaaatattagttccttgactgagtagatgcttttcatacattctctgctcttcataaagatcccattgtcctcatttaacagaaaagaaaacggaggctcagaggggtttagtaacttacctaaggttgcacagctggtaagtcatctggacttgaacccaggcccgcctcactccttggcccatgctctccaccagaacagaagctgagaaccagaagataatgaacgatcatgtagggtcctagagggggcagaaaggaggggcctgggagtccaagcagaggtgcctctatgctcttgtcaaggagttcgtggcccacaactgggggggctgccctgacctgaaatggtgtcaagtcttccatattttacaaaatggctccttaatgggctcctcagagggaatcagggaaggtctttgctggtggcacagatttgtttgtgtttaaactgtggttttaaaatgaaattttagaaggattgtagtggtttcttcatgcatgttcccccgagtggttgggacattgagggtggatttccttgcccatctaaaaatctctccttatggctgcctccccactcccctggcttcttgcagccctgaggcccccccgcccccagagcccacgtgggaagagcagcagacaagcgtgttgcacctggtgggggacaacttccgggagaccctgaagaagaagaaacacaccttggtcatgttctacgccccttgtaagtagcttgggtgctcactgagtggcacagtaagaggggtttggccccaccaaaccaaaaagacccgcacacccaccccagggaccaaggcagccgctgatggatcccagggtcatctccattatgaaccaggctctccaattttattccaggctaagaggtccttcaaatccagggcctccttttgtcagactcgtcgggctctccttcctttggggcagcctttctcgtgtctgtcctaaagccctctgcctctgtgctcgtcccctcttgtccctgggctcctccatgcccctgtcccctacctgcacacttcccacccctcagctgtccccgccccctcttccttctccagacactgacttatcttcagcaccttggaaccccctctccctgcccttccagatggctctggagccgtggcataggcacagccacattcgctcctgagctcctgtgctgtgctcgttttaatcagagctcaagctgaggaagtgacacgtctgccgacattggcatcggtgacctcaggtttctgtgtattcccattttgaagttgttaattgatacttacaatgaaaggttcttagaatttcccactctctgctgcccttctctctctcccccaggttacagctcagcttaatggagtgaggataataaaagctgcagtctacagagaagccaggcagctccatctagccataaacctgctcagttgtagctggccctcctgttggctcccccgtccccacctttcaagtgtcagtaatccgtggagtctgtgtgttctcagggtctgagaggggccgccacagcctcagcccctccttgaggcagcctccctgcccatctctttctgcctttccttctcagagtgggacttgtcctctcccagtcccttacagagcttccggctgtcctcttcggtctgtagagtgtgcccagaagcctgaaaattttcgggagctgacatcttccctctggcattagggggtggaggactgagccttgcccaaggccatggggcaagttagtggcaggcccctcccgcagcctggatggctctctctatgtcacaggcacagtccagagagtgagagtgttttcagcagcaagtgagaacctggctgcaggagtggaagcccttgaccagacgaaatactttcccccagacctctggaccagagcccagtgcttcctctgcctctcttcagctcctccctgactgaggggccttcatagcagacataagccccccgccaccctgaccctggctgctgggaccgacaggtgcttgaatccccagggaatctgggagagactcttacccttttgggctgccaaagatctacaactccttccttcctgcctgcctgcctgcctgcctgcctgcctgcctgcctgcctgcctggcctgccttcctgcctgcctgccttcctgcctgcctgcctgcctgccttcctgcctgcctgccttccttcctgccctccttccttcctgcccgccttcctgcctgccttccttcctgcctgccttccttcctgccttccttccttcctgccttccttcctgcctgccttccttcctgcctgccttccttcctgccttccttcctgccttcctgccttccttccttccttccttcctgccttccttcctgcctgccttccttcctgcctgccttccttcctgcctgcctttcttcctgccttccttcctgccttcctgccttccttccttccttccttccttcctgccttccttcctgcctgccttcctttctgccttccagcctgcctgccttcccgcctgccttcccacctgtcttccacctacccatcaaatatcagctctgtgctgtgcagtgtctagggcccagggtacaagggagggagacatgtccctgccaggccttgaggggctcactgtctaccctgacaaaattctaaacacaatccatccagggcagggtcactgagtgactcaacctctggcagagggcttggtccttagagtttcttcatttctgttactgcgtttttctgtccctaaaccttgccccagggacatacatctttatcagtgggttacagggggaagactttccaaggacaaaaaagatacatcttttgactttttaataatgaaaataataatacctatttttatatataaatatggcatatactatatactttttatatatgaaggatctaaacactacagaaatgtcaaatagtaaagtcaaatgcctgatagaggtctaaaggaaaagcagcatacccacacgttcctgctccccttctagctgcctcaccccaacatcttacctcccctcacatctctccacctcccacatcccttctcccaccatgtctgcccctgcatcctgtctccccagcttctgcacagctcttcctcctgctgtttcattgttccttttacgctgaatggtctggtcatggtgactgcccttctcaggccagcttggcggagtctctagaactgcaattgtccagcctgtcctcagtctttgttcctctttccccactctgggaggcgtctttggttttctgctacacagaggcagtgccttttttttttttttaagcctacattaaataaaaaaaatcatccacatctggccctcctgacacctcttggaagcatcttcatgcactttctgaaacagccctccctcccattactcattggccccactctttctttcggataatgagaaaattagatgcaacagaaagccattaatctgaggcctagatattttaaattgatggtaacaggaatttacactaggctgacagttacctttagactttcaatgaacaaagaggttaaaaaggaaaaattaatagtgaaaccaggttttgaggaaggggggtggttattttcgccagcctaatgctattatgggcataggccacacacaaggggcctgcagctgcctgcaggagctgtctgtgacataccttgttaaccagtagattgcgctctttaagtgttttgaaaattttataacatcatccctttatagtgtgacattttcatgaatttgagctatttttctttctgttatgtcaaattagtgaagtgttacttgtaatttccattttaggctattaaaaaatcatccagtctctgccatgagctaggctgtgctaggcacattgctaagctgtgcttgtctcatttctgatataacccatcactggcccaggtctcttctgctccttctgcatgagacttggcaaagccctctacacccccaccccccatcaccccccacaatgctctgggccagctggccactctgccagccaggccatgtgggtggtcctgctcatctcaagactggctcaaggactaaattcagattaaacttgtagcttagccttaatttggtttcacaaaaccctttgaaatgccagtcattattatcttattttaaaaaggagaaagtagatgagcaaagccgtttctgttcccaccgtggcatctctgccttcccgaggctgagggaggctggctgacgtagaggtgtgggctggagcctccccttgctcagggaaaccctcccctcagagcccttctgtgccctggacagttctgttcaccagtgactgggaaagggctgagagaggaggggggtttgggttctgatctgttagtgctgagggaagggctggatcagcctgcagctcctgggctcaccaggacaggaggagaaagtggcccccacagaggtccctaccctgcttctgagacactgaggtcagagttggggctcagggtgatgcccagaacaagagacagatgctggaggtaggggccccagtatagctcaaaggccttaggctgctctgacaagccttctccctgggacagggagcatcaagggacctgaggactgcctggtgacttcccgtagctcctctccctcttaccctgaccatggccttcctgttcctggctttgaggttctggttattgtagagcaaagagtagatggagacctggggaccagggcctgatttggctgctcacagtctgggctgggtggaggttgctaggaatgcagaagttagcagcaaatcatgagcagtgggtgcagagtagttgccccaaaatccccccaccctgcatttcccaacgccacttcctctcagtcaggaaatggagagatttgctattgtccctggagcaagagaagattgtagcggctctgagaatcccgtgccttcctctttaagcccaaagctccctctgcccccaagatcaggctgttcctcgtcctctgtggaaggagcagaactagactacagtgaccatcgccccccagcctgggcaggagcatatgatgcttgtgacagggactcctaccagtcccccctaccaatagatcagacatgggtgggaggtggttagagtggcaaggttgacaaaaggaccctgacagtgtggcgggcagtggggagctcctggagagccctctctggagctttcaggaagggtccctggccctgcagcctccctgcacatgcatcacagtcctgtgtgctctcttcccctctcacacagggtgcccacactgtaagaaggtcattccgcactttactgctactgctgatgccttcaaagatgaccgaaaggtaaggacagcgctcttcatctcttgatctgcctgcagctaattcctacaccttccttcttgtcattcaggtccttccccaaacaggggcaggtctgctaagacctgtaagcaggaaattccttgggaaccaggacattctctttagaaggaagatagggcaggctggatttatgctgcaaaatcaactaaaagggatatgctgaaccattccagcacttacttggaggagagggatggttaaaggggtcatctatttacttttttagtgtttgaacctttttactgtaggattgtcatcatgcattacttatataattaaaaatacaaatttaaaaatccaacaaaagtcaactggaggatgccatggtggaggagagcaaggccatgtcagtggagcctcgccctgcctaagtgaaaggctcctgcagctgccgactgatgaagcataaaattaacaagctagagctgcagattggattagagtgcagggcctccaggcgcgtcccccaggcacatcccccaggcagctggtgcagtgggggcttctgctgggagagggcttgtggggcagggaaatacccctgaattcggggaagtgtgattgactgccagcctttgagttcccttctcatccatgccaggcggagcactggtgcagaggactgcaaacattcctcccagccctgagactcagtcatgggaacctctggcctaacaggccctagaagctggcagtcacgtgggatctgcattcacacacacccaaacccagagtcacgtgcaggggtgccttactttcctgggtggaatcccaggtggggccagggcaggctggaaggaaccaaggccaggcataagctgagcatagagtcctagatgataaacaggccaagcaggcctagacggaagttcagccgaggcaggaaaggggagcaggtattagtggagcagccctcacaagcagagacagatgaccatcccagggccgggtgggcagggtttgaagttttgatcaaggccaacaggaggtcaggcctaaaggtaccatccagaccttgtgggagcagagatacaggtgctaggatcaccttaacaggcccagagacagtggcagagatggggtaatgagaactttacagggacataaagccaaaggaagccaggctggggacaggcccatgcaggcagagtggggatgaactgggaacctgattctcacttagacccagagcccaggactctctctggagtcaggaggtcccattgttacccgaaagccctggctgcggctttgaggcacccctcacccccaccagaagggagtacaaggaccagaagcgttttctcctctgcctgcccctttccctgcactgagtggggtatggcagcaggggcttccttcccgtgtccatgtccctcattgttcccacccacttgtgcacagcacagggtagttgctcctgcttggtggtcccacgatatccagcatggcctgggctgccagtccacaggaccggaatagctgccactctgtattgacgtccatcacgtgccacccagaatgctgggtgctctgggcagcaggagaaaggctgaggtgtgccatctccctgtcccactggacactcaggtctccataggccccaggagatctgtgagggtcctgaggcatgactggcagacagatcctgggcttgccctcccagccatgctggggagcatggtgtcagggagcgtggtccagctgaggcaccgagggggctggggaaaccctgaaggggcagccccattgacgtggcccctttctgcccactagaccgccgctgaggctgtcctgtggcctgacccacatcagtgcaggtgaggccagacttgccaggcctccagcgggcagctgagagcccacgtcttctcttcccattccccctgcactgctacatgggggcccatttccttgatgctcccctccgcttagacactgacacacctttgcttgattgtcttgggccagtggtgttgtggccttttcctgggttcagtcctcctgtctcttattccctctgtctctcctttcagcttcctttattccaagccagggatcaccctcacttgcattcaggaatgcacttcataacctctctgtctgaggcaggtggcctgcctgggtttcctggaggttatattcatgacatcagggaagccagccatctggcctggggggctgaacttactggtgcccactctgtgctccaggcatggcactgtgactactgggtcccatcctacaactatcagatcagagtctctgggggatggtgctggaaatttgtggtttttaagagctggctcttgtgctggccacaggctggtgtgtggggactgttggcctgtcccctctccctttactcgtgagggatccaggcccagagaggagctgtgtcccttgttcaggaatgcccagcgggtcactgacagccagaactgggtctcctgacaccccaagctgccacttcttagctggaattgtggggtttttccacccagaagccagcccctgttcctatcccaatcaatatgcagttggttgttcacttccattttcatagccaaagtcaatattagctcctgcagagatttattttactgaatcaataaagctgtgtgtggcagctcatattttagcaggggagcctccaccccctcccgggagcttacttggggactttatcggttggcacactggtggggaaaggaatgcaaagtgttagtgttggaacagatggtgttattgaaggggcaaggcagacaggacctgtggtgggctggcaagcaggtggggggctcacctttcactgcacgtcaaggtgtgcaggctgggggtggtgtggggccaggtgtgaaggtcacccttagagggaggccctgaggcagtgggggccccacctctgccatgggcccacttcactgctggaatctggccatgacatgtaggtcctcctgtttatgaggctggctactgccttttccaagtgaaagctccctcaggacagagacctcatttgtccttgaactccccacagtcatgacaccttagacctgtgtaaatgttgactaggtgaaggaacaatataacatatttgatatttactgcgagctcttcttccactgaaagcatttcttacatcatgttgtccttacaatagcttgctcaactaggtattgttacagtgctcatattgctgaagaggtgattgaatcttagagagatcatatgctagtttctcagctggagaggggcagagtgagaatcgcaaacaggcattgtcagagtttgagttctcccagaagcagaccctgctcctgggctcatgtgcagggaatttatttgggaagtgatctcaggaagttcagagaggaccctggaagtgagacacgaaaggggaggaaccaaagcaggtgttttatgggcagatgactggatgagtcaccaaggctcagtcccacaggagacctcaccaggaaacgtgacacagagctgttccactcaaaggccaaagaagccagggtccttgttctagacccccatctgtcattggccttacgtccagctccttgaggctgggaggatgctctgaggctgagagtagcaggtgctgtggcaagggctggtctgaggggatgtggcaggacaccagcagcgtgtgccccaggatttgtaccaaccaccatagaacaaattgagaaatcgtaggtgttctgtgttgcaggtgatcagtgcaaatcttgagttgggtgtaaggggacaggcatttaggtgaaatttcaatagctgagaagagctttattcgctgccttctttccaaagagtctaagctgctgcctttggggaggacgcatttgtctcttcttctgtggaaaacgcgcgtggattcacctttgcagctagaagttgcattccatgtgtgcggctggcagctagtttaggtgattcagaacaagtatacatttctaatttagtagatttataaaaccatacactatatttccaatagctccagggcattgtatacaaattaaattcataatttaaagcagatgcagggagagcagcagcccagagccatgttcatccagcactttcatggcggagcagcagctcctggcccgggctgggcatggggcctcagcctctggctgcagggaaggaaagtatgtggatgcccgtgtccctgggcagggccccatagcacctgccctgagaaatggaaccccacaatttggccaggggagcatctgcctcatgtttttaaataataaagtgcgttagaggtgggctgcggttatcagaagtgcataggggccagtctgctggcctgggtgaactgggctccagggggtgctggggaaggtatgtttagcctacctgaaggacagctgcctctctgcccagccagttgtcacctgtgagactgcagggtaagtgccatcaagtcttctgacttttaaagagaagctggaaagccaaattgttgtattaaatcttctggctccatttctatgttggagctaattcagatttattttttttgttgttgttaaattcaatgtgggccaaatagaagaggactgagagccagatacagattgcaggcagcaagtttgtaaactccattttaaaagtctcaccgtatagaatgttacatagctgaagagtagaagggaagcgtgagggtgaggggggtgaaggtggcacctggtggccaggggaggccgcacctcactcttctcttcagctatccatctggcagctcacctgggcatgagggacatgatgagtaaacgtggccatgggggcccacaggattctcctacctggaaaggggctttgtccaaatgcaaataaccatcaaccaaagaactgtgtgaatcatggttattcaataattttaaattatcttattgaatcaccctcttttaatttcttccaagcattcattgagctctatctaaaatgatctaatttgtcatacagcagacgcttgataactggactttgtcaaggtcgacgttgtcccccagcatctagaacaggcttggcacacggcagggtttcagtgtgtgttgcctggtaggaggactcattctcatgggaatctgccccatcttccataacacctctgtactgggtatggccattgaggaccccttctcgggcttccctggtgcatgaccctcaaccggaaacaagttccccatttctgctttatactgtcttcctttgaaaaaacaacaaatgatgaggaaaagctacccagcatgtggaatttgctagatggtcaagaagaggccagtggccaatgtgggaaccactttctgaccaaacattctgatggctttactcatgcggggctcctccagtttccagatgtgcttccctggtctcctcctcttccagtcttggctcagatggcgaatcatacagagcgcctttgccccactcacctggcacctggaccacctccctcatccctcacatcacatcatgttggaattgtccctttatccaacccctgcccagacactgagcccctaagtggggacagagcttgtatatggggttggaagaagtgactgtaatagcagctgacatttcctgaccatgaatctggtgccaggttctgtgctcactggcctcactggaattctcttattcagtcttcacaatatcctgatagcctagatactattattatccccattttacagctgaaaaaaatgaggcaccaagaggctgagttattttccttaagtcttactgtccaggcaaaccaagagtgcacttggggaacttgacttgaaagctcttgcccttaaccttggcactatactgtccccccaagctaatgttccggaaatattagtggagaaatgattaaatcctacagtcccttacagatagcaccacagaacctgtggtgtttacaaatgctttcaagtcatcatttcctttacgatcatcatactcttgattttaaaggacagtctaaaggcactccaggccgagtcccctaaccttacccatctggaaattgaaaacaagcaccatcagtctccaaggagtcctgagctgggggtgctttggttcagttcctacctgccactgaggagaaaaatcagagtgggcctgtgacgtggactagatgtgcaatctgtgttgtggggtccaggcctcagcctggggacaccctgtgccaactctctttaccttggctcctagattgcctgtgccgctgttgactgtgtcaaagacaagaaccaagacctgtgccagcaggaggcggtcaagggctaccccactttccactactaccactatgggaagttcgcagaaaagtatgacagcgaccgcacagtaagtgggggagaggcgtctgcccagagctctctctctgctgatgggcagggaaacttccactgaggaggggcagcactgggcagcatcccagaaactgcagaagtcagctggaacactgcaccgagaggcccaggccctgggcctggctgaggcttgacattgttggaggagagtcccaaggggttgccacagatgtcctgtccccagaggcaggctggactccagatgccgagggttttctcacttgctggtcggggctggtgcaagccacgcagaccctctccaccttgcagaagtctgcccacctctccctgtcataggagtgaccccctggaggggctgggggtgtggggagagagagtgcacagccagctcagggattaaagctctttctctctctctctctcccacttccctgcaggaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattt

SEQ ID NO: 36495 - DNA, 22226 bp, Homo sapiens
gtggggacgcaggatggcggcagcagtgccggtgggtgtgcgtggatgggggcggggggcgtcgccgcggggcgctagggcccgggtccctgaggcctgagagaggcgaagtggggcccttctgggcgggcgaccagactgactcccgccccacttgctcgcgcaggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggtaagtggctggccagggcggcctcgcatctccacccccgggcggatgcggtgggggaatcatattaccgagggtctgcggttcatggtcccccgctaacggactgtggtgacccacctggcgtgagctcccacctatgtcagagatggaatcagtggcatagcgctttacacgccaaccaaaggggtccacctgcggagaggggcctagctttgaacgcaccggatgctgtatttcattgattctttgtcacagtcccccagtctgggacacgttaatatccccattttacagcgtggcccggagggactcagtattttgcacgatgctatgtagtaggtagcagatttggaattggaacccaaaactatccgaatacccatgcttttatttatttatttatttaccttttttttttttttttttgagacggagtctcactttgtcgccaggctggcaagctggagtgtagtggcgtgatctctgctcactgcaatctctgcctcccaggttcaagcgattctcctgcctcagcctcccgagtagctgggactacaggcgcgcgccaccacacccagctaatttttgtatttttagtggggactgggtttcaccacgttggccaggatggtctcgatctcttgacctcgtgatcctcccgccttggcctccaaagtgctggggattactggcgtgagccaccgcacccggcctttgcttttaacctttaagccagtgtgtttactgaagagctgccctggggacaggggaggtccttaaaattgcagttcctggaccccatcccagccttactaaaccaaactctgggatgaagcagaaagtctacattttttaacaggcgttttgggagctttttacacaaatatagtgtagtgtggtagtttgggaaacactgcataatgctatatgctaatcctatcttggacgtaaagaacctgaattaatcattggcaataggacattgaactaattacttagttgttctgagcctctgcttttgaaaactgtcagtgggaatattagtatctacttcccacggttgttatgagatgcagataaagaatttcaggccgggtgcagtggcttatgcctgtaatcccagtactttgggaggctgaggtgggcagatcactagaggtcaggagttcgagaccagcttagccaatatggcgaaaacagtctctactgaaaatacaaaaattagccaggcgtggtggcaggcgcctgtagtcccagctcctcgggaggctgaagcaggagaattgcttgaacccaggaggcagaggttgcagtgagctgagatctcaccactgcactccagcctgagtaacagaacgagactccatctcaaaaaaaaaagaaaaaagaatttccaagtgctgtgtaagtgtcctgcaactgctgttcagtgacttaaaaggtcttgctaggctgggcacagtggctcacgcctgtaatcccagcactttgggaggccgaggcaggtggatcacctgaggtcaggagcttgagaccagcctggccaatgtggcgaaaccccgtatctactaaaaatataaaacttagccaggcgtggtgatgggtgcctgtaatcccagctactcgggaggctgaggcaggagaatctcttgaacccaggacgcggaggttgcagtgagcagagattgctccactgcactccagcctgggtgacagagcgagactcttgtctcaaaaataaataaataaataaataaaaggtcttgctcaatgggcaatgatgggggtatccctagcacgatggctgaaaagaagaagcttcacctcccacagctcagtggggagcatccctggcagagggtgcccctgcacatccattgttgcgggtttgtcctttaccattgtccttcaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtaaggacagctgcagactcatggagggggtatgtgggggtgcagtctttgcctggtttggggagggtctcccagagttataattgatggggcctcagggctgcctaccatagacccaagctctggactcagcttgcaattaagggacttcctcagtagggcatggtccccaaaggctgcttaaggacccctgccttggacaaacctctcctagacttgatttttcaagatctgagctgtgtgacttgtataaatcacttaacctttccgagttaatttttcatctgtgaaactgggattagttgcttctctcaaacttagaaaggtaatgagaagcttcaaaagctggttatagctgtggagaggaaagaaatggcctcctgatgtattctcccagaggacagcatcagtattgtctttctcccttccaggggcgaggaaagagtccagttccatattctattcacagaaagtgattgaataggtggcacaaatgcacatgtgcagtgtcaagcatcctctcttcttccccaggtacctggccagtggctctggagacaccaccgtgcgcttctgggatctcagcacagagacaccacatttcacatgcaagggtcagtatgcaattagccatttagggggtcttctttttttttgagacaaggtcttgctctgttgaccaggatggagtacagtggtgcagtcacagctcacttgaactcctgggctcaagccttgaactcctgggttcaagcagtccccctacttcagcctccagagtagctgggatgacaggcacttgccatcacacctggctcgttttttgttttcatacagatgagggtctcactttgcagattacaaccccttaatatccagttggcggctgtctgttcctaggtagagaccatgtccttgagcccagccagccacttagacacaagcagaaactgcaccaaggagtcaatatgggacatggtgagaggctgactgactgctaccaaggagaacctggtttaaatcctgcctctgccacagtggttttcaaacttgagcacaaatcagaattgccccgcctcaggggcttgttaaaatgcagattgctggccaggcgtggtggcccacacctgtaatcccagcacttcgggaggccaaggcaggcagatcacttgaggtcaggagtttgagaccagcctcgccaacacagtgaaaccccatctctactaaaactacaaaaattagccgggcatggtggcgtgtgcttgtaatcccagccactggggaggctgaggcagaagaattgctcgaatctaggaggcggaggttgcagtgagccgagatggcaccactgcactccagcctgggtgatggagtgtgactccatgaaagaaagagagagagagaaaagagaagagagaaaaaaatacagattgctgggccccacccccagaggtttagttctattgggcctggggtagggcctgggaatctgcatttctaacaagttcccaggagatgctgatgctgctgctctgacgaccacacttgaagaaccactgctataccacagattagttaagtgaccttgtgtgtgtagggcatgttccctttctaagcttcaattttctcatctggaaaatggggatgataattcttgctttgctccatagcttagagctcttgtgagaaataacaagggatgacatgtacaaaaacacttcatagcatgtgtcacataaggagtcattagagagtgatggtgttatccatgcagcaagatgcagagctctaacacttggggtgcattctatccatccccagaaagcctcatcgctccttttgttcaatcattcatttattcaaatggttaaggagtacctggcacctgacaggcactgctgggcacttgggataaagacagatgtagtcccttatttctccctcctctgctttcttaggacacagacactgggtccttagtatatcctggtctccagatggcaggaagctggcctcaggctgcaagaatggccaggtaggtagttctcagggtaactaggcagagactcaagggggccttcctaggagacagttcagaatcaggttcaggagtctttggggagggttgggtgggaagtggtaggcagggattttggtggagccagagacctgttggggaggattattcagtgagcttctgtccttcagattctcctctgggacccaagcacagggaagcaggtgggcaggaccctcgctggccacagcaagtggatcacaggcctgagctgggagcccctccatgcgtaagtgacactgacggagctgggacaaatgagccaggggatcaaagccatcccctttccctgcccaatgcatagaagttttacgtgaggggacaagatgggcagcctgaatgaccgtgatggcttggcaggcatgggagaagggtctcgggcagacctgcattgctgcttgggagaggctctcatcacagggtctgctggttgcagtcaccttgcagtgcagccgggtcttggtgtcagaaaagctgtcaaaagattgtccatggcctttaagttgggaatggggaggtgccatgggcacacagatgttgccaggtcacagatgaggtcacatctcccttctctccaggaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacgtaagtgctgggagggttcagaaaccagtccagaaaatcgcaagtcacaagatgctggcactcagaatgaccttgacatcagcgagtccagtgtttcccagatgtgtgctgggagccctggtctagggaggtgttttgggaatgaggagttctgtggttggtgctgcaccatagtggagattgcagagtccccatgagatcgtcacactctggaaattcctcctgtaggacagctgttgggctttatcagatctaccatatcccaaatgtattggacaggagccgtttactctgacatccctaactcctcttccatgaaacattttcatgatctggactccattttacaagtggggagagacttgaccccagaggggtagtttgattaagatcacaatgcatgagtgatgatgattattagtcttgtaccacctgtctcctggggctaatcgcccaggcgtggggaggagtgtgtgtgtctgacctgactcgctctcccgtagggtgtgctgtgccggactctgcaaggccacggccactgggtgaacaccatggccctcagcactgactatgccctgcgcactggggcctttgaacctgctgaggcctcagttaatccccaagacctccaaggatcctgtgagtgattgggagaaggaagagcgggggctgattgggaaggagccagttctcaagcttaatggggagtgtttgctctttgtgttggattttcttatcggccttcttcctcatctccttttctcccctccggtacctggtcacagtgcaggagttgaaggagagggctctgagccgatacaacctcgtgcgggtgagtgtgtgccagccacgtgcacccctagctctgtaccagtccttagccaatcactaaaaccctctcagacccttctcccttctagacccagctcagaatgtacctattccaaaaagttgttcttcataatcctagtttgcaatcctaaaatactaatgtgctagagatcattttatttcgttttttgtttagtttatttgcttgtctatttattacatttccaacatgcttcttttttactttaatttgttgtttaagattgttcacacattcacgttcaaaaaatacaaaaggtagatcgcggagtctcccgtctctattgtagcatccagtgccaccagtatcctgaatcaccttccagagatttaatatacagacacgtgtctatatacagtatatatgtataagcacacacacacatgcatacatacataaaatccttcttttaacacattattttgtgcctttttctgtaattatgtatcttaaaatttttttctacatgcatgtagagtttctttttccttttggatgaagtgacttgcctggggtcacatgcgagtgagtggccaagccagtcctcattgctcctagcgctggcctctctctgtccctggcattgagtaatcagggtgtatgcttgctgccaaagtcgggccctcctccttctttctgagaccacacccaacacagtgtgctttctgcctcccctagggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtgagtaggggtgggtactgcttctctgtaaggagtgaatggtgggaggggcttggcactgccacttactagctgtatggccttggcaggtgtttggattttctaagccactgtttcctctttggtaatatgcagaccccctacctctcagctttgttacaaggtgtttgtttgtttgtttgtttttagagatgactttcactctgtcacctggtgttcaagtggctcgagtgcagcggcacgatcttggctcattacaacctctgcttcctgggttcaagtgattctcctgcctcagcctcccaggtagctgggattacaggcctccgccaccgtgcctggctaatttttgtatttttagttgagacggggtttcaccatgttgactaggctggtcttgaactcctgagctcaagtgatccaactgcctcggcctcccaaagtgctgggattacaggtgtgagccgccatgcccagcctagttacacggatttaatgagacagtatgtttaggacccgcactaagtggtcactaaaaatgctagttcaggctgggcgtggtggctcatgcccataatcccaggagtttgggaggccaaggcaggcagatcacctgagttcaggagttcgagactagcctggccaacatggcaaaaccctgtctctactaaaaatacaaaaattagccaggcatagtggcacgtgcctataatcccagttaccccggaggctgaggcaggagaatcatttgaacttgggaggcaaaggttgcagtgagtcgagttcacaccactgtactccagcctgggcaacagagtgatactgtgtctcaaaaaaaaaaaaatgctagtttatgtcttaggagagaagtgatcttagagctagctgctgaagaggtagggctgtagccctggagaaggtgaagtggtggtaggtaggcttgtggtacaattgttacttggccctcctcaaagtgtgggccacagaccagcggcatcagcatcacctgggagcttgatagaaatgcagagtcctggccccaactcagaccttgtggatctgattcttcattttaacaaagttaccaggtgactctgctacccactcaagtatgggaacccttggtgtgatgaggcacagtgctcttggggttaatcggattagaggagaggcaaaggcacaggcaagggggagaaaaagagccagggaaaccttgttagggctgaaggggggacctctgcgttagtgacgtcactgtgttttcacacagcaaccctttaagataggtaattgggttcctttttaaaataaggaaaatgagtctcagagaggcctgatggtttgtccaaagagaaacagctagactgtgttgacgtgaaagttcagtgggcccactgttactccatgccacctgtcagcaggcacttgctgtttggggggatgacaggcagatgggctaagcagatggccacgttggagtctaaggcatgcaaagttgtgcaggtatggagggcaagcaagaggcatgctagaagctactcatttggagaagttttacaaattgtaatgactggtaatgattaaaaatggtctgggatggggaccaggcagtgtgattttgtaaaggttcccaggtatttctaacagacagccgaggttgagaaccactgccatgagcgtaggggacccttcagacgtgttgaaagatgtaactcagactaaaatccatcatcgtcttctcctggaccaggtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtagggccaaccctcaggcaaaggagggactgggattggagcctggctggctgtctccctctcaccaccccacctgccttcctctgcctccctttaggtatatgctgttgactggagtccagatggccagagagtggcaagtggtgggaaggacaaatgcctccggatgtgagtgtgggggaagtggtggttggcatacacagccctcctacccctaaggtccttctgtgcacactttcccttacagcatagaattccgcagggccgtccaggtgctcagactgtcttgaggaggcgtgtggagccagattctcagtgggcaagtgggagggccacaagtgggagggccaccggaacaacagaggccacaggacacctcgtagagggcgcgtccaggtctttctgtcagtgggcaagtgggagggccaccggaacaacaggggccacaggacaccttgtagagggcgcatccaggtctttctgtcactagacttcagagtcgcaagacctgagttcaaatcctggttctgccatggagtaatcacagagaacttggttaatcagtctcttgggaattatcaaaccttcacagacaggatcaaaaataggagggtcaacactctggaagacaaagtgttgtgtgcttataagggattgtgactgtttgctggtgggcatcccgagggccaggccctgggtggaggtcctggtggcagcaggcagtgagtgggcagcctgagtttgggtgggcagagcagggacggtcacctggctcttggtgactctgagggtggaccacaggccgtccgtctgttgacactgggattatatgacggcctccctttcctaaggtggaatccccatcctgacacccttcccttctccacagatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacaccccagagccagaaatcgaaggtcacaggaagttgtcactgaacttggcccgtgtctgctactctgtaccttgctggtacagacaggggtggtgggcagccaggctctatgagtgggcccctagtgtcagctctgtacagggtcagatcccaggttctatgaccaaataagtaacttaagttttgtgtgttgggttctaattccttgtcctagaatccccatgactcaatcaaggactgtgctaaatgagattgtccagcccccgcccttgcactggactacgccaaaaccacactgaccaggcacttgccttccctctcttcccccgtgttggtaagagagaggccagttgtgatagtggccaaggagaatctagggctgtattgttgtccactgcagtaggcaccggccacatgtgactgctggcatgaaatagaagtgcagttcctccatcgcactgggtaaggcctccagtattggacagcacacagaaaggttttcatcatcaagagagttctgctggtcagccctgctccaggggatgcctctgccttcgcatagcacactgcttgaggccctgccaggcaccaagcactgccctgggcccatgggatagagcggggaaggtgatggctcttccagaggattccctcagatggggaggcagcagtatgagctctgagcagaagtgggtattgttgatacagaggaagttctttgccacgagaactttcaagcagtgaaaggaattcccatcaggactcagaccccaggccgagatcttgccctgaatgtaccctgcctctgctttctcctgcatcccatgctaagcagggtcatggtctgaactactcagattggatttccaaaccatccttgtataaactgctcagaactagcatcttgctccttcttaccctcctccacccttgtctgtgcttttgggttttgcgcgtcacctagctgtggtgcttggcctccaccttgcacatatctgcagtgaggctacataagaagcgaacaaaactatcagccactgagctccttggtgccagctgtttgtctgctgtgctctcagactgcaccaggcctggaaggttctcaagctccaaaacttttgatgaggaaacaacataagaaatgattagcccatgccctcacatctagtaagagaaagctgggattaaaccaggccctgccccaaagcttattgtgcactttgtaccacatccctccgtccagagctcaagctagtttgacagttcatgggccaccacgtctgtccatgacagctatttctgtatttttctggtgtaagagccttttagtcttagagcaccagtctccctgttcccctaccccgccccactggggaaggggtgatggcagcatcctattgcctagctgcctgttttctatctccccacccatgtagactctgtcctggtggaagctaggaggtgggtgccagccagcccatctgaggctgtctgcagcataaagcagactttagggtgctggatgacctgcagttctttaatgagggacctagacccagcccagatttggaggaggagggagtctagcagctgtgggcagtggctgagcctggcatggcctggcctgagatgcctccaggtgaatggggcccctatgtagccttggccccagcccaggggtggggtgcccataccactctgccagaccccgggcccgcagggtgctggtggtatggtaggtctcatggctctggtttctgagggcctggggttgaagctgaaagtaggtgaggggtgtcctggggccctcccccttaacagggaaataggtattccagatcctccagcctccgcatctcctccggcccgatggacacgatcttttgccggggttccttgcgccgcacggtgatctggatggggtagttctcaggaaagctgctgaagtcagtggccagggttgcaaactgaagtgaaacaagaaaacccttcagagttccttcccagatctgaacctggctctctctctgtctctatcaccccttttttttctgtctgctgactcagaccttaaacagccttatccaacctagccattgacgcaggaaacaggtgcaaagatgcatgactcaagcctgtacctcctcattatgggatatttccaaccaaagggctgtctgtactcaggcctctatacccccatacccctaccccatacccaggctgttcccttcttcgtccccctttagcctcttgtcttccctatttctttcaatgcccttgacttcccagcctactcacaatcatgggcactgaattgcagagtctaaaaaccaatggctttggaaggggaacattatagtgatgttgaaaaatacattcgtttgcattcctagtgggccccagagtggcttaatccttaaacctcccagaagcatgcattctggaattgatgcttcttgacccaggcagaaggaaagctagccagatgagtcatgtgggcataggggtgttcccaacctccaaagccctggttccctggctttggacttctctccacccccaaggcccctcttttcccagggctcactttgtagggcttgcaccacttccccaccccagctgtgttggctgcacggacactgaggcagtaacacgtgttaggctttagctccatcagcttgacagtagtgcccaaaatcttgttgaagatccatggacgattctttgcctcgggcaactcattctcctgtgtcttggccacctcctgtaacaggagctggtagaaactgaccggctgcttgcccaaggcgtaggtccaggaaatctaggggaagagagagccccgaggcttcctcagatatgtcctgtccttcctgtcccttcaccctcccaactggggtcaggacgtcccatgcccatcccctgctcctgctggggcccaggcaggtcagatggaaggtgcaaggtactgcagcactgagtgtggaacccctgccccgaagcatgtactactctcctgggcagccccacccactttagggtacaccctcattccatatttcttatacgccaggggtcctcaacccttgggccaccaactgatagcagtccatggcctgttaggaactggatagcacagcaggaggagattggtgggcgagcaagcgaagcttcatctgtatttacagctgctccccacggctcagggtaccacctgagctctgcctcctgtcagatcagcagaggcattagattcccataggcacgtgaaccctattgtgaattgtatgggagggatctaagttgaatgctccttatgagaatctaatgcctgatgatctgtcattgtctcccatcacccccaaatgggaccctctcgttgcaggaaaacaagctcagggctcccacagtttctacattatggtgagttgtataattatttcattatatattacaatgtaataataatagaaataaagtacacaataaatgtaatatgcttgactcatcctgaaaccatccccccaaccggatccatggaaaaattatcttccatgaaaccagtccctggtgccaaaaaggttggttctagactctgtctagactctgttagctgagagggaccttagagatcatcttatcgactaggtccagagagggcaagtgactggtccatcatcatacggcaattaagtgacagccagtgttcaaacccatagctccagagcccatacactttgtactacaatggttgccaagcctggctaagcatctcagggagattttgtaactgcagatttctgggcctgctgcctcctgtctggtttctcctccatctaggccagtgtttgtcaaacttggtgtgcattagaataccctggaggacttattaaaagatagattactgggctccgccccaacagtttctgactcaggaggcccaaatgtggtggagggagatgagaatttaaatttgtaacaatttgctgagtgatgctgacattgtccatctggagagcactttgagaaacactgctctgggccatccaacagtggaattccaggcatcctcccaagatacagctcgaattgctttcatcatctgatgtgaagctttttacaaagctgttccctattacttacagaaaagtctataaagtagtctaacactggaggactctggaagatgatcccagactaacattccccatcctgtcccctgtcttcacttcccatagtgtaggacggtgttgttcgacgtgtagcccgcggacggggagccacagcatcctctgggaatctgttactaatgcaaattatcaggcttcaccctagaccctctagggaggaggcccagcaattctgagtagcctcactcgatcccaggtcctcatccagggcttctcacgctttcatgttcctacagatcacctaccatcttgttcaaattgagatttcctccctcactttcctgtgagcttttgctagggtccgcccctccagggaatgcctccctcctccacctctagatgtttacatgctacctctacatcccagctcagatgttaccaaaagccaccaagcttattcccgcatctggaaatatctttccctctgaattcctggtggcacttgctctgaacttttcctacagcactgaaccctttctgtcttgcactggagtttttacagacacatcctctcccttcctaaaccgtgaacttgaggtcgacatgcaggtggcaggcaccttctcactacccatggagctcagctcagtgcctggcacaataagcctctgctgaacgcatgagcaagggaaacgcaccacagctgtggaattgttgacggtgtgctcaaagatgaagggggtgtccggcaggtccacaaccacagaagattctgagtgcgttgaggaggtttctgtctccagctcagggttgtcaaggtccagcaggccccttgtggccatctgggacttcgatgggcatgggcaggggccgagcgccaggtcctcattttctgcattcttggccattggggagaagctgagtttgttcagctccccctccagcatccctgcaaagaagctgctgttgggctgggtcacagctaatttgatggggttcagcaaggtggatgagaaggcagagatgctggtctcatcagagctgcagtctgaatcctctactggcagcggcttcctggagcaaaaggggagacaggtgaatcagatgaaggaggccaccccagcccgttccacctgagggcaggccttgggcctgacttaccagcatccccagccatttgcaaacagcttggaacagcctcattgctctatagcattgcattagactcaccagggcacttactaaaaatgcagacttttagtccctggtccccagttagcatgggactagagaatccgcatctttaataagatcctggctgggcgcagtggctcacgcctataatcccagcactttgggaggccgaggcaggcagattcaaggtcaggagttacagaccagcctggccaacatggtgaaaccctgtctccactaaaaacacaaaaattggctgagtgcggtggttggcacctgtaatcctagctacttggtaggctgaggcaggagaattgcttgaacccagggggcagaagttgcagtgagccgagatcacaccactgcactccagcctgggtgacagagtgaaactctatctcaaaaaaaaaaaaaaaaaaaaaaagcttagaaaatcctgatgcaagtgttctgcaaaccacaatttaaaaaacatgctaaaatggcaagtcctccctccaaagtggggtgcaaatgccccagggaataaccacaaagatctactggggtatggaagtaatacattcaatttcactaatgtttatttactattgtttaaattttaatggaattactaatatttacttacattttagtggcatttaataatacctattaatatctagcacgtaaaattaacagaaatacaaatacatatatgggccaggcgcggtggctcacacctgtaatctcagcactttgggaggccaaggtgggtgtattacctgacgtcaggagttcaagaccagcctggccaacatagcgaaaccttgactctactaaaaatacaaaaaattagctgggcatggtggcggttgcctgtaattccagctacttggaaggctgaggtgggaggatcgcttgagcctggtaggtggaggttgcagtgagccgagatcctgccactgcactccagcctgggcaacagagtgagaccctgtctcaaaaataaaataaaacaaatatacatatgttggtgtggatgctcaaaaacttatttcttccactctgaattttttaaaattatgaagtattttagacttatacaaaaatatcaagaatattatattaaacctccatttactcctcatctacctttagaaataaaatcttatcactatgggtaaagccccccagacacttctgtctcccaccaaagtccccatccttcgaccgacaagtaatgagtacagtaaagtttaaattgtgtatttattactcaatgtgtgtctttataggtttcttacatatttatgttatccctaggcaagatctattatttttcacgtttgtagatgttgtacaaataaaagatattattcagcacatacccatctgcaacatgcttttttcactcaactttgtgttgacattcatctatcttgatacatgtagctctggttcagtcgtttttactgttttatgattttccattacatggatatttgtttttgtttttgttttttgagacagggtctccctctgctgcccaggctggagtgcagtggcacaaactcccaggctcaagccatccgtccacctccacctcctgagtagctgggactacaggtgcacatcaccatgtctagctaatttttgtgtttttctgtagatgcagggttttgccatgttgcccaggctgacttcgaactcctgggctcaagtgatcctcccaaagtgcttggattataggtatgagccactgtgcccggcctatatggatatttgtattgttatgagatgtttgctattacaaagaaaaaccttgtacatgatccccaccacttaacatttcttttttctgtttttactcttttttctttttttttttttttgagctggagtctcgctctgtcgcccaggctggagtgcactggtgtgacttcgactcactgcaacctccgcctccctggcttaagcgattctcgtgcctcagcctcccgagtagctgggattacaggcccacactgccacatctgcccaatttttgtatttttagtagagatggggttttaccatgttggttaggctggtctcgaactcctgacctcagatgatttgccggcctcagcctcccaaagtgctgggattacaggcgtgagccactgcccccagccaaacaaaaaacaatatttttttaactgatgaagaacaccaagccaaaaagtttggctttcaaatctttttttacctttacccaaagtaaaatacactttccatggcaacttagtacatgcatatatacgcctataactaagacaaacatttcacagaccaacacttactctgtgtgcaatgggctctggaatttccaattctattatagtttattttatttatttatttatttatttttgagatggagtctcactctctcagccaggctggagtgcagtggcgtgatctcagctcactgcaacctccgcctcctgggtgagagtgattctcctgcctcagcctcccgagtagctgggactacaggtgcggccaccatgttcagctaatttttgtatttttagtagagaaggggtttcaccatgttggccaggatggtctcgatctcttgacctcgtggtctgcccgccttggccttccaaagtgctaggattacaggcgtgagccactgcacccagccagtttatttttatcatagtggtcttcaccaactagaaggacttcttgacccattaataggtcacaatccacagtttgtggatcccttactcccatccagcctcccaggtcttggttgatgaacgggccaagtttttcctccccaggttccagcctcatcagcctcctcctgagaaatcctgattagcccagatcccctatgctagcgcttggtggacatttggaataaatgattcccccaccaaggtcttttgtagactgaagagtctgggtattaatgtcatatgtgctttagattgtcctaatgaattaatatttcagattcacttactgcaaatgctggtactgaagcaagcacagaaggccgctaggcactggctacatgctgaacatctcctcctcctgatgttcacaacagctctgctggatggatgttagccccatttggcaaacaaggggctgagggtccctgatctgtttttttttttgttttgttttgttttttttatggagccttgctctgtctcccagacccctggctggagtgcagtggcacaatcttggctcactgcgacctccacctcccaggttcaaaggattcttccgcctcagcctcttgagtagctgggacaacaggtgcgtgccaccacatccagctaatttttgtatttttagtagagacgaggtttcaccatgttggccaggctggtctcaaactcctgacttcaagtgatgcatccgcctcagcctctcaaagtgctgggattacaggcgtgggctaccccatctggcctccgatcttaattaagttgtctaagaccataaatctctaagtggcagaacttggatctgagtttgggcttctagtccaagattcccagtataccatgaagtttcctacgagcatccatcactttagccatacctgcttgcttacgggcactttggggaatggacaccacatccctctcacatactcaagaccagctatgtagtctgtggagcccagtgcaaattgaagtaccctgagccccttattcaaaaattctgaatttgaagatagtaacagaaaagcattaaactaagcacaggccccttgtaagtgcagggctatttgtgactgcacaggtcattcacccatgtggtgggtgacctgcaagtaattccctcagcccacatcaccctgtaccaccaccccttcactggctaactcctttccttccttggagactcagctcaaatatcacttcctccaagaagcctccttcaactgcacccagtctcaagctatactaagcccctctggtccctcaaggcatcctgtcctggcacttaccagaccatgctatatcattctggttattgcatgatccccatcctttcacccctgacctccacatgccagactgggagctccttaaaggcagggactgtgctttccagctctgcgttcccagaacttaaacactgggacagacaccttgcaggtgctcaaagagttttgtggaatgaagtagaggaaaaccagacttggtgaggaggaacagcaaaacccagtccgaaggaaggcaggctactggggagcagtcaggtagatgaaggtaccaaagagagagggttgaggaagaggagccatgggtgtgtcagggatttggtgatggtgaggaccacagccagtcaaggcaggataaggagcactgtcaacaaactgactaatccaagaaggcctcctggagtgggagctccatatgcctccaagaagtgatttggggctcaggaatacataaatagatccaacctgcccacacgctcttctctgggagtcaaggaactgggttgtgacaagtcagggaagtatagattctttgtctctctgcccagccctcggctccagcctttcttagaaactataggcatggtggctcaagcctataatcccaacactgtgggaggctgaggcgggaggatcgcttgagcccggaagttcaagaccagcctgggcaacacggtgaaaccccgtttctaccaaaaaaaaaaatttatatatatatatatatatatatatatatatatatatatatatatatatatgaaaattagccaggtgtggtggtggcgcgtcaatagtcccagctacttgggaggtggaggtgggaagatcacttgagctcaagaattcaaggctgcagtgagccgagattgcaccactgcactccagcctgggtgacaaagcaagatcctgtcaaaaaaaaaaaaaaaaaggaaggaaggaaggaagggaggaaggaagggaggaaggaagggagggagggagggagggagggagggaccagatttgtgacttacagtaggttgatggtatcatcctccaagaagttgaccaaattgccctttgaggctagtgggagtcctttggtagtgacggtccggttcatagacttggggtttgaaaagggttttggcagttggtcaagggcattcatcatgttgaagttttctttcttcagtacagcctcctccccatctcccacttgatggagtgcctctgatgccatctgatttgttcgggatgacacccgtcaccatgcaggacaacccagctgaccagaagcagagagaaactgtgggggcagtggcccacctttagtttggacagtctgcaggtgcaatgagctgacttcataatcatcacagagtgtaacaattacaggccagcctccccccttgatttgaggctactgctgccaggctagctatgtggctggccagaccaagggccagtgtgactgtgaagcagcatcatgagaggggtaaaaccaaggaacagactgcatgagcccttgggccccttccagctctaatactccatggtgatggcagccctgcccttctctgaagatctcaaaatgcctgacacctgtgtccttccgcactgccctgggaaggagaataaggatggtgagagatgggcgtgggatgtagaggatggtggtgtggccctgagagataggcagtattggaaagtgtctgctggggagggaaactttgtccgtagaagctaaggctctctatcctgaaaccataggctgcagactccactgtgcccagtcggttagtgaaagggaaagcccacatggttcataggggttcatggctcacatatgatcagacttcactgctagaattctaaatgtgccacacccacactcccaagtactttcctgtgtggagtgacaatggtggcagttgcagtgggatacagagatgggccacacatgatctctgctctcagagaaaccaccttacagtaggaaaacatgtacacagcttcaggggtggggaggggggctgttagaaagcactggctttgcagagtcagatgtggatgtgaagtccagccctgtgccgcctagctgggtgacctttggcaagtgatttaacctcactgaacctcagtttcttcattggtgaaacagggataaaaaatagcgcctccctcacagatttgtgatgagataaccatgtaaagttttatttcttcctatggatgaggcaaagcaaaggacatttaaaaataccaaatcatatctttttgtgtgtgttctatataaccaaggtttcttgcccttaaaaaaaataaaaaataaaataaaaaatagaggccgggcacggtggctcacacctgtaatccccgcacttcgggagaccaaggcaggaggattgtttgagcccagtagttcgagacctgtgtgggcaacatggtgtaaccccattttgtagaggcgaaacctctacaaaaaatacaaaaattagctgggcaaggtggcacgtgactgtagtcccagctactcaggaggctgaggcaggaggatcgcttgaacccaggaggtcgaggctgcaaagctgagatctcaccagggcactccagcctgggcggccgatcgagaccctgtctcaaccaaaacaaaacaaacttttgaaaaatagacgcaggtgccctctggatgctttgctgcttcttgacacctgtcgtataatctgtaatgatgtgatttctgcgattccttttcattgtctgtctttcccttgctcacagtaagctccctgggggtaagggcgggtcgtcttgtgtcgcattttgtctccagcggagatccgttccgtttggaacggaagctggcgcaca

SEQ ID NO: 36496 - DNA, 41686 bp, Homo sapiens
gggcgggcgggaggcgcggaggcagcggaggctgctcggccgcaaggaggcaggcgggaggccaggggtgcagaattggggcgggggctcccttcacccccgcagccctccgcccgggtccgtgtggccaggcctcacgtgccccgcaggcctggggaaggtggagacaggggcgggggtccgcgcagaggcctgcacggcgcggccaggtgatggtgggcctctgtgtttctccagacgaaaggggacccccggagcggccgtgcccctgggctgcccccgcgaggcgttttgacatcagccatagggaagtcggggagccctgagcctgcctgtttccgttaagtgtccttaggatgcagtgattaaggaattaggctctccctccgggaggggcactgcctgtgctagggaactcgggggcagagaaacaggacaggatgatgctgtccgagcaagcccaaaagtggtttccaacccacgtgcaggtcacagtgctccaagccaaagatctgaagccaaaaggcaaaagtggtaccaatgacacatacactataattcagctgggcaaggaaaagtactccacctctgtagctgagaaaacccttgagccagtttggaaggaggaggcctctttcgagctacctggattgctaattcagggaagtccagagaaatacattcttttccttatagttatgcacaggtccctggtgggtctggataaatttttagggcaggtggcaatcaatctcaatgacatctttgaggacaaacaaagaaggaaaacagagtaagttatgtaatttattttgaatttgggggagtttatatcttatttatggtttttctgttcttggaaattatccgtatacttcgggcgttggtttttggattgaaatatgatccagttttaagcaccatatttgcatgaatctgaagtaaaagtagcactcgtgatgaaatattttttaaatggaatcattaatgatcccttattctttctgttaaacatctgtcaaataattgaatattttgtggtggattttaagtaagttaacattgtttcagtatgaggactggatcacagtattgaccaactagaacttcatataaattgttatggattttaaaccttacaattatcaatgaaatggaagatgagaaattaaatctggcaatgtaatgttgatgtgtcgcactttgtagctgtcaaaagataaatcaccagatttagaactcagtatttcgtttcagcgttataaacacagcttttattttagctcagccatttttcagggtcagtgtgccttgatgggagtctatacctgttagaaaaaaaaaaagttttaaaagtatgtacagacatcctcaacttcgaatgcacttacattttcctttgaatttgcaattacatcagagttattgtattcagaattgattttccaaagctattgtgtttagaccatattaaatgctgtaggatggagagaatgataaatttttgtgatgaaatgatttgataacatcttcagtggtcttttcagtatgacttttgagcttgagttagatacattttaatttaaaaaatcataatataaattaacactaggatattgtgtcttaaattgaaaaaaaatatgtttttagagttaagtatactcaccccttccataaacttaaaaggacattatattaatgaaattagtgagagaaaaatactggttgaacttctaagaggactttccatttccaaaatagtgttggtgttttgttcagttataattgaatttatttactctttaaaaaactttcttacaatgatatttttcttgaagtttatgttaattctttacattttaaaacgactctctcttgttcttttctgtacatttctactctcaggcttctcttgattggagtttttttgtttcattttaaatcaggtcttaacctaagatttaatatatgtggagtaaaagtgtagagagatcagaaatactaggaatgcaggaggaaaaatggtaccatttaattgagatgaaaatattttagaaggagagaaaaagttaaatgtaaagtttaatatatatcagtgatttgaataataaaattatttgatacctaaagagtggcattcagtttcctccgagggattctttatcaaattgaaagtgaaaaatggataattaccaaataatctgtttcaaattgccaattttgggtgacacttagtaaatatttaacgtgttttgaatgtaaactattaagtatattgcaccttcaaattcctcacttcatttatagtactttaatattcatggatcatgtatttcaggccttctctgaaacataaattttcctagtgaaagtaggaccaaatgtgaacccaaggagtctgaggatgaaataaccttttacaatttcttcttgttttactcctagtcctgggcaacatcacagttacaatacatttggtgtgagcaatactctaatattatggtctctccttatagaaattctctactggctattatataaaattgattagaactttaggggtaaaatgcttttaaatgttatcaacagggtttgtgatgttattgcattcaaagtgattttcatatattgctaaacccttaacattttatttgtggataaatggggaccatgtatttgatgagatatctttattggtaatatttctagttttttaatatatttaatagcttccttttctagcacagctgtacctgtggcccagtaagagacagacttgagccgccggtatatttcaaggaagatatttaatattctgcacattgctaaactttttcagcatattcccaagtgctttttagaaaactgtttcgagtgatgaggactaccagctaacttagatgtcctatgaaactgctgggtgtgacactttttacattttgacactgaagacatatatttacagcttgtcttccagttgtgtcatgatagataaagaagtatgacaactaaaattattactttacttattttcttaccttgaaaatatatgtcttttttctctcttaaggaatggggaaaaagggtctgagccagaaccctttgagtgggcctgggaagagaacttctgtatctcctcctttagaggatgtctgggttggttctggcatgagatttaaagaaataatacaatgtttagtaatagaatgttaaaatcattgatgctgttgtgtaatatccattgattttttacaatagaagtaggtgatgttgacttttttttttaatgctcatgaaaagtaataacaaccagagtctgtagagttagatgtgactcagacatatgcagattttaggacgtgtgtgtgtctcagcggtgcacctgtgtcctggcctctggcacccttactgccaattttgtcccatttctgaccacacagcaccaattgcttgggaatagttcccatatgtgtgctggtttttgaacatggacctgtgcccactaaaaattgaacagaggccatgtacagtttaaatccagtactccagaggtgaaaaaaagtcagctaatccagtaagctccaaatgctgtgtcttcgttttatctttctgaagactggaaaaacaaatgctatctctgaaatgattcttgaagatctcattaagacttccctattatgtcattttcaaaacaaagcaactaaagttatttgtcattgctacattttcaatgagtatatttgtaaaagttctttgcagttttttttggggggtggggaatggacattatagtgtatttacagtttgtagtcaaatactgatttgctttattcaggtttacataggtctttacagtttcctactaaaaaaacaagacaatgtaaacacatacacacacacacacagttgtagcttacttgtaagaatatagttctagaaataaaaattgaataaacatttaatgcaaggcagactgccttccaggagcttatactctagcagtagaaaatttgcattgtctttctcttcagctctcatgtctccttattaaatacagtgtcctgcagtatgtgccagccatgtggttaaccttattaacatatgtggttcatcaaataagaaagagcttctattttcctgcagatgttattcatcaactttagatttttttctttattgactttaatctgacattgggaagttacatatcattccttgtgcctcaatttcctcatctatgaaataaagatgttaaagtagatgatttattggtcttatctctaaaagtctgtgaatttccactacccccacccccttccattttgggggtaattaatttttttttactcatatttgctttgatttgttacatacgtgctcgtttttgtttgcaaatttttggtacattttttgcaaagtatattcacctacattctataaagcctgaggtactacagagtatttctgagctactgttcgtcagatgtgtttctctccctattgaaaatagctctgttttccaaaactttgagttaactgggtatataatctgcttcatttccaggctttttgagtgctcaattgtatgttatttaaggttgtctatttcacagaaatcgctgtcatttcttatttctagcccctgtttcttcagattttaccatttgccttatataagggattttctcagtttaaggtctcaggctaatagtattttaaaatattgatattctaagaaatggctagttttgatgcaactatatctgaattgattgaatagctccaatttagttaatcaagaaaatatttttcttccatgttacgtgcaaagatgtagctggtatttatatcatgtgccagtatttcaacttgatatacagtaaatgtaatcttctcttggcatatccagttggtaacaatgagagaaagaactaatgtaaaattagatcagagttcctttgtagctaagaaaatttgttacactcgattagagctatatttaaataataacctgtgtgcaggaatggatattatgcctcattgctaagttatgtgaaaacattgtagaaactctttcaggcttgattttgtagttttttttggctgttttcccatagaatgaccacttgtgacatggccaactggagaatttctcatggataaaaatactataaaaccaaaatattgcttcttgtatatcatttaaatacagatagtgccatacattgaagggactaaaacgtaagatttggcttcattttcaaaataatttttatttggtattgtcacagtagcaatagtaaaatgaagcaaatagattcaaacaagaagcattttaggtttttttttttccttttgaaaacttcacaagatttattttttgtcacttcttgcattttacttattttttgcatattttattcaggagtaggctttgattcattttatgtcaatctaaatgacatcatatgctgttttaatgattagcaagctatatgcaatgatctccaatgttaacaaaattcttttgctacttttacgtaagtaatattttgggatggggccaggtatttattattgtattaaaatgtcatgagattcattttataatgctcaaaaataatttgtattggtgaattctttcaaaatctctgcctcaatgtcttttaatgttaaaaaaaaatgtccttaggccgtgagcaacacttaatcccatatggaaaacttctagcattgataagaatttttgatgatgagtgattttcaaattacaaaagaaaagattatctgaaaacattttcaaacttgccaaagacctattcattccttcagtatatgttacatcacagagacaatgatcagttttttaaactaaataataagtaaagcccgaaatactgtggctgacagattcttattcagagcttaggttgccttgatgtatagttactttacctaaaaggctatttgtatgtaacagaactcagtatcctctctctattatgtgttacagccaatttttttttcttctctttaaggtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaaaaagccttttctcttgggtcctcagcgactctcgtcagcgcattcaatgtctgatttatctgggtcccatatgtcttctgagaaactgaaggctggcaccataggtcaaacacatcttctcggacaccagttagattcctttggaacagttccagaaagtggtaagtgtcacattcttgtgtactcattggtctgaactacccttttagtttttaaagtttaatttctaaatttagtaaatcaaaatagcagttgctttgtagtattttccaaattttgtcattcatcaaatattgagtacctactatacctcaaattggtaagttccttgaaggcagagcttgtctgcatttgtatttatattattagatgataataaaatgagtgccagtttccttttatggcttggctgcctgttttactgctgtttctgctatctcaaaaccctgagcataaatgaatgttccatttcatcataaagtccttagaagaaaacttttatgttcagaagtaagaaagtaaatttaatgctaatgaaaaagtctctgagaatttttaacattatcatgccaaccagaacctctagttttgacatcatagtttatatgattgtgagctgaatacattactaatggtctagcaatatgctagttgttatcagcctcgatgcttcagactgctacaccttagcattttaagattgtttccttgattttttgaaggttaatacatttaagtggctaattgctctcattctaaaagcagcagaatgcacacagactgtgtcaaatagtgtgatgtaatgtgtcactgattatgtactaactacaaaattgtttgtaggaagtctcaaatctccacacagaagaacattaagctttgatacttctaaaatgaaccaacctgacagcattgtggatgaaggtgaattgtgtttcggaagacaaaatgacccatttacaaatgtgactgcttcattaccccaaaaatttgcaacactgccaaggaagaaaaatccatttgaagaaagcagcgaaacatgggacagcagcatgaatttattttcaaaaccaattgaaataagaaaagaaaataaaagagagaaaagggagaaagttagcctgtttgaaagagtgactggaaaaaaagatagcagaagatctgataaacttaacaatgggggatctgatagcccttgtgacttgaaatcacctaatgcatttagtgaaaatcgccaggactattttgattatgagtcaaccaatccatttacagcaaaattcagggcttcaaatataatgccatcttcaaggtaagcttaatatgggggaagttctactatttgggaaaatcttgtacttgaaggtatcaaatatttcttttaaatgctagaatattttcaagtcattttattttatttgaaaaacatttttatttgtataattaaattatagagccaggcaatgttgcatatatttttggaactgaacttttttatcttaagaagataaaagactcttattctctatcctggtctacttccacttatgtgagccagaaattcaccaaaacttagaaaacaacatggcttgtgatgagacatggcgagagtgaattgccagtgggtgttagttcaagccagaaatttaggtgataatgtttctagggattcgttcatgggctacctggaaaggaccaacagcagcccatgtgctattctttaaaaaacgccagcttcagtattaatggctttcctaatagatgttaattatccttattaaatggctatttagaagtggtttttatttgagaatgcttgttattggaattcagtaaccctcatgggttctgtaggtatacccaagggatctatatgatgatttatagtcagaaataatcactcatgagaaagattggattttccaactttgagttttcagttatatatataatggtgcttttcttattccttagtatatctaaattatatctatatatctaaatttaaatctatatctatataaatttatatctacatatatagatataagtgtagatatgctaaggaataaatttaaatatggttatggattttacagaagtaaacgatgaaatagctgattaaggaaacctcaagcaaagaaaagataaatttattcccatcttaagtatagttggccccccatatttgcaggttctgcatttttggattcaatcaaccatggagtgaaaatatttaaaaaaataaataagaaataacaatatagtaatgaaaaaataatgcagatttaaaaaacagtacagtgtaacaactgtttacattggtttacattgtattaggtattataagtaatctagagataatttaaaatatatgggaggttgcgtatatgtgcaaatactgtaccattttgtataggggacttgaatatccctggattttggtatccttggagtcctggaaccaatctctctcagatactgagagatgactgtaattatcttggaagagcatgctagagtgtttaccacgtaatagaagattttcttcaagacaatattatagagtgtacagacctgaatgggaatactggcttagaagtgctatgacctccataaacctcagtatctccatctttgaaacaaggaaaataatcccacttgataggattcggtgaggataaatgaaagtacataatacaaagccaggccccaaatagggaatccataaatggtgactacaattatgtttgatgtatcgtcatgttatattttactaaaaaacagtgctttgttttgtcccactagaaacagcaaatagagtattaacaatcaatcacttttaggctgtgccctctcacctctcttatgtatcttccatgatattttaaaaatttgcatttaaattttcaaagtgaagtgtactttttttgttttcttttacctataaatggatatttgccatggtttaaaagagtattctgttctgtttataaaccatactccagaagaataacatttttatcatatggtatcaatattttattgaagagtttatagttttgatatgccattcaaaaatattttggtattttacatactgtacttcacatattacattaaatcttatatgggtaaatagaaatatatttgcttctttccctctttactaaacttttttttacagaaggttgttggaaacaactgtctgaggtaacttggagatggggcaatttagctaattttagagtcagaagaaaagcaagaaaatggaaaatgataggaaaataatgtttttacattatgggtgcatatggaaaaaaaagcttattgagtatttgcaaatctttaattgccctgtatttgagttgtttatgtgggctgttacgggttttaaaagtgcctgtggcattttgacacatccaggctttgttttcagttactttattattattggctgtttctagcaaaattagagctgttttatgatgtatgaaatgattgcaagtatgtaaaaaaaaatagttgtttttcattttatgactttctcttcttcatatttatgagatgccagatatgaggacagaacatttgtggattcctaggaagttattctttttgcatcacaaaccatccgtgtggtaaatgtaaaacatttgcagtaaaggggtagttctagttaatcttataaaaaagaagaattgaatataaatagacccaagaagagtgtgcagttcacacttttggcaagcagctttatcttgagtggaatttgggaggatattgccaaggtagtgttgtctttacgtaacagtatagttctatttttcctcccagtatcaaccctcagctatctgggacattttaaatttctcacattaacatcctaaccgaatgcacttttggagctatgggctcacattattaagacacgtgctgtgaatttttttcaggagtgctaaatagacctatttacagtttcctggactcttgtggccagtgtttgtgagaatgctgaacaaggttaagggtaaaatacatagccatggaactgcattttcttcttggtgagtgaactggctcacttgtgattgctggtacctaggaaccatattgttaccctctggttgaataatgtatattattaaaactggagaattttctttatgcccaaaattttaaaatgtactaaggcacactttttttagaagttagactttttattccttagtgttaagtaaagtccgcctgaagaaagcactttggaaaccacaaaaaataccacattttgatcctgtccttggaataggtcccatagttttacataaaactgatagaggaagttaggcattatcttgggttacttcagcaaagagcagggctctttgaaacacttttccccgaagttactaatttgcagtctcttacatgcccctatttctttgaagcatttcctgttcttgtagggaggggtagttgttccctgtgctgcagcattttcttacgtaagtcttgtcttctgtgggcatggcattgttcactaatagcttagtctcactttttttgcccactaccatgaagagtttgatagcagggtctgcatttcattcctctttttgcccttagtctccagcgtgatgcttggtaggtagcaggtattagatattttgaataaacgcacacagtatagcagaccagtttcttaatgcacacagtgtagcaaaccagtttcctaatgcacacagtatagcagtttcctgaaatgctactctcattccgttagcctcctacttccagccctgcttgcgtgggctgtgaagatctttctaatagactgaaaacagatccataaagccgtatgtatgcatttttatgtacaactaaacattgttaaaaatctaagttttaaaggattactaaaatttaatattcaatctaaatagcacatttctggagactattaagaactgtgtattagggtaggttgtcagctgtaataaccacggtatcagtggcttatcacagcaaaagtttattgctcactcttgtcacaaaggagttcactggaatggtgataggaaaagtgagtgctttgctctatgcattcatccagctctgcacagtctctcaggaagcaggcttcttccttcttgtgatgccaccatttaacacatggcctccaagatcagtgcagcgcaggaggagagagaggatcaaaggagggtcatttctgtgtgccaggcctagtgcagtatgcattacttccacatatgtcccattggccagagctcacccgtgccccagcctcactgcaacctgtgaagaactgtgacttagctgtatacgcagaaggaagctgaattgggtttagtgagcttacaatattgtgtgtgccattgatgcctaatcagcttgctactaagaagtcgggatgctgtccaatgctggcatgctgcaaaactcctatgacacatatacagtaagtagtgttggagttcttgtaatcttcaggagaatgttttctcagtttattactggtactaagttgtttgtattttataattgccactagtcttgttttttaattgtaagtcacaggttgtttagcatcatcagtatcaactaatttttttcatgctttatcaaataaattgtcaactaatttatcatttggtttatcacacaatttgcgaagtaatccttctttttatcagcagtatatcatttgccaaaaacaaatatgcctgaatgtttgttataccatttttaatttgttcacaacaaattatcttttaatatattataaaatcacaaataataaattgtaaataatgttaccaccaggctgtttttcacttaaaagtggaaatgatgggtgtgtgtcttcaccaagccaaatttgttcatttcatttcttttttttttttaactaggacatagcaagttctggcttatttaagagttcatggaagagatgtataccactttcaggtctggcccatggaatgtcctcttaacactcttaacacaatcctccgttttgcctcttcctccatatcctggaccagggattggcaaactaagcttggaggccaaatctggcttgctgccagtttttgtaaagttttgttcgaacacagccgcattatcgtcataattgtgtacggtggtagcgttgagtagttgtgacagagaccatatggcccacaaagctaaaactatttattgtttgggctttacagaaatactttgctgacccctgcagtagctgaatggagaggatctttgagatgggcagagctgtaagtaggagcagcctgggtctctgcatgcaagtggaaggcccacctgacgaggaatagccaagtggcccttgtccaaatgataaattcacaggatataagttactgagatttatatatatatttattagagcacttagcattatttatcctactgaggagggcacatgggctgtagtacctttcgttgtgtttaagaaagccctagtcaaaaaagtttaagaactactggtttgcaacaccaaatccaaactcctctttctaacgttctaaggcttgttgtattttaggcttttcttaaccttccaagttttcttttactgttcctcaccaacctgttctaggtaagttaatttccttactgccatgtctctacactgaggtccttgtaagccatgccgtcttcattcccgggctcaattgtggggtgcactctcaactcatctctgagtgttcttttttgagtaataacctcgtgtttccctttggatttctgctgatatagaagaagtaattactatacaatgtttattgtactaggtcttatattaagctgtgtaagcttcataacagttgtgcagaatcctctttcttgggtgcaccacagcacctagatttgtgcatgacctcagtgctgatcatcaagggctcctggagattatttttttttagctacaatttgttgggcctcccctctgactgaattagaatctttagtgagtaggccctgaaatgaaaatcaacattttaataacttcccattgactatcgggtttaaaaattgctaatctatattatatcacctacagtggtcctcctactctatggggatacattccaagacccccagtggattcctgaaaccaggcacagttccgaaccctatatatcctgtgtttttttttctatacatatatacctatgataaagtttaattcataaattaggcacagtaagagagtaacaataataatgaaatagaacaattacaacaatatgccagcatcactcctcttgcacattggggccattattaagtaaaataagggctactcaaacacaagcactgtaatactgcaataggcgacctgatagccgagatggctactaagtaactaatgggcaggcagtgtagacagtgtgggtacactgaacaaagggactgaacaaagggatgattcacatcccaggcagtacagaatcggatggcctaccatgtcatgaggctactcagaaggacacgcaaattaaaacttaggaattatttctggaattttccatttaatatttttggactatggtggttaactgaaactgtggaaagcaaaaccacagataaggggatgggactactttatttcctaagctttcagtaagtattcactgtgaatggagatcaggaattgtgctggcaaatgcgtacttaaattagacaacttagtcatattagctctgcttgcaggtccctaactaaggtagagggtatagtaaggaagttagcttggctaaaacagagatatggtggaaaggagtaaaagatatggctgaataggttaaacacacacacacgcacgcacgcacctaatgcacacacacacaccctaaattatagtgagcattgaagaccaggcagaaaagtctattaaatatttatggcatctatgaatgaattgtttctcaggattgaggtaaaacctgagagtcaatagtgatgaatgacgcttaaaaatatgcttctatttgtatgctacccatggtaaattgaggagaaattccatgatgtgtattctttgaaggaggtgtaagttccttgaaaaatttcaggaccacagaactccacctactgaagggaattctgcttgagagaataagattgagagagtaagattttctgtctgttagagaaaattgcttatgtatgtcttattctgaatttttttaaaaaaatcaatataagcctactactctgtgtgatgagtttctgttgtttgatgttaggggggcagctgttctgagagtaataatttaatgggagatatttttaccagagaattttgtttggggaccgaccttctatttgtgactcatagaaagaacatgctttcactccattattttctgctctactgtggtagttgtgaatgccatgtagcaaattcttaactactcctgaataactaaatggtatgttctgtaatattatttctagtattaattgattttccaaagcatgtatttccatttttaatgtttggtggaagagcctccctcctttttagcagatgatctcacgccaaatagttatattttaggatggtacagaaatagtatctaagatgcagacttgtaatgttttagtgatttttcatggcagtgtgccttccacttctgaggtcaggtctacctgattctccccctcttccttctttccttccttaatgagtcaattcctgtctgtgcttgtatcataccttcctcaggaggtacaaaaaaattggttacctggaatgtatatttaaatgtctttctaattttcaaatcaccataagcttgtaagcatgtagccatttttatgaaattgtgtaacatgttcattaaaagtcaaagactgtttactgtagaatttacattttgatttttaaaaagtatagtaaataaatgatcctaaagaaaaagagcctattgatagtttttaaaccttcatttttataatgtcccaatggacttttttttcctgaatgagtttaaagttcagtcgttggcatcataaaccttaatatgcaaaggatttgttttaatagcaatatttactttttgctcatatttgtctagtgttaaagataatttgcctgttattcatggtaggctataaatcttttacacacttgaaaatttgtggcttcatttatgagacagaagacaaaaacttttgagatgatttttagacccattaatccattagtgctcagagatttacagaatgtatccaatgaaacaatgactataaacacgaagtatgcaacgtgattagttcccttaacactaactagaacttttatgtttaactccccagatactacttgaaacttttttaccctttgtcatcctaatactcattataatagctctcattaattggtgtatctcccagtgggttaatttgcagataccagcgatgccatccttgtgctaactctaatgcaaattgatatttagagtcttcaaaattgaaaacaaaaaaagctctgtaacaaaaaagacaaactttgctggttttttttttttcttgagagattgagatatagcaagattctgagagagaagaaaacaggccaaaaaaattcacaaaaactagtgtaggctaataaactgatgtgaaaatttctcaatttacagcacttgacaggtgctaaaagaaaagcatctttaattttaatgtgttgttaggacctctttagagagactgtacaagttattaacaaggtcctctgagacaggagacgggtaattaacaagacctatggagatatagtttaggtaattaacgagctcttaggcactggacactggataacacgtagcgagtccaatacttaaagagaacaagttgttatgatatgatcaaatataagatacagcatgtaagccctcttgaggtttctgataggaaagtagtaagattgtattccagtgaccccagtgcactgactattgtaaatcagcatgtaaggtttttggtttaacttttaaggtagcatttgagagaattatttttaattgttgttacatgtagattaataatctttgctaattgccattaatgaacatgtgtattttgagaaaaatgcattggaagcacatcagttgtatgattctaaattgtcttaaacatttattttcagtttattttttacctgtgacttgtcggctaaaattgcctattgcaaattaaccttgctttccttgtctactttaaaacagtcaggatctaggccagcgaggagatgtggccctggcaccagtttggtttttacatgttatgcccaggttcctccagtcatgcccctatgctaccttcaagtctgagattttatattcccaacttcaaatatttggtccagttatttcctgtgtaaatttgaaatttctgaagtatgaatcttgagttttggctcagaaaattcccacattcagcaaacatttattaagaacatgttatactctaaaggttaagaatataaagaaggcccttgcgaggctcctgattcattctgttacctgctgtctcagtggtgctactctagcccatcaggatgatttttttctgaatttcagctctgaaaatcaaatgatattttcattattatttttggaatatttgctgtatataaggaaatcatattgttgagatataaatcctgctctttgtgctcatagaaaaaggtgtgtaaatatcaggtctgaatttcatattaagggttggacattgtatagacactggggaaccatgaaaatgtttaagttggtttgtggtatgattgaattaatgtcttctatcatgaagtagctgttgaggacagaggatgggaaagggaagaaggacttgagacagggaaactagttaggaagttaatataattgttttagtgagagttgatggaggtcatttggcagtgaggagggagaagaagggaacatctttgagaaatatttacccattatgggacttacccattctgcttttgggtaggggggtattggggggactggtaagggagaagagacaataaaaactattccaatggtatgttttcagctggtgtcttaagtttaatgaaatgtaacatttttaaaacccatttaatttagtacaacaatgtcaggtctatagtctttgaatcaaacttgggattgtagtcttgatagaaaggtttgaattttttctttttgtttttttaatgaggtgctatattattttagttttttttttagagactaggaattaggtgttttgaattgtttgagactagcaagttagcatgaaaacaatagcagcttttgaaagtttgttttttagcactgaaacactttggcttctttgaacacaagagtggaagtttcagtaactggttgtgaaagtatgcatttaaagtgtttctttcaccttagcattgacattactaaatatatttctctcaggtggttttggcttgaccaaagcttgtctctgttggacactttttgttagtttctcactaagaggataacttctatttcttacataattagccctcacttctgtggacactacttttccaggcttctatgtttagaacatttccagttgggccactatgatcacctcatctgtgattacttttttcccatgacaataatgctttaacttttgaaatacaggtagcattcctgtatatttaatttatggtggtacagttaccttgtagcggaggtgttttaaatagctgctggtgatacaaattaactatgaagtgatttttcttacctgcatgtaactggtatctaagactattaggatccagacatttgacatttatctctttgaacttatattttaaggattaattcttggtctttgacatgatatatttaatatatttctatgtaataaatacttataaatattaaaatcttatatatttaatatattatacaccaaacaaaatgtctttatgtattttatatatttaagcttagaaatcttggataaaagtactgataccacttaaaaagcaattagttgaatcagcttggccttcttagagtataccttaattcaaattgctattaagaaaaaactgtttcacaaatgttgtgtgtaaagctctgctagggctggagaggtatgggggatgacagtcctagccacaccagctatggagagggatatgtaagaaataacctataatcaaagcagaataaactgtgttaaacagaagtacatggagtttactgtggaaaggtagatgaaaagagcagttcagtctactggaaattgggaagtgcttcttcaatggggagaactttgagcttgatcttgaccatggaacatcattttgtaagttggggcatgactagatagacaactctgttttagtaaacggcaataaagctctttttgaaaattattagataagttttgaagggataatttataaaaagtgactaaatactattatatcattagctgtttattaacagcttagtaattttaccatttcttttctagttggagtcatggagctatattctatgtcattccctgactggtaggttcctgaggaagtatgtttgctgctttaggctaccaaggagccaattagcgggtgtgccgcagcagcagctctgcatgaagtataatgaactctttgttacagagcctggtatgggaatgggggtgttccagttaatcacatattttgttttctagaagtatacaatgcatttgtttcatagagactttttatcttcaaagaaattaaatgctgcaaataattaaaaatgaaaatcatactgaacataatttaatatttgattcagaaagtacatttgattcacttctttcagtgaaaggttttacagtataacatgaaaacattgaaatactaataataggatattctgaagggagtataggataagtattaagagttcagatttaggagtcaggtctgcgtttgagtctctgttagccgcgtggccttacttaacctttctacacctcatttttccaactgtaaaatggagataataaccttggtgtaggacagattaaataatgtcttgtacaaaaagtgctgagggtagtgttttacacatggtgcatccagaaacgatagcccttgctaggatcttaatatacagcatctagagaatacttaacaattgctttaaataaattaggtggaatttttttccaagtaataatatcttctcaacttaaaaaaaaacttaaataaaagtagaatttagaagcttctggttttcaccaactgataaaggacctacatttggcaggaagtaataaacttgatggtttttctagtatctttcaagacatatattcagcaataatctttgatgagataaaactaaaaccacattgaaattaagtaaaagtattctctgtattaagtagaaaatttataaggcaaagctattatggtgaatattgatgtaaagtcttatgttcagaaattctttcatagtactaataaggatattgcaggatagatatctaagctgtggctttccattaaggcatggtgacaatttcataaactcagatggctgagctcaaattagattgttaaagaaggcagttcagactgtgatagtaagaaagataaaggctgcttattgaaaactcctcagaacatttcagtcccctttggtaaaaagggcacttgccttaggaaattcacacaggcactggtgtctctcttccaaccaagattcggaggttggctcttttatttctgtgtcagagcaggtgccctctttgtttttcatcaagagtataaaattctactctagtagtctctgaattcaaggttctttaatatatcagaaataatattcattgtatttttaatgttttgtcatcctggttttaaaaaataaatattcttcacttaacagaaaaaaatacataaccaaaatttgaatgttaagtattgttagactgtcgtcacgtcattttatggaatagtatctcttgtacttacagagatggataagatcttataatggcaactctttgtgcctcccatctttagactaccagacagtgtatattagggtgacattctaagattcagatgtttatttttgaatttgataagggatggaaatttttgcttttccttggttatatgtattattgctgttctttctctgtgagggttatgttgatactctgatacaaaggatgcacaaagcaaagtctctgtctttaaaagtataagcaggtagatatagaatgtgtaattaattgtcctagttgtaaataactgtcctgggtggtacagttggtaagtgctgatagagataaaaattatagattagatggataaggttaggcagtctaggcattacagaaaaggtagaactaaaagtctcgaaggatggatctgtgaagacagagaggtaaagataaatgagaaaaggtagagaggtaaaaatgaatgtgtgaagtggttctcagggacctaacctgcctaaaactgttaagggttagaagtagtagtgaagatgtgaccttattagtatgaatttagcataccagaatgaagaatttgcatctaattctatagaatgtatgaagagttttccatatatgactgatgtgatgaaaatactattttaggaaaactcagagaacagtgccattgctgttatatacgtaataatgccggaatcggaagaggtgcacatgaactcagaaaaactgcgtttctaagtgtgattttagattccgaacaaaaacttcttgtagtgaaacattttaatgatgtaacttatagaagcaggacaatagtgaaattattgtggcataagaaatttgcagatattaatgtgtattagaggtacactctttaaatcagtgggcacctgttttagctgttctttgaatagtttattttttttcttcacgcagaaacatttttaaaagctgactgaaagttggataggataatgtacaatttctaataagatcattgtattcatctgttgggggatggccctggaaattttattttacacaaaacaatatattcttttctggcaaaaattttataatttaatagccccactgaaacaaactcttgactgccaagaatgttttaaggctgggcttctcagcttgggttgcagagtggtgaaaatcccccagtcatgccagcagttgcttctaagaagcaagtgtaggagcctgtggcttgcatcacccaactggggggcccctggaagtctggctgccttgatgtccctccttgaagcctctgcagagatggctggggctaggaaagtgggtgcttgctggccaggggcttcattgcaggctgttcttaaacacctgaggccttcctggtaaccagaggacaccgtgacttctccaaaacatagctttgtcataggcccacacagagccagcttgggatgcttttggccagggtgttgtgggccgtctgtcttttttcacctgcttcacagggaccagggatgccttgcttgcaccctcatggaagagtcacatctctccacattatccttacactccctccttgcaggaaaagcttgatcaagactgctgggtctgtcttgatcacgtagacaggcagagcctgtgctgggtttggccctgcaggtgccttgctgtcatcactcctgcccactgttttgctgctaaaatgaacaggacttgtttacacacacacacacacacacacacacacacacacacacacacgatgatgatgactaatggatacgtagaaggtggcgggcaagggtctactcaggggaacagaccaaacgcaacacagcttcccaaagtgacacatttcctaaagatacagggagaaaatactcattttatatcaagagacacatgattatattagtaaaatgcaaaaattcatctgagtttttaacttgagatgtcaaattgtatgcttgttgttggatttattcttatgtattagaatattaaagagaaaaaagggtgagaagcttagttttaaaggaatggagaacttttggaatccataggctttatgttgagatttgtgggttgtttgactgtctttgaaataattatttctattctattctttttttttttttttttaagacagagtctcactctgttgcccaggctggagtgcagtggcgtgatctcagctcactgcagcctccgtctcccaggttcaggcaatcctcctgcctcagcctcctgagtagctgggattatagacacatgccaccacatccggctaagttttgtattttttagtagagacagggtttcaccatgttggccaggctggtcttgaactcctgacctcaagtgatccgcctgcctcctcccagagtgctgaaattacaggcgtgagcccctatttctgttctttaccaggagaaatgtgtaagttagacttgattgactattataatagtcaaaccaagccttaatttcattgatgtctttaaatcctcaagttctaggactttcaccaacaacatattcattattattcattatggaaaagcagctaggtctgaatttgctgtccgtgatctttggtgtcactgaccacaatttttaattgtcttgcctctgagagctcataaaagataccccatgagaatattaataagtaaattactgttaatccccatagacatttatgtattaggttctgttttgtcatcgaggttttggtgtacatgcccagtcccaggagacagaatgtagtcttttcatctgtaatatcattaatttgatttggtactgagttttttgcttttttctaaaaagaaagaaaaaatattgagtttcgtcttgcctcttaaggcttatttgcatgtataatgaacgtaattggaatgtgctaaagattccaatgaaatctctttagtggaatctctttgggcacttcacttttttagagctttggaaagagcattattaaagaacattaaaaaacaaaaacttcaacatgtaacctctgtggaataaacgttttcaggatttaccagaaaaatctctaattaatctgtattgtgtcaaatacctatcctggtagacctagttggtatactcgataaactggctaattgaattgattctgttggcagtccaccagtttgaaaatgtgttttaattcctattgacttaaatatgagaataattcttcgtatcttaaaaagaactgaaaaacactccactaatgtatcatcaggtatagatataagtaatctttcttattcaggaagattatttcttccactctttggggacttggtatcttgttggtggaacttatattgccctaacatagatgtactcagtcaactcaccccggtttttacacatttttattaagtactggttattaatgtattcagcatacttttgttaggaatttttcatgctggcactgtgtcagatgctaagaatgaaaagaggaatgagatatggttccttcctttaagtggcttgcagtagaaagggaggggatccaggggtaagatagatacacagaagcaaacttttataccatatatttgaaaagcacttttgtcaaacaaaccattttcatactcatttcttttaaccctcttttaattctacgaaatagatggtagcatttctgtttcttaatttgaaatttagagcagtgaagtagattgttccttggcattaggggatgggcaataagtctggaaaggtaaattggataaaatccagtggactttgaaagccagtctaagaaattttgtcattattcaggaggaggttagaggtcaaaagttttttgacagacgaataatgaggttagacttgagcttgagaacgccatattcagtatgcataggctggattggacaaggagggatgggcagagactgtgaagaggctgttgcagtagtgtcagcagaagacagtttggtcttatggtcagaaaggtagcagtaaaaatgagcagggaggaaacgatgagagttctgtggcagaggctgaatggtgagaacatggcagtttatttgtgaggcatgtaagctgaagactggagtgaagggtgtctctgaggcttcaccttcggtgcgcaggagattggtggtatgagtaggaagaaaaccagacagaactgttctaaaagacatgattggtctttcagggacaggtaggatattcgatctaagattttgatcagacatttgtaagcatgacattataaagggtaaagagattggtagttgaaaagatttactactcctccatccatatagggatggtagttggtggtgagagaatatgaaatctccgaggtagagcggaaaaggcctgaaaacaaccttaagaaatatccagtgtttcccacctaagggtgaagaggaagataacaaggaaaaggagtgattggaaatataggacaaaagttaggctaccagatagcaggaagagtgagtttcaaaaaggagcacccatttggtatcacatggagctgagaggttaaagagtgaggtgattttagtgaaaatagttttttggtgaccttcgtcaaagaagcaatgagtattggtggtgggagttgtgtttcagattaaagaatatgaatgagtcaaggtaacaaagtcagcaagggctacttggtagggtttagagattggcaaaataaaaatggtagaatgtccaagagataatggactgtcgacgagtcctagtgagtaaatacaggtggattaggagacaactgggatgatagtgggagtgcaccagcaggtctctaggagagagggagtgtcagaggtgagattgatcagatgggattctgattgtatgagattttatggtataagattttattgattactgttcctttggaaacatgttcagagaaattcagtttgtgaaaatgtcttataaattgtaaggcaaaatgtaaatatgaggtggtattattcaaatccaagtcacttgaagtaattacaccattttacatactgcaggagcaatgaatctttaaaaatgcaatcctaaatggaaaataattttgaacacaagtactccagctctgtgaattggaaaagcatattgttaaatgaaggccaggagtttgtgtgtgtgtgtatgtgtaggcagggtgggttgggggaggctagcagtgaattatcatttacaaagtaagaagaggctatgcatattttgaaaaaaaaaagttaaaataagtagttatggagcatacgccagaaattgaagggcaaaggaaagtataggtaattcatatgagtaattatttttctttggttctttctttctttctaatagagaaatagaacaaacctttgtcctaaattattttacattattaagtgaatggtttatggcatttattttatattcatgtatcagttaagaacctaataggaaacaaatgacacactcaaaacgaataattgagggaagtttagtggggaggtgtctgcagggttaaggacatcaagaaggaatagtacagcaccagggaccagcattgcatgcttagctgcagctgtggctgtaggtagagatgctactgcagcccagcagggaggcaggggagcggtgctgggatggggctgggggaaggggagtaaataccctgcctcctatgctttcagtgctccatcctcttggaggtgcctcccggtggcagaacataataagccagtgggcaagcccaggtgatacactctccagaggtcagtatcctggggtgcagtgagggtcagagtggagcaggaggggcaaacagaaaatcaagagcacagttatttccaaacctgttgcatttcagccattattctgtctcttttagactaaatctaagacttttctgaatcatttctgattggaagaagcctcatgaaattgccctggactcattgaaaccagccaacagtgagctcacagtagaactgacagtttagagcagctctgtggaagaagcagagtttatgactaaagagtttggactgtggagtggggctgcctttctttcatcctaactgggccacttactaactgtgttaccttgcaccttaccatctctgtgcccatttcctcatctgtaaatgaggataaatagagcactcaggtcataggattgttacaaggattaagtgagttaacatgtaaagtgctcagaaagttaccatggttaaagtccaataaatacaattgcttttaggatgtttttctatgcttcattatcgatgaaatacacggggtgtttctcttttcctccttttagactcactgaagatttttgttatattatgtcacagttctcagtatatacctttgtcatgaaagtgaagccccaagtctcttttttttttttttctttgaggcagagtctcgctccttcccccaggttggagtgcagtggcgcgatctcggctcactgcaagctctgcctcccgggttcatgccattctcttgcctcagcctcccgagtagctaggactacaggcgcctgccaccacgcccggctaatttttttttgtatttttagtagagacggggtttcaccgtgttagccaggatggtctcgatctcctgacctcgtgatctgcctgtctcggcctcccaaagtgctgggattacaggcatgagccaccatgcccagccgtgaatccccaagtctctagagcccacttggttaagatcaataggacacactccttggaaaatagttaatgtcagttcttctgtgataatttgaagttatacttatttgccatacacaataaggagttgactggcgtttgagaaagttactcctgtcttgccccttccctcttcctcctcttccctcctgccagccaggtggcacacctcctggatttcacatttaatttgaattcacttcttaaatacaaaatgagtcaaggtgtaggccaaaatggactttgctttgtaattccagcagtagtggggtttggaaagagatattatggaaggtgtaataatactctaaatacttaaaaatacttatttttaaatgccctccaaagagcttgttgttatgtgacttctcattgaaagatttaaaatcctagaaccaggaatttatggtttacattgtcttataaaagcactcttaaccagttttaatagatctttgttcttatgtagggtttttttttttaatctttgcaagcactgtacactttttactctgaatagtttctcctccttaggtattcttgttccaaaagaatatatatgtttaagaaagagaaacaaacaaaaacaaaaaaacaaaaaaaacccactttgatctctgccacatgccgtagtgattactgtggtgaacagtttttttgctctaatgattgagttattttctggccgatatatggaaggttagtccatagcacaaattaaaggacagtttcaagacctcactgatttatttcttatctctttacttattatttattttaactttgaggtaaattaacaagtgatattgtagaagagatactagtgattcctagaaatatttgaaaacatttcaaattttagaattacagtttactggggaaaattctttaatatttggaaatatctcaaagtaaaactgttgatgcttttgcataaaaacttcagaatgttaaggtaagtcattttatttaaaataacttttaaaatactaatttaaaatgtttaaattctgtagtttcattttacatagactcctttttaaatgtgagtgtatctaggtttattttgcacctgattaaaaacaccattttccttaacctgtcagcagctcggctgagcagtcagaccggattattcgatatcttgtctgacatgaggacggcagtccaaagagaaagatatcacaaattggtgccacacttcaataaatagagacattttatttttcaccaagctaattcaatccagttcagttaactcttttttccccattaaggacagatcaaaaaaggcagccatgaatgactgagttcgtcaagtgtttgacacgtcagtgtgtgaatataaagcagaccacaagggaggggttctgcctttagacttcagacaatacccagtacaagagcctctcactcagatctgcactgtggggagctggagagagtggctcagatcactcaggtagaatgggaagtagccgggcttgccgcactgcaaacccttccccttagagttgcgacattttcagcattcttaggaattctcaggcatttttgagcagccattgagttgcattttagttttataagctgtgattggctactacatatggttagttttgtgattttgataaaatctttgtcctaaatgttgttccttgaaaacccttattgcaataagtataataccgatatttctgtttcttagttcagtgattttttcctgagacatatactgaaatttgtatagtcataatactgttcaatctcaaggatacaatgagatggattatgccaccaaatataaaatgtttaaatatttacaagaaaagattaacattgtccaaagcttacctcctgctctacggattgggcctgaggaatgcgtcatcagaacctttatgggctcctgccgaccctgctgcctcgctgccagtctcctccgtgtcctgcagcgacactactgtctgacagccccaggccacgccatatgtttgcagagccctccttgtctagcctgccaaacatatccttcatgtcattttaaatcctgctttttccatgaattaggcattccttgactaattgctgtgatagaacatttcatttctctatgaggtctaaaaatttaattatccggagtgctctcccccacctcccacaagtacatctctaccgtgtgccttcttgaaatgcaacattgttattctctgattcatctatgtggcctatatgttcagggcttccgcagtgcagccagtgctcactaagtaaatctgtatacagggaatggggctagggctgtgtatcataggaggacgcagtctagagccacacagctccaccagctactaacagaatgaccacacgcaagttacctaacctctctgtgacttgtttccttacctttaaaatgaagatgtggaagatactgggccgtaagactaccgtaaggatcatgaagattaaatgagttaattttggtaaagtgcttagaatagcatctggcacacattaagtgctatgtaaaagtttatgaaataattatttcattattttatttatgaaataatgttctatctggtagtcacagtgctaagtgttttccatgtagttaactcattgaatcttcacaggagtcttatgtggtagatactgttgccatctccattttacagatgagggaaccaagacataatcaaagttaggtaacttgctcaaggtcacagggcagaaacaggatttgaattcacaccacctggctccagccacttctctgcttgcaagcaccttgtatgctgtcgggcctgagtgtatatcattttgttttttagaatatcccagtcagatgggagatgtagcagaatgtgtttcttgacctattagaaaacatgctgtgagataatggggtaggagagattaatcccactggaccccctgttggctaccttggatcgaaaatcagagaggatggaaaccacatgtgttagcagctgctaccacggcactctaggctaaggtggactatgtgagaatgctttttggatttagtttttgtcttttaagccactcctttgtgggctcttgatgctttgctggtatagtgacttgagtccaggaccatgcagaataccataaagatgttaagaaaatgtgccagccacacaggcctttaactggtgctttgtaggtttttaaaacatgtttcactctctctacatgcaacccagctctgctgaaatactcaatttatcctcaggagttctagttagaaaaggcgaacaatcacttctggaagctagtacttcaaatcttagtcatagccagtgaaatcttggttacatgggaaactctctggaggtggttgtacatgtgtgccctgtacatcttagagcgtaggatttgtacacgtaattacagatactttaccaacattatatccagtgtccagactttttgtcacacaatcaaaagttttaaaagtaaatttcttaaatcttcaaaggatgccagttattttactggcaagggacagataatgaaaacatacatattttacagttgttgttttgtgcatggaataaaaaggttcttaggacactaatgctttgtgaaggttttaaaggctaatacctttaagtgctgggtaaaaattaaacttgaatagcaccgatgaaatatttactcatcagatggctttgaagtttagcgtcttttggttgcagtcccatctaatggacatgtttcaaagaagaaaatagttatagcattcagctgtgatgttttcttctctgcatgggagaaatctgtgttgttttgattcgtttcagtatttaaattttcaagactagctacttagaaatcacattaacgagagaaatgtttcccacaattctgaatttattcttattgatagggtaatgtttgaaagctgagttttctaacacttatggcatttttaaacagattgctttaactcttttattctataatctttccaacctaaatttacttaattctccctagttttatatcagagggcctaaggtgagtgactgtgtgtaaatataatgggaaatctctcacacaaattagttttgcaaaatatcttgctggataaaagtgctatgtttaaagttgtttagaaacttcctatttcattcttcagttctgataactaaaaagttttccttcaaagtttgaaattgtaatgatgctttaagaatgttggggaaatactggatttttttctacttcttggattaaatttcactcctctgaataatgtagggctttagaaatttgtattacaatgttggttaaaatttttctatttttatgtttcctcccacatgagttatgacacttttaacatttgtttgtgttttattagttttcatatgagtccaacaagcaatgaagacctcaggaaaatcccggtaagttgctgaaggggttagagggttgtcaaagagtaagctggtctttttctctggcacacatttctaaaaatgcctttgtcttcttgccttctgcctcacttacctaagaattgtagcttagcgtagtaattttaggagaaagaaagaaagtaaaatacaatctttgcctttaatatacaatagggtgtgactcgtatgatctatgaaagttcaagcaaaattggttataattgaagccaatttagaatatacatattttgtttacagacttttgaaattaatatgcaagctgtatgtcagggtcaaatttgtggttatgaaataagagcacgtagaaaagactattttttgttgttgttgggacaaggattgaagaaagaataaagctgcttgttaacattcaacaatagaaaagcatcctggcaggagagccagataaccaggaaagtatttgaaagaacaaatactttaggacacttatctttctcgtcagaacaaaaccaaatatgttaacaggattggtagcgaccacctaaatcaactcacgtattttgcaaggattattcagataatctgaactttattgtagtatttgaagtccagtatttaatctctgttcagagttccattgcatctgcaatcaattctaactatattaaacgtagagaataaattactttgccaaaatatgggcaaacgttcttggtagaaaactaaattctcactgaataacagaaatagaggctttattccaagacactggtggttgctgtttcaaccatctgtccttgatgtgtgcgatccagatgtatagtaagaatttttttaggcaatcccatatcacatatcactattttttaggatgtgacatggctagaagaagctaaggtgggtttagggtttattttctaaaccattctaaatgcagttgtttatctttaaaattgtggaaactgttacagaagcacaggactttgtactgtgtttttgctgttttatttaaacgattcgtaagttttgatgttttataaattctcaagtctttataatatggcagtctggcgagaaatgtgagaaaatatgaagtcagcctttgatcagatagtaaaatgaattctatcaggcggttacttaatctcaaacaaaatgcaacatcaaaaaaatcgatttaatgtgtagctattgtttattaagtaaccttaattacaatttcgattgcttgtaaatgtacttttccaaatcttgtaatttattgctgtagaagcatccttagaattctttaaagaaataaaatgtgaaaattgttttagttaaaggatttaaaggtgataaaagaatccttgatgtgtgattatttttctctggaatactaactattctaaatgacagttaaaggattactaggtgttgttaatttactgcaagatacaattaagaggaggaagcgcatcttcgtactgatcatgattgaagaaaagcattcgaacaatttttatgttgaagattataagatgtttgaagtaatttacattaagttctccaataatagccatccaccaagttattttttctccctctggacatagtattttgtaattaagtttgtatgtcttatatgctagtgccaacacctgtctgtgaaagcacagtgtttaaacaggagcagtagccagttgaaagggcagtgtgagctctttaaggcctaattaagaactgaaagggagatgaagggagtaggacaaaagatgtgaaagtagctgagatgatattcccagagcaaagttcctcattagaacaataatgagatgatcagagaatgccaagccttcatttttttttctctctctcctctagttgccttggatgtcagttagtaccccaccaatatttggttaccaggacaacctttctttaaatcttcagttattttgagtcttgataatttgcttttgtttaaatttaaatattgtaaaaaatgtacatttcctagtttaaaaggctagactgtgtaaagcaaaaatagatcactagcagttctcaaaatcttatgcaaaactgtattatttaaaattctgggttagaaaacttcatgtagtaattctaatattttcttaccagtccacatcttctatgtctgcatatggacatttttaacagaggtggagtagaaatgagaaaaggttggttgtaaaaggggaagagagaagaaaaatttacattaaatttcaaaataagaaaacatcttaaaaacataagtgctgtctgtatggagtactgtaagaaaaaatattgagcactttggagtaaccattgtaagttgcatttggtctttgccagtttagagagttatgaattttgcaagtttttgcaagaataatctttcgaaaaaataatttttatatttacctgagagttttcctctctaaaaaaataatttttgtaatgagcatatgttttaattttctattgtttatattacttaatcattattttatttggagttatatcaacaaacagaaatatatatatatatgtggagtatatcagtcaatttaagaatctcatgcctaaaattagaaggtttacattgttttcaaatatcagataaaatctggaactcagcatgaaactgtttttaattattttatattcttttccagaatataattcatagtacatatgtttctaagatgttttcctgcctagaaacttgatgctaaaatttgaggtgaaattttcacataaaaggacaaacggaaaatttattgaaaaggccagaaatgtatttccaggaaatctgtctacacattagtgttagattgttgtaaggaaaaaaaaaataatccaaataacatatctgtgtattctagagtatggctataaagtatgaccagtagtctgaaataataattgattattttgaaagattaaactattaatttatatcatggctttaatttatatcaaaacacaaatttttgaaacgtttttcatcttcagtgtctttagagaaatgttacaaaaaatttttaactacattaactggtaatagtgttaaatataacagtgcacttttattttaactatttcatagcttaattagtttggagaaatcagtttatatatgtgtaattttattaagattagagagacttgaatagatgcttttattatgttaaataaagaaaaagcataaagcagtcaactaatcagtaatgaatcccatttagcttcctttcattaatccctgcaattctcacaagaacatgaatttctcagtaaatgttttattagaaaagtgaaatcacattagttagagtttattagtttttaaagtggggtttagaaaaatcacttggtataccagacaattttagagttgaaagggaccatggagaacatctcatctatcagataaggaaagtgagacccaagttgctttctctctcaaatttatgcagaattactcgagttgaagtaagacactttagcttatttttaagaaatttcaaaagtataccgaactctacactatgtcttctctttactgtagaaaacggcttaacataatcttttataagaatgtaattaatacttatgtatctccaaactatatattatgaccaattaaactagtaactacgtgcatgagagtgtgtgtgtgtgtgtgcgcatgtgtgtagacttataaaagattaattgatctgagagaggagggagaagtaaaacaacacttatctctagaattgtcctttaatggttttagaacaatatttgaaatgtttttaaggatgaaggaaatatgactgaaacttacatctgtttccagtttctaatgctaaaataaactaagttgttttagacatattttatagaatttaaactcacttccctttaatatcctctctattcattcttgctaactctggtctttcatatttcaatagccctatacctaatcttagcccctccaaatgattccactgttgccattttacttttcctggaacatagctttaatcatatcctttctctgtttagaaaccttcagtggcttcctattttccatagcaaaagtctaaaaattctttatactaccattcagcattcttggtggtctatttcaaaccttccatttcggcccctgtctgctcgctgtcctgtacagtattttccagccatgctctacagagtacctgttattggattacctgttggccactatgccttgagccttgtttccttctttgaacaagcagagttcactgcttgaaatgccccattacgcatttctgcctgcaaactcttgaaggcctagcgcaagctgtatcttctccacaaagcctgagagattctatgaaattggaaaagtttttcagtcctgaatgttttcacttatcctggagaagtgggtgtgcttcaatgacccaagcatcaaattggtatctgtactctagcttctctttctctggtctggtaaagtcctggttccttgggctgagaggctggggaagtggtgagggccagtgaaaagttaaactttggcttttctcatgaacacccccaaatacatagcactattaaagtagatcctgaaaacagggaaggacagtttaattcttattgggggtgggggtcattctgcattcaccagtccccattccccatcctccactgaatagattagatagtattccttaacagcaagaaaaccaatttcctcaatattttagttaagtttccttaaagccaaatggaaatgttttaaaagatagtgatgaaaattattttaaattgttgggcttaatgagagaactatgatttaaaaagaataaaaaattgcttagttgtaattgggcattatgttttacagaatgaaaactcttaatgctatacactataaataaaagattatgttacagggccttgattaaattcctgagaaatatttttctttcacttttgatataacattaatattagaatgctttgtaataacagtgaattaataagtgtcttttaaaaaagatttttggttatatttatgcttttgcctaaaaagaatttttgtcaatagaataaagttaagtaaatagatgaaatgggagagaatgcaaatatactaaccgtagtattaatatggttgaactcttgagtttcctgataaccagggtcaaaaagggaaagaagataaattagatattattataggagaaagaaatagaccagttactcaggggaggaaaagttctgcctgtttctaaattaaaacagaagttactcacatggggcttcctgtaaggataatctttgatttaattccgagtgcttccattttcatagcaaattagaaaagatttttgctgtaaccatcttcactaagaagccaaacatataacattaaatcacagttcagtggaagcagtttcataaggacacaagtccaagtgtatagttttcagttacttcttacagttcctctgagttaacttttagaaatctttagttttcatctattttagttgtatttattatagaatatttcatctcttaatgtaatcttacatgatataaccagtctcagatattaggaaattgcccacaatgttagaaagggttttaggatttagagttatagtcaaaactttggtgcatctgccctagttcttgcctcaggactggctagccaatttgtgaactgtcacattcactttaagcaaggctagcgaaaaacttcatcagggtttgaaaaacaaaaagtcgaagttccaggtaattcttaatgtttgtcccagatgttatatctatgaaagtgacagtctttatcctgttctaggacagcaacccctttgatgccactgcagggtatcgtagtctgacctatgaagaggttctacaggagctggtgaaacacaaagaactccttaggaggaaagacacccacatccgggaactcgaggactacatcgacaacctccttgtaagggtaatggaagaaacgcccagtattctcagagtgccgtatgaaccatccaggaaagctggcaaattctctaacagttaataaagccaattgtattgtattgataattggacaaagagagagaaagaaagaaggaaggaaggaaaaacttgttactgaaagagactacactatcaggtttcattacatattctcctttattgtgaagagtagttttacctgtaaatattagcagggactatcaagagtgacctttgaagcaagctaaatcatttaaatgtttaaattgaaaatgggccagattctcaatgaataagtggttccttaggactcactcaggtgctggtactgacccactaatctgccataggcccagaaatatcttcagaagtacgtgagttgttcctcaggaatagatttttcataaagcagaattgatcctgtggctggtttctcagaaatcagtttgtagaaatatttagcttcaggaatactgctcgttataaacactactaaaaaaacagtttatattttatatacacatatgtacatgaatatatatatattcatgtatcttgtatataaaatataggcatatacctcatatatacatgtgtttttagaacatttagaaacaattgattgcctctaaagttaggctaccaatttcttgatttgaaaatgtgtgtgctctattgatgcaagacaagtcatccttcctactgtcatggtttgttatagagaagctgcttcaaatcactcttgactacatggaccttggtttcaaagtgagctgctatatattattctagcatcaaagtttttctctttccccaaaagtgatgatctcaagtccttttttaaagaatgacaaattttaggagacttcattaacttcataacagcatgaatttatttgaattaattaacatttgagtttgtttaaggtataagcagaagataagctaatatagcttgttttgttgaaattctgcatgcctttaaatcactagcaaagcaaatattataaagttatatctgaaaataattgtgggaagtatgtgattgcctggtgtgtctgataacccaaagcagcgggcagattccaggaatgaagaattaggcttggtttcaggttacataaataatagagcagatggttgcctttgggtcttgaaccaaaataagacttactaaaggaagagtgagtttttagaagagaactttacgagcgtgacattatgcattactccacatccaccctttaagaattgatttattacaaaattatgttctattttaaagtccactcccccaaaatactgatttcttccatggattatttttatatgatttgtacaaattttttctgaaatttaaattgacaagcaatgttataaaaatattgctaatcttctgcttatttttcagcctttaaagtctgaaatactataaaacactgagagtatctatgtctttctgaatttaaaatgaaaattcatgtccatatggagacttacatattccccaatctttccatgaattgcatttttttctaatacttatctctgttaagactccattgaaagttaaacaaaaagccgatataatagtttgggttttttttttttgcttattttagtattttgaatcagagaatacttggccaagctcgtatttgtaaactaaaaccccttgttatttgtatcttctgcatttcagttttactgtaagaacatacattttgaaattatgaacatttttttcataaaaattaaatgctttaagaaatggagaaggaaaaatagcttttatcaatttttttctcctcaagattctgtaataaacctcaaagtctggtgtagaatggtattttcccgtttgaggtcttggtagttttttttttttttttaaacatggtgccacttttaattaactaaatgttacaaaattctcagcatttgtttttgtctggtagtattattgagtcttttcatacacttcttaaaatgtgaaaatctatgttttcagtattatgacagtatctgcagatactataataatatgctttggccaaatttgctgtttatagagtgaaccaagatgtcagttttgtattggggatatgttttacataaatagaactcatttaaaagtatggttcaagtactgctcttctttttatggggaaattgatttttaaggagcgattcttttcctatataaaagctattgaggcttagctttattcatacatgagtgatttggttataactcaatcaaaatttttatctttaaatctgagacaagtattatatttaaaactagatctattaatacattcatcactgcctgaaaatttgctgttctaatgtttgtgaattttcactcattacctagagtaaacttattgcatattttcataatcagtcaaaataataaaactaaaaacaaaaagtaaaaattagttcccaagtaaatatatcagtgtttcctgtgtttgggcagaagtgcaaagtagttttaatttctcacgttgtagaaaaagaggccaaaaaggtcaccttagtttatttttccaaaacataactttaggtattctaatgtattttgttagttgcttagaaatggaaataaaatatatgtgcttattaaataatgcacagtacactagattatagagtttatttttgcttttatgctttaaagaatgcatgcccaaaacactactaccaacaagaggattttttaaaatcacagaattgatatttatctcaagactatcttaagctaatgtacttctgttacataattaaactatttctgctattatttttaaagcagtattattttataaccaattctaaaattcagctttaaaaatattgaacataccttcctaccacttacgcttcaagtttcatttattgaataccagggtcatatcttagaattgtatataaaacaacatgtaacccattcatgaaaaacgtttttaagtattgctttttgctgctatgttctgcattgagcctagttttgccattgtcccctgaatgtagtattatctatagattatacataactacatctattgcttttggtggtaaatcaagatttagttgtaattttccagctgtgaaaatgttgccttgtatttaaaagggtttcatgaatggaaacctaagtaaaactaagctcattagtgacagacttgttttcttcttgttattcctccagcaactccctcaccaccacgcctccctgcctaccatccccggaagggtgcttattctttaacaaagagaatctaaaaaaaaaaacaaaaaactgttgtctaatatatctacagtaaatgttacactagagcttttattttcctctgtagcttttcagaagaagcaatttaccttggatttgtaaatcaagctgaaacttttttgatgttcatgtactcatatgtcttgtaggtggtaggtgtcacttgtgtgtatgtgtaagtgaagtatgatgcatgctcattcacttggtccctttgaaataagggaaaggatcacagtgctgctgggccatgatggtatgtagaagggtctgtcagcacacatggaaagcccccatttgcacagatgtagaactttaataatccagatgcaatcattggaagtatttaatatgcaattggtagcaccttagctaattaatctgcatatgaagcattttctgatatatttaataagaggtatagaagctcttcaagcattaaaatagagttgatgtttcattccatttgttttatccatcaaaaaatgcactctcacagtggagttgaagtctaatacatgatacatgtgggcctgttagtcttcgaagcttccagatggtttgtgttttgaggtacaaaaaaatgctgcagatctagaaatgcatatatttagcgggtatttgaaagatagaagcattatttataactgaagagtataacacttatcttcttaagtaaatgctctcataacttgtatacatttttgcaggtacaaattcaaaagtatgtaagcattgtataatgtgacaattgtataatttatgtaatctgatgcatgaatcagaatttttatataatatatgattattgacttatagttgattaaagtgtttaaactt

SEQ ID NO: 36497 - DNA, 89298 bp, Homo sapiens
gcacacagccaggggccgcccgggctctcgacgcgccgacggccgggcggacggacggacggacgccgagcgcagtgccccgcggtgagtgcacgcggcccctcccgcccggactcatccccgtcggtccgcgcctcgcagctcaggactcgggggcgctcggacgcaccgacggctcggcggaccctcggacgcgcctcgcgggctgcccgcgcctccacccgcgccgccggtccgaccgggtctcgctctcccggtcccagcgcggggacggcccgcgagcgccgcgacccagtgtacagatgcgggcacagaggccggcgcggggtgggggccaggggtccgcgggcgggttcccccaccccaggtccgcagcttcctccgctctgggtttcacttctcccccctgggccggctcccaccagtcatcccctctggtcccactgcccacccccaccccgaccgcaggaccttgccgcccctccagtccagagggccgggtcaaccccctcggggaaagaagactagagtccctggtctaacactaccccctccatcacccccaagtcacactcaccgccacacacgcactcacacaagcagaagtttctgcacgctctgcattggcgcgcccaccctgcctgtcaccacatcctccctctcccagccccatgctcaccccgccagctcccccaggccagaatctctcacactcatctcacgtccccttagcacacaatgctccacacacacatgccttgcacattggcacccctccgaggcatgcctctagcagacagttgtgtctctgataaacacatgtgcccttactgccctctgacacgcacacacgtccgccacacaggggtagctatcacatgcatatctccatcatatgtatcacacatgtgtctctcacatgcgtgtgctcctcaaatacctggaatcacaaacactgggagtgccacacactgtgagtctcacatacgagtcacagacccccacgacttcacagtcccagcccccctggcactccatgggcagtcctcccctgtcctagggggtggggagccgattttggaggagggaggtggttcctcctgacagaggctgcttaccatgggacctgggtggctgtggggagcatgggggtggctcagcctcaggctgggcctgactcctcacctccgtgcatcctctctcccttcccctgctccagtctccgaaataggggtgccctccctcccttttttgctgccacaaggagttgcccatatcagctttgcagtgatcacttgggccagtcccaagcaggcctgagccagcaggcgtcccctgacaggccaaaaagagaaaaagggaagtcaaacaggatggtttgggtgcttgtgtctaccctgatgcccctgagatgctggtccgggccctcccagagggagccctgatgaattgggtggcagctgagaagtgttccctcagcctggcatggattgggagctggtgtgtgtttgtggctgataggggctctgggccttaacttccccatatgccaaatggggtgaagactccccagcaggaggaagagagggagggggagctactcccctggggtgcacccttgacttcccgccctccccttctgcagctgagctgtgtgatgggggtgagcaggggatgaagtcaaagaatcttattctggaggcacaaacctgccagccccggctgtggctggccctgcatgttttgtttggctctcaccatgttattattattttaaaaaattaattagctgcctgcatttacaaattggcagttttcacgtaaaagtccggatttccgtcttctcttgaaaagtcacaaggtctggtagttcaggatctgcatctcctggctggtgctgcccacccccaacccaggggatggggcaggggcgctgtttggtccccgtccccacctggccctctcatgccttctcagctcctgcctggcctgcgtggcctttgtgcggctgtgactgctgcatgcattgggctgattttgctccattgcccgcctcaagcataggcccaggctggtcctccatgcatggctggggaagccctgggcgggcctcctacccttcgaggccttagtcgttgaagcaatgagtggtgcccagggccctgggccacagggcatctttgtgatggtggcagacacttcctgctaggctgtgggggacggtggtatggggaccccgtgaagcaagagctcatgccagagagcattctccgaggcaggctttattcatcacttttcttcccagatcccgacatccctcctgcagggtggaactcttgcacctatttaagagacggggaaggggaggtagagaaagggcctcccagcaggcaagggggagagctggggttcagcccaggatcttttccctccaaagcaaagctctttgcccctcttactgagccactagtgggaggacttggtctccttggccgtggggggagtgccctgagcccatccacacctcacacgcaataggtgcttcgtaaatgcttggggcatgctgatggtaagtgaaactgggttctctgcagcaaattcgggcctaaggtgaagattgcacagccacttgacctccatctcttgacctcgtgatccgcccgcctcagtctcccaaagtgctgggattacaggtgtgagccaccgtgcccggcccctcctttttttttttttttttaaagacaggatctcgtcctgtctctcaggctggagtgcagtggtgtgatcacagctcactgcagcctcaaactcctgggctcaagtgatcctccagcctcagcctcccaagtagttgggactacagacgcacaccagccagctaattttctattttttgtagagatgaggtctcactttgttactcaggctgatcttgaactcttggcctcaagtgatcctcactcacagcaggtgcaggtgattgggtgtgatgaggagctgctggtggattctggtttggggaggggtggggtctaattgagatcctaaaggtcccttcccccacactgctgctggcagggaacaggctggagggcagctgtggggatccatgcagcttccaggtgagagaagttggggcttggattagggcagtggcagcattggaggtgagagtggtcagatttggactgactttgcaggtggggctgccaggatttcttgatggattggaagtggagtgagtgaaaggggaggccagggtgaggccggctgtcctgcccggtggtggacgtaaacaccatgcatggcttctggtccttagcagccctctgtcatccagtttccttccccaggtccccgagtgtgggtggtgcaggtgtccgtgtggctgcaggcagctctgcctccagggcgccttctgaatgctggggctgcagaggtctaccctcccaatagaccagacagaggcgctgctcctgtatgctacaggggcagaggggaccacagggctgtacctccagccaggcattatagggtggtgggagcagtgggtttgtggcttcacctcgggagggctgggagctgtgactgggtgttgtgtgggggcggccagggaggggctccctggagttggcgttcctgctttagcagctctatgaaaccctttgccagggagtgtgcccagggccttggattctcttcatcaccccacagtgctggcagtagcctctggtgtgggccaatgctgtgccaggggctggtgtacagaggagcggaacacagggccccttttaaggtcatccccaggggtgcctgcatgggttgctctgaaatgctttgtcggggccatcctggaggagaacgctgaagccatgggaactgaggaggcatctagctgagcctgggtggtcagggagggcttcctggaggtggcgcaggcactgtgatatgaaggtacaggggtgaggggcacctggggacagaagaaagcctggcttctttcagagtgggggcttggaggaagagtgggaagtaaggctggcaaggccaactagaccctgaaaacggaggccctccagtcctggtctgcgagcgagcaacaggcagcctcagggcgttccgagcagaggaggcgcggccagactgtgaggttgaagggtccctctgcagcccaggtgtaggagtgggcctggagaggacaaggcggcaggtgggagacctgtgagagtgacagggccgggaaactgaggcgcagagtggggcgtgcttgcctgcagtcacatagcgactgaggaggaagagctgggacgggagccagctccgtccacctccaggtcctgcctggcgagctgccctcgtgtacggggcaccactgcacgcccacaccacaaactcgcctcagctgggcacgtcctttcccagggcccctcgtgggtcaagccgtgcgtcattttgtgccattgtcttcagttattggaatttggaaacgttgcagaaatgcctctctctcccctcatatatggagattgttgcaaagcaagtgctggtttggggaaaggttatttccttcctcgagggtggggagcctggctttcctgagaggggctgtattgtaggcggccagtgcgtcccgcccaggtctgtgtgctggtgaggaagtggtgccacccacctgtgccgggccagggatgtggaggggagcacccatgtgctcaggcagaccctgccagtcccaggtctcacaccttgtcgggcttctggttgctcatctgtgaatcgggggcgcccccctggctatgctgacattgttgcccaggaagagccttgaaacaggaggagggctctgaagtgtgatgaggcccagctgggcgcgtggggagcaccgtgggagttgagcattgcctgggcctgagcccccggagcctgcatcatgagggatttgtctcctatccttagcttctcaatctggaaaatgggcctggtggtaggggcccccagtagggttggtgtgaaggctgaaggatgaatggagagccccaggcccactctggggaggcggacagtgctgctggccgtagctggttcttgagtgtggctgagtgcagccacctgtgtctcccgtggcttctgtcttctggccacggagacaccatcatctgtgttggggccagcccttgggcttgtgatcggggtaccccagtgcttgataagcctcccagagttcttccctccttagcctgggacccccatcctggccctgaattcccagccccaaccttggtcccaagttgagcttttagatgatccagaaagttctgttcttcttagagtctcctcaaaatgaaaacacatcgtcaaaaaacattgatgagcatgcatgcgcgtgcccacacacacgttctctctttctctctgtctcttgtctgtctctgaagatctcgctcatcactgtgttttcttagacaacttccctagtcctcgtggtggttggtgttggctgagcatctcaatgtcctccctcatctctgctcccctgcatggctgtggaaacaaattaatttcaccgttttggcccatgggcatcccaggggccctgatggctgttgtctgattatggggctggtagaggcagagggcttctacggggacctgtgcactttcttggggaataagccagagggtgtcagcttcctttctgacagagtgaggatgagtttcaccaccgtgttttcggctgcatcctcctacctcctgtccttgacatcatacttaataacttaatgttattttaaaaaatcccttccctgttttgcttatatttacttttttttttttttttttttttaaatactgaattttactctgtcacccaggctggagtgcagtggtgcgattccggctcactgcaacctctgcctcccaggttccagtgattttcctgcctcagcctcccgagtagctgggactacaggtgcgtgccaccacactgggttaattttgtatttttagtagagatggggtttcaccatgttggccaggctggtctcaaactcctgacctcaggtgatccacctgtcttggcctcccaaagtgctgggattacaggcgtgagccactgtgcttggctgcttatacttacttttaaaggaaacctttgatcacaactgtagacagaaatcaggatcacttgtcctaaaccagcaatacccataaaaataaatatggcactaaaaatacagtgcttagcatcttagccaccttgtatgccctgccacagccttgagcccgagtgagtgttccctgttttttttttatttatttttatttttattcatttatttattttttgagatggagtctcgctatgttgcccaggctgaagtgcagtggcgccatctcggctcactgcaagctccgcctcccaggttcataccattctcctgcctcagcctcccgagtagctgggactacaggcgcccgccaccatgcctggctaattttttgtatttttagtagagacggagtttcaccgtgttagccaggatggtctcgatctcctgaccttgtgatccacccgccttggcctctcaaagtgctgggattacaggcgtgagccactgtgcccagcaccctggtttttaaaaagaatggttggcaagcgtctgagaggtgtgggaggcacacccgtgctgtctagagacggtctccaatagccagattggttcagagggattcgcggggacatttcctcacaagatcaccgagcgttggtgcttgtccctgaaatcagctgtccttggaacagtcatctctatccctgcccaggaagtcccctgtggtaggggcgtcacatacctcacatctcctggggctgccttggcatgtttcgtgctaggctggggttgatggaggaggccccagccctctagcaggaatgtcttctctgagaccaagtgtctggctctcagggagtggccatgtcctctgtgcccccagctccgtgccctaagactgtcctggcgggttccggctgctataacaaatgtcacagatgagtcggggaggagattgaagatggacatttatttctcagttgtggaggctggaagtctaagccctagatttcgttcctggtgagagttttcttcccggcatgcacgtggctgccttcttgctgtgtcctcacaaggtggggggtgggaagcggcggacggagagagagagagaagggaagagagggagggagggagggagagctagtgagctctggtctttctttctgtaaggacactaatccacacatgggggctccacccatgtaacctcatctaaacctcctaatggggggccccaccccctgataccatcccactggggtcagggctttcacatagaaatgtagggaggacacagatgttcagcctgtaacagactggtttaatgaactgctgaggatggaaacactgtaacaccagctgccagtccctgtgtgaccccaaggcagggtgtggtggggaggccatggcttcctgtgcatgggatgggaggagtgacccctctttggccctagacgttggggttcccagggtctggttgggcatcagcacatgacactgtagcccacctatgacctgggcttggtcccccacagtgacttcggaagttggcctgcccattgctggaagcaggggcccctttgcacaggcttgtctgtgtctgaggctattcaggagacgtaggggccccactacatcctcctggaaggactagtgatctgtcagccctgggtcaagttgcagccaccaggactccctcacgccccatctttcttttgtctctgcctttctctgtgagcctggttgattctctcgaaatgaggcccgccacatggcaggaaatgtgcccaccttcagaacttgctgtttcttcctctgcaggtggtctgtgctttcttttatttccacttcaagagctcagggaggagctgtgaccagcccagcctgggaagaacatctgccctgggccagtcagctgtggctggggagggtcaggaggtcatgcgttgatgtggccccaggcgcatgtctggagccattccctgagcctggggactgagcgaggcagcctgctgccctaggaggggtctagtctactgcagggacacataaccccagcaactcagacattttggggttaagtcagccatgaatacaagaaggtggttcttctttctttgttttcacaaatgtcaggataattttggttacaggtgatagaaagtacaatttcagcaaaaaagtcatggaactaaaaaaatacagggtgtagcttcaggcatggctgtatccagggcctctgcagatgccatcaggaccgggtctccatctcttgctctgctgttctctgtgttccatactcccaggcaggctctgccgtgtggtggtcaggtgccccagcagctccaggctcaccctcgagctcagaagctctggagcaaggcagcctcctcccaggagcatcagcatgggccatgtgactgggtcgtgtgactgctctgacctgtcactgtggatggggcagggactcctctcattggccatccagcagtccacgtagcctgaagtgtgaaggggggttccccagaggagaaaggctgcagtgattagacccactgtgcagatgaaagcattgctgctcagagggtcacatgctccgaggtgcccagcagcctagtggcagggctaggttcaaatttgagctctgatctctgggagtccagagcttggtcctgctggctgtctcccttggctttggcagcaggggctgactgccttgggggcctccaaggctcttgagcccaacggttataccacagactgggccagaccccgctgttggttgtacactggccgcctcactggcagccctgagaaattcctaaatttcagggccgtgcaaataaattgggcacagcaaaggcctgagggactcgcagagagactgggctgcccgctcccctggctgctgcctccttccagatgctgtggtggccaagggagcctggttctgccgtaggccggccccgcctgcctgtctccatcgctgtctgtctctggctgtctgcttggctttcggtctgtgcttctctccatctctgtcttggtctctttctgtctcactaatggatctctttccttgtctctgtcagtctctgtgtctctctctgcctgtcttttgctggcaccactccccccaccccgccacccaagtctaggatctcagccctttgtgagactaaaaggcggacgcaggagtgaaagtgcctctgtatgaaaggtggacacgtaccttggttgtttaggtcacttagccagtgactagccaggtgacttcagggaagccttttctgtttctgaaggcccttctgggatactcacattcataattcatcccatcctctctgccagccctgtgctcgggccatacggattaattaatctacccctctccactcacccacccatccatatacccacacacccatccatccacccgcccacccacccatctgttcacttacccacccatccacccacctacctacttttttagccacccatccattcactcgtccatccatccatccatccatccacccatccacccacccacccacccacccacccacctacctacccattcatccatctacctacttatcccaccctcagggcttggctttaaagcatggggtgggatttgggtgttcagggttctaggagagtttcaggagagagggcatcgcaggttgagctaatgatgagagaaagataaggggttgggaactagagagagttttccagtttagcaggagttgggtttgtggaggacaacagagggggatgggttaggaaagctaggtggggttagttggtgaagggctttgaatgtctccgttaggagttttttctttatccttgggccacaggacttcagccaggggtctgtgagtggactgcagggagtctatgaaactccctcacatagcagttttaggtatgtgcccatatgtctgttaaggctcttggttgcaagggacagaaaacctggtccaagttaggttaatcaaaaggggttcatgtcattgtgaagttcagtttttcagttagcttcaggcatggctggatccaggtgccaggcagctatcactatgaccctgtttctctttcttggcttttgtgtattttatgagcaggtgccagcctctgatggtctccacttgatgacaagatggcttcaggtacccttgatgttaaatcatcttagtctaatacagtaggaaagagagaagctgtttgcccagtgttttacctgaggtgggtcttatagtctctaattgtcctggtgtccatctctgagtcaggtgctgttgcaaggggaatgggaagtgctgattggagctccagcagggtgatagggccacagaacgaaatctaggggctgttcttggaaagaggctgaatatgtgccaggtggtcagaaaccacccagtgtcgctgcagagcttggttcattatgtgctttttttggtggagctgggtgtgtattatccatagctttttgcacattctccagggggccagagctgatggagaaccattcagggtttggagcagggatgagaggtgatgagcagtccctggaggcaggatctcggtccaggagcagaccatgtggagcatgcctggggattaggactccccccgccccaggcggggcatgggtgtgcctccttctagggtcgggtggagggtgtgtggagcgccaggtggggagggtggtgatctcagccttggccgtgggcagcctcatttctcatcgctcccaccctgggagtgtttcctctttgcagaggagtaacttgtggggaaggaaaataccagctcccttcaatgccaaaagcaacattttctttctcaaaggttgattaaaagtcacggacattaatctttgtaatttttcacgtgcttatgttggtaatgagattagtgattgtgtatgtagggtcagctcttacctaaaatttagggagctttttattcatttcttgttttttcttttttttagggaggagagggaagggaggggagaaaaccctggctgttccacttgaaagattatttttcccagggttttcatgagctcaccctgttgaaggaaggcccagtgaccagtgagcgtgtgaggagcatggggcacctggtaccctaagccccacctgcggcctacagcttggtctgtacttcacgtgtagggcttgccctggacctgctgtctccctcctcctccttggggtctcacaccacccacctgtgtcatcagcctcacctgttcaacagaaaggaccacagacctctcctcatcctcctggcccggtagccctttcctcgcagccaagcttctggtcttttgcacatcgtgctattattaagacatttgcccgcgaggaaatgaaggcaactgtagttttcaagattgaagccaacttgattactttgctctgataatttgtgagtttcgaatcatttcccttccttccgtttctcctgccaacaccttctctggcttttgtttcctttttctggattactgcaatggttcttttttattttctttaaaaagtctctctttctctctctgtcttttagatacggggttttgctctgtcacccaggctggagtgcagtggtgtgattatagctcaatgcagcctccaactcctgggctccagtaatcctcccgcctcagcctcccaagtagctagatacagagtctctttgaagggaaaaaaacacaaacatacaaaagagtacctaaaagtcggtgtagggtggtagaggaaattcttggataaccaccacctgggcaaagcaagaggatactgcccgcccccataggtcctctgatttcccttactggccactagactttgatggtgacaactcctgcttgactttctagttctggttcctacatttgcagtccctaaatgatgtagcttagatttcaccaggttttgtactttatgactggaatctgtcccagatttctcaaaaggggtgtctacagtctgttcttgaattcccagtgtgctgtgacctagtggtggccctgccaccctgttgggacaacatccactaaatgtaccagatgttttgctgaggtccctgggccccggattcagtgactgactgatcgccctctccttggcatctcttcttccttgatgtgtgtccccacccccccgccacctctatcatttttctttgtgctgctcacttcccagcgaccactctcttcctccttccctgcatgccggctgcagtgtgtcaggctggtttctgcctcagggcttttgcacatactgttagtgctgcttaggataccattccccagatctttgcatggccaccacatttttgcatgatatcagcaagtaggttgcctcctaggcctcctcgtctgaccattcttgccaaaggagcatgcggtctgtctctgtcacaacgcccttatctcttccccccatcagaacattggctgcatgcgggtaggactttctttcatcttgttcgctgccatatcccagcacctgcagtgggctggccggtagcaactgtttgatgaatagctgcaaactaaaggactctagctcaactttctcggccagacagacctgttcaaatccccacaccttttactacttatgtggccttggacagatcatttactctgtctgggcctcagtttcctcatttgtaggtattaaatggttaaggaaaataaatatccctggaaactcacagtccagtgattggcattgtgttggcactgaggaagtgatagttagacacgaacttgattaacagctaaaatccctacttgatgctttgtgccaagagcaagtttatttttcccagtgaactagatgacttcctcttatcagagaaggagcaccgggtcaccctctaatttcccttttggctttggctgccaggaagcatactgctaaggggaggtctcaggagcagcccttatttcctgtccatcttcagtgcagttcttcttccctttcttctccctgttctttggttatttacgtttggctctacagtgcacatttgtgattattgtcctttattttggtaaaatatacgtaacatgaagtttacttttttttttttttttttgtgacggagtcttgccgtgtcgcccaggctggagtgcagtggagcgatcttggctcactgcaacctccacctcctgggttcaagcaattctcgtgcctcagcctcccaagtagctgggattataggtatatgccaccacacctggcaaatttttgtatttttaatagagatggcgtttcaccatgttggccaggatggcctctatctcctgacctcatgatccacccgccttggcctcccaaagtgctgctgttgcaggccgcgcccggctgcgatttaccattttaacctgcttgagtgcacagctcagtggcatcatggaagttcacgttgtgcagccgttaccactatctatttccagaactttttcattatcctgaacagaaactgtgtccccattaagcaggaactcctcctgcttcccacctccagcccctgcacccaccattctactttctgtctctgaatttgatgactgtagatatctcatagaagtggaatcacacaggatttgtcctttggtgtctggcttattcacctagcacagcgtcctcagggttcatctgtgttgcagcacgggtcagaatgcccctcctttcaaggctgataatgttgcattgtatggaatattttgtttatccatccatccattgatggtcacttggcttgatccgtgtgactcgagtctatcatgaataacactgtagtgaacttggatgcgcaaatattatttttaaaaaattactttctgggcctcaggtggtctcaggcccactaataaattaagggtagatttttggacagtttctaggatcaggctgtcttccctgcctctgcctggtgtgtggctgtgtgtctgtgctcagtaaactccatggccactgtgggtgcccacccaggtctctcacctggaggtgcacatgtctcccagcggccacaggtgctggctgctgatggctcacacctgtgccttctccagctgcctgccctttgctggcaggtgtcacttccccgtgaagtgcctgggaggtcactctccatggtctttggccagtgactgacatgcctctgagtgggatgcacccggggtgccccccacactgcatggcttctcgtgggtcactggactccagctgagatgcagtcttgcccagctccccctggctctgcctgctttcctttgcccttctcctgagcgctctcccccgacagaccatgccctcaagcgtccctgcctcggactctgcttctggggagccccgtctaagacagtgcgcagctcacatatccctctgagcactatgggtcttgcattactgtgggcgttgggttggattctgatgcagctgacctactgaggccaactacaccatgtggctagaggtggtctccttggaagagggtgagaactcccagcatctatcacatatagaagaggcaggtcctaacccaggaaaccaagctattctggaggcgaccctggggcggggtggttggaggggcaggagctcccacctcatccaggcctctctcctcctggtgtggacaagagacgctcaggccttggagtgttcaggctggtagagatgactcaggaagcccaacgatgccaatgggaagggagtgtgcatccaaattagcccagggaagccctgttgctgggccccacagcttcagtgtcaagtgtcctgacattaaatgttatcattttaaactaattatcaatgagtaatattggcagctaatttataaagcaccatgtgggccccacaaacacatctgtgtgtgaacaggctgggtggctggtttgtgcctgctctctgcttggacttgggcccgggggcagccgtgtgggcacagccagcgggccaggtggtactgattatgggtttctttgtcactgtcttgtctgtgagtgtcttgtgtgtttatttccctgctgccatccctagcagtcccagtttgcaagtcccagtgttttgatatagctgcttattatttttttaaaagagatcccctgcaaatatttaaaaaattttaaagccatactggcgccaacctgagactttgttcttatctacagttgcctcatcaaatggaggttgcccagttaagttggaatttcagataagtgacagatgtgtgccaaatactgtacaggacatccttaaatgctagacagttctccatcatttctctgagatgcctgtgcacatcccagatctgtatttgctggatctcatcagagccagaagggtcagaactggaggtgggaagacctttccttcctgatccagtgtcatatcctgtggcctgtgtgctcactaaggtgggacccccccacctttccacagtggcagcactggggatgtccccccaggtggccttgaccttccagtgtcctcgccagcccagagaggtttcatctggggcctgctgtggatgaatgtgaaggttaatttatcaaaggaggcagtgttgctttactataggatgcgtgtttgtttttgtggtaggttggggcccagccctatcaggacagcagagcgaggagcttgtggccaggtgagagaggcagctggggcctgagccacatcctgaggcacttctgactctgatgtgccggagccctccctccccatcctgcctgccccaggtgccttgtgaggagtgggcaggtctctaggagactcacactgtgtgctgagtcacctgtccctgctggacactccctggggagaccctggctgaatgtctctccgcccccacattgccctgtgcacgttcaagtgatggccctgagtacgtaaccccaggtgtgaaccctgctgccactttagaataccctggtccccccacccacagcagggatttgatcaacaaagaccaaagctgtgatagccccacctgccgctggtcctgtctggagcctgctcttgtgtctccactccggtggcaaagccttgctcacagtgctggatgcactcccagatgctaagtgctgagtgccacttcatggtggcttgacgtcctcattgtcacctaaatgtccattgtcattttggctcttcctgtgaagaatgggccgccaaatacagaggaatggctaggcgcagaggctcacgcttgtgatcccagcactttgggaggccgagacagggtgattgcttgaggctaggagtttgagaccagtctgggcagcagagcaagatcctgtctcctgcctattttttaatgccgtgatatatgttacgcacatgatacgtaaagcgttcatcttttaaaaatgccagcagttgccaaccctcacccctcctagggttgcagcctgaggccagcctggacagtgactggcccggtggcctccacctgccaacctttcctgtccccagatggcagcccggtgaccaccaggggccatatggacctggtacagacgtctctgagtcgcacactgggcgtcagaagcacagggtcatggagtgcatgtgctgaattctcacatgggtactgccttgcaaagaggctgctccaggtgacacttcggccagtggcataagaatgataataataccactatcctagtgtttgccttcctgatgggtgcaagggagaggctgcagtggttttactttgtatcttgttgtttcttgcgtccccacccgggagggctggcttggtgcagtgtgactgcctggctggccaccgcagccagtcccaggggctttgtttgctggccaggctctgactgctgggactgtccccccgcagggaggtcaggcctccttccccaccccatctccaggggcttcttttttcaggttgctgaggggtgggagctgtctgcagaagccggggttgtgggaaaactcagctggagctcccaggaggggcatgtttgattctgtgaccctgcagtgtagagactgtgccctcctgcttctctcttgtacgagtgtccccagccctgcttgcttatctctggcgatagatagggagctcactccttcccagcagcctggtcagtccctgccctggagggagtgttctccacttggagctgacatctgccatctcctccatgcccccacctcccgccccacacatacacgccccattgggagcagctgtggagatgtgaggacagtgaggtctgctattctcccaggtgagccaccccaaggggcctgggccccctcaccacgtgggccactccctctcgacacatcccagatggtcctttcccctcctgagtggacatacaaccatcagacagcaccaggatactctgagctgcatgcatttgggggggcccagacgacttggggaacctgggagctcacaccccatgtgacatctcagggtggccagagctctgtggcttgaaacaggagttggaaacctgaatttttatgtgaacgttttcaatttatgcatgctggtaaccaatttaaaatgagaaacccactgtgtgagccaaacgaaagcacttatgggccagataatgctggtgggcccccgactatgacctgaggtatggtggaacacgttcactgggtggatgcagaaccagggctcagagagggccagggccgtgcctggggttgcgcagcaaatgtggaaaatgcagagtcaggcttgggcctgatgttctttatcattgccctgggcctggagtggggagatgggcaagcctgaggtttgggattgcttaagcatggacagaatgtgatgctgggggcctggggggccaaggggccaggtcaccctgggggctgtgccggtgagcagagcaaggggatggacttggtggaccgggtggtggggcagggtgggctgggaaggaagttcttctggaagaagttctaggacagccctgtgtcctgtggctggggtactgtcctctcaggacacaacgttcatgcctaggtgtgtgatgcacctgaaggcaggagggcagggagcttgggtctcagttcaccaaagatttccttttgttttgagacggggtctccctctgttccccaggatggagtgcagtggcacgatctcggctcactccaacctccgcctccggggttcaagcagttctcctgcctcatcctcctgagttgctgggattacaggcacacgccatcatgcctggctaatttttgtatttctggtagagacagggtttcaccacgttggccaggctggtctcgaactcctgacctcaagtgatccgcctgtcttggcctcccaaagtgctgggattacaggcgtgagccacctcgcctggccaaagatttcctttcttaaaagacactgtcagctggcacggtggctcatgcctgtaatcccagcactgtaggaggctgaggcaggagggtcgcttgaggtcaagagttcaagaccaatctgggcaacacagtgagacccttgttaaaaaaaattagctgggtgtagtggtgtgtgcctgtagttccacctactcagaaggctgaggtgggaagatcgcttgagctcgggaggttgaggctgcgatgagctatgatcacacaactgtgctctagcctggacaacagagtgagaccctgtctctaaaaacaaacagaaagaactgttgagagtggacctgagggcctctcccttgcagtctggagggtccttgcttttgctgactgggagtaaaggccctgattctcccaggggcccattcctaatgtcagtggctttacggagtcctccagcttcctgaggtggcacctcagtgtgagggcaggggcgtcagccctcgaggccccagaggctccctagcactccgccggccctgagcctggtctgggcatgggcttccatctccctgcccgtccatggccctccaccgcagccttccctgcctcggtcacacaactcccccttccaggcgctcctggacttctgtcttctgtccgctgcatcctatccatcagcaaatcctgtgggtcctaccttcaaaatagatcccctgtgccaccatctcctgcctctcttcgctcactgccctgggctctctcacctgctccctgctggctcccgtgtctcagcgcagtgggcagctgggtgggtcccttgcactggagagtcccaggctccagcgcttacaggcacgcccagaggccctcacagcaggctggaagcccgttgctctgcagttaccacccgtgtgctgatgtggctcagccctgggggccctctctgtccttcacctttctgctgctggtccggcctcagccccttggccctgccactccctgcctgacgccctcctcagagaagccctcctcttccgccggactgacacgggctcccctgacactgccacgtcctccttccgtctccttgattcccttcatttatttcatcatggggctcatgcctgcctggcgttcagttctctacagatttgctcttgggtttattatctgcccctccacccctgagggtgtcagtgctgtgaggacgctgggaacctgtcttgctggctgataaacccctggttcctagaggggctgggtgcagaggaggcgttcctttagaaatggggcaggcttggggaccactgctgtggtaacgagtcctgctgtccctctgtcactgccctatggggctgcgctttaggctgggagtcggagaaggagctcttgcctgtgactttggggagcacgctgtctataagagtcaggtacggccactgggtcacaagtggggctacaggcactggggacttgggccagggtggaggagggaggaggcatgaggactggtgagaaggtggcatttgagtggcttgtgcaagatgagaggggagaagagcccttgggggagttcaggcctaagggcctgtgggagggtcgggttgggatggctcctgcagggccttgagtgccaggctcagctgggaatccagacctttcctttctggccatgggaaactggggcgggctgtggggccgtggcatgtcggggccagctgctctcaggccagactgggttccctgggaaaggggaggagtggtgggcagggaggtggcggggctgttccagtggagatcagagctgagactggagtggggacagggcctagagatggaaggaaggggtagagaccgtggggagggagtggagacagattgcggggagaatggacatgactgggggagttggtggggtgttagggacagcaaggcatcaggatgcatttgccagtgctactggggagggggacaggagcgtcccctggggctaagcctgcagtcccgagggtctcagaggtgtgttcctgagtcctagggtctgcgggctggggctgtagggggcgtcttgttcttgcctagcatttccccactgactgtattttctggccagcagctgtggtgcgtggctggggactgagtcaaggatctggggggagggattggtcgggtgtgtgcgtgggactgtgcgtgtgagaccgcccagggtgtgtactggcacgtgggcatgctgtgggtgagacagcgtgtgtaactgcatagaggattatggggcatattgcctgacgtgccctggtgagtgtgaccgagtgggtgtggggctgtgcatgtgtgtgtgtgggcacgagggctcactcagaggacctgcctcagaatgcaggtgaggatggaggatggagtggcccagcaaacacgtgtggggctgtcagcgactccaggtcaacacctgtggcgcccagcgactagacactcacctgtgtgtgatctgacccatgtgtggcggagcctgtgtgtgtgtgtgaggcagtgcttagtgtgctcctggggatgagcgcatgcgtgtgaggtggctgaggctgggcccctgcccgcgtgcgtgccggtgtgcaccgtgtctgtgtgtgcacacccagtactgacaggcttcctttctgattcccccagggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagcctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggtaagaccctgtcctggttccttcagggcactttgtgtgggaagggcagccttgggctctggccgctgccccaggtctctgcctggggctggggatgctggactgtggggccaggcctagggtggccaccccaggcccttggtttgggcaggaggctgtgagagtgcatcttctcccaggcccagctcttgggatgggatgggtgggtgggagtggggttcctgttgtgggaggtgctgggccccctggtagggctgcggtagtggtcaagggtccagaaggtgcacatcttcagagctgggggccctgaggagggttcctgcctcagcccggtaggcccccacgtgtcctggcaggaaatgcgaagggcggtctcttctcagctgccccggtggctggcctgtggcctaggagcctagcatggccacctctgccaatttttcaacaaatgtcagccagaaagctgaattttatgtgacatcttcccatttctaagtgtctgcagcaaatcctaatctcacaagcatgtgttgtagaaagaagtgaactcgtggacagaggcgaggtgggtgggccatttgagcaggggcgctggccatgctgggccagtggaggtggtggggccacaccagctgtaccctcactccatggaggcccctctccgagctggtcaggcagcttcccatcagtccttccagcagcaccgagtgcttactactatgtacgctgtttcaccagtgaggcaactggggctcgagggtggtgctggaggctcaggtcacacaaccagtgagcagtgggcctggaaggccctggagcctgcactcctgaccctatatcctccaagccacctgccacagagttcaatacactccatcgggcacatcagagcaggcagccaggaccagggcacccaggcttcagatagggaccggcccaaggctgtgcagaggctggtaggcggcccaggcctcttcttgcccatccatgcctgctcccagcaggtcctccatagcccagcacagtcagacaccccatttgaagaccccatgagctgtggcgagaaggggaatggtccgctgagcctacctaagagccgtcctcaaagggcgctgctgctaagcaggggccacagcccccacgaggctgaccccttcctgcttactttaggagccttgaactcctgcagggggtgattctgtcacaagagctgggggcttgcagatccagaagcctggtctagcttccatggggacctggggtgatgctcctaagaccccacgcaggtttgaaacccccgtgggccaacactggagaggagaggcttcaggagtcctctagcaaacaggttaatctgggtggataaccctgtgctgccacagcctagggaatctgggggcctcacagacccacagacattggaaaggcccagagctccgtcagtgtgagaggggacagccccgcacctggggggagcgcctcaaacacaaatcagatcatgccaccttctgccctatatggctccctccggccggcccctccccagcctcttctcacaccagtcagagcttcctttcaatcaagttcaattccctctggctaaggggcctttgcacgtgctgtttcccccgcctggagcacccccttctcaccactgcccacttatcacctcatcctctacattgcagctcaagtggaagctcaagactccctgcagggagccttccctgacccccaggaggagtcagatcccctgagtgaggctcaccacttcactcctcagctcgtatcactgctcagaacatcacacctctgtgactgctggggtctctatctcctcctcaaagccccaagctccccaaggtcagggtctctgctgggttttgtgaaccctgtacattcagcatcttaccggctcctgtgcacatgctgggcactcagaagccactgtcagagggtgggccgggcgtggtggctcacgcctgtaatcccagcactttgggaggccaaggtgggtgggtcaccagaggtcaggagttcgagaccagcctggccaacgtggtgaaacctcaaatctactaaaaatacaaaattagtctggcgtggtggcaggcgcccgtaatcccagctacttgggcggctgaggcaggagaatcaccacctgggaggcagaggttgcagtgagccaagattgtgccattgcactccagcctgggcgacaagagtgaaactcaaaaaaaaaaaaaaaaaaaaaagggaaccactgtgagaggttgaagagctgaagaaggcagaagagaagcctgcttccaccactttctgcccctgtgtccacaggcggtggcctgagctccctgtagcccactctccactcctgtaaactaagagggctgttgtgaggactacgcggctcagcaatcacagagcgccgagcacggtgcctaacagagtcaccgtgttgaggggcgtctgcagtggacagcagcagtcatttgagttttagggtttccctgttagccagagcatcacagcattcagatactcctgccctgcagaacctgcgtgtgtgaggccctgaggaaggggcccctttcctgccatgcattcctggggccacaggctgtgctgagaggccttctgcaggtcaggggctgcccccagctgctctgggaacctccgacctcctgagggccgccctgcccgagggttcctccgtgtggccctccattgtgccagccctgcgggaaaagccgccctcacgaagccccttgagtgacaacagacgtcagaccccttcttcccagcccagggagccgggcatgtggcttccattaggccacatctggacatgctcagaggcagggatggcctggccgaggcagtctggatccctggcagggctccagctcaaagacaggacccccagcccagccaggcctggggcactggctggaaaccccttctctaggccccagggctgccatggcaacgcggctggaggggtcacttctggccccattacctccctttctgcagggcccagggctgagcagggcaaagccacctccccagcttctcctcaccaagggctgctccatcatctagatcccccaaggcctcccccaacaacagcagccaggggcgctagggtccaaaccccacttcccccaagaggctcagttgggcagcccgatcccccacccgctgggcttccatctcccacccctcccatgctgcgtgcacatggccgtgaccagggataaacctgcctgtgtacatccctgtaacgccctcctcccccattagactctaaacgagggcgaggttgcgtctgccttgctcactgtcgcagccttggctcagtgagggtgctctgtgagtatctgttgaagatatcagcgggtgggctgaggacagacggtgactaatcatcgtcgcatttctaattgctcagcaagtcctcagctgagtgttggacacaaattagctcatttaatcctcaaagcagccccatgatgcagggacttccctgctgcttacaggtggaaaaactgaggcacaaaaccataagccgcatgctcagattctgtgggttgagccagagcccatgaattcgtgatgacaagtgggccatgggtgggcagaagggtgagagttggggtgcggctgtggatgtttatctggccaggcctgagcttctgggtcccctttgaattcatcctctacccctgggtccttaaaccttccattccctgcacaccaaacgctgcagctgcctgtccctgccctaactctggtctctgggcctttgcgtttgctgggtcccctgccagatcagccgtcagacaagataagggggactcagttgggggcctaacagccagcagtcctcatcaaagcccacacctaaaaaatctatttgagaaagctcagggcagaggggaaaactggggctcctgataacaaagctgctctctaggatcccacagcccagaccacagagaggcctcgggcatcaagaggcaggactgggggccaggggtggggctgcttctatttcagaaaccctggaagctgcactgcatgcaccacgcttctgagcctggctgcatgccctccctggcacacgtgcacttcattacacactccacccacaacatgcatgttccgctcctcccccatcccagcccaccacctcccaccaccaggtcccgcctgtgacctggtgctgctagccacacctcttggactgtgctctgctgagaatagggagatggagcctacctccccagcttgttgggaggatcatatcacagaaacaagagccgggcacccaggaggtgctcggcaagggcgagttctgtgccctgcccaccgtaagcaggctggaagcagagttggcaggggtggcagccggtaggcctggaggaacccacagagaccccagtttcaccctcattgcatgtgcatgggctttgcacatggtccatgcccagcaagtgctgtgggaggacttgggagatgggaaaacaggatccaagctggttaagagccttgcccaaggccacagctatgggcagcagaatgagtagatgggaacactgctgacactgcagagcccctcatgccccctccttcaggaagccttcccagatatcacacaggcctctcttcctcacagcccccagtctgtgaaccaagtccatactggttcatctctgccttcccagggatgccaggacatgctcagagctgacacctgatgaaggctgtagagtaaatgatatgggattgaacaagacacaggcatccaactgtggggacagatctctagaaacctcagaagggagacaggaagaaagtagagctggagctgggggagggggatgagtgaaggcacaaagattcaggaaggcttcccaggggaggtgctatctgagctggccaggaacagtgtaagcaaatgcttggaacagaggggagagaggtcggaatgctcaggatggcaggagaactagggtgaggaggaattactgagagaaggggtggtcagggggatcccccccccccgggttcactcatttatccacccagtatttatagcgctccaactgtgtgcaggccctgctagaggcccttgggctctgcagagaatatgagaggtatggtccccaccctcacctcacagtgctgacattctgttggggaagaaaacagtaaacaagtccatgggaattatctgctgtaatgtcaggtattgctaagagaaattaaagcaaggtgaggtggctcacacctgtaatcccagcactttgggaggccgaggtgggtggatggatcacctgaggtcaggagttcaagaccatcctggccaacatggtgaaacccctgtctctactaaaaatacaaaaattagctgggtgtggtggtaggcacctgtaatcccagctactcaggaggctgaggcaggagaatcgcttgaacccgggaggcagaggttgcagtgagccgagattgcgccaccgcactccagcctgggtgacagagccagactccgtctcaaaaaaaaaaaaaaaaaaagcacagtgagaggaagggtggatggacaggggagtcctccctggggcggtgacccgagcagagagctgaaaggggaggagcgagccacgcgtgcacctgaaagagggagcggcgagtgcaaaggccccagggcaggaaggtgcctggacaggaggccagtggagccgagataagtgggggagagggagggggataggagatctgggaggtcactggggcaggctgtccagggcctgtggccaccatgaggactttggcttctactctgaggtgagagctacagcagggtgttgaacaaaggggtgacactggccaacttatgtgttaacaggatccctggctaggaggagtggcagagttggtacagggccctcacaaggagctcccaaaagggaacacatcctctctgttgtcagtacagagacccagagcacagctgtgcatagaggctctgctggagagaatgggagcaggtggctgccccaggtccacagagctccgtggctggacaggtgccctgcatttgctgcagtcccctccaggccagctccccaggtctcattgccaccagcccgggggcagctgggttcaggccctctgctcaggggcatctgtcagaaacagcaagtttcaccctgtggcaacctggagatactctgcatggacatcccatttcatggaagagaaaactgtcatcttggggctgtagcagggggccccagtctcccagtggaggaggagggcttgtggttcccatgggggacctagaggtacaagtgggtctgggtggctggtagctgggtgctccctgtgtttgcctgcctgggcaaaatgcgtgcatttcacagccggacccaacccatcttgagggtctggggccaaggctaggcctgcggtgggtttctttaattttaaaaactaactctgttagtttatgcaaataaaaccactttattgagatattatttgcatgtcataaagtccccactttgagggagcagaatctagtgggttttagtagatttggagttgtgcagacatccccagaatctaatctcagagcattgtcatcactccagaaagacacccacatctgtagcagtcactttccattccctctttctcccagtccccggtagccaggaatcttccttctgagtctatggatttgcatattctggatatccctggactctctgggaatcatgcactatgtggtttctagtgtgtgactctttcacttagcacgatgttttcagggtccatttcatgtggtagcatgtgtcattaattccttttcatggttgaataatgttgtatgaatataccacatttcaaaaatctgttcatctgttgatggacattattcttccagcttttcagtattatgagtaatgcagctatatatattcatgtgtaagtttattatatggacacatgttttcattcatcttgggaacatatctaggagtggcattgctgggccacatggtaactctgtgtttaacccttagaagaactaccagcctgaggccgggtgtggtggctcacgcctgtaatcccagcactttgggaggctgaggcagacagatctcctgaggtcgggagttcaagaccagcctgaccaacatggagaaaccccgtttctactaaaaataaaaaaattagccgggtgtggtggtgcatgcctataatcccagctgcttgggaggttgaggcaggagaatcgcttgaacctaggaggcggaggttgtggtgagccacgatcacgcctttgcactccagcctgggcagcaagagtgaaactccgtctcaaaaaaaagagaactatcagactgttttccagagcgactgcaccattttacattcccaccggcagtgcacaagggttccagtttcttcacatcctcaccagttgttatagccatcctagtgtgtatgaaatagcatctcatcgtggtttagattgcaattccctgatgactaatgatgctgagcatgtgttcatgagattgctctagaaacttctagaatacgcaagcacacatcccattagcctcaaagtgatgacatcatcacactgtcatgtagtctccagagaagtccactatacactgcactgggggagagtgtatgaagaaggcaaccaatgtcctaatgttatgacaaacataattttgaccttatggatccctgaaagggtcttggagaccctatagggccaggaccacacttgagaaccactggtcagtgcaactacaagcatgtaggtgcgtgcacgtattttcacaagcactaacataggacgcacagcgttctgttctatgcctttttcaaataacaatggatcttggagcttttccctgtcactgcatggaaagtcccctttctgtgtttgatggccgtggtgccccacagcatgcaaaccccatctttgatttaccggttcccttactgatggatattcaggttggttccagtcttttgctcttaaaaagcgatgctgctgtgagcatctctacaccatgccccagtgtggaattgtgaggtcgatgtgtctgtgctttttttctttgtacgctgttcattgacacataaccactagaacctgtcagaagcacacaactcaaatgaattttcccaagtgaacacacctgtgaagctgaccctcagctcatgagacaagagccggccctaggaagcctcctttgtgcccctcctaggaaaccacctctcttgacttctaatggcagaggttagttttcctgctcttaaacttttataaatgaatgaccgtgccattgcgtgtatcgggagggggtctttttgattgttgcatagtgttccgttgcagggatcgaccctgcctagcttgttgttccccggctgggggcattggggttgtttccagtggaggccatgagctttctctgccaggcttctggtccttatgcctgtgcatttcagttgagaggtgctggctggctcagctctaggagatatggatgtaatttttttttatatggacgtatttttatagccctggtagacgttgttcacttgttcgccctggagggtgtactggattttacttacacctgcagtcatgagaatgtctctttcctcgttctattcatgcgacaaatatttattgagtgcctctctcaccattgcaggagccggggagacagggtgagcaaaacagacaagactggagctgccagtcgtggggtggggattcacacagtcaacaaaatgaacatctgaaatctggcacgttagatggtgaaagtgctaaagaggaaattaagcaggttctggactttgccagtctgagaggtggggagcagcctctcctggtggttttagtttgtgtgtgcgtagctctccacccacctcgtctgatggttccccagtgagtctcactggtcacactcccaccaacactgctgtggggtggccttcctgccattctcgctaaaccaatgttagtctttcctccttggacacacctcggccatgtataaattacccattgtcacaggaatgcaagtgaggcaaccacagctcctccgtagcgcacacagtgcacatttattattgctcccaagtccacgggccagttgggcagtcctgctaacctggccaggcgtggctgacacctgctgggcctgaacgtgtgtctgtggtcacctggcagctcagctggtccgggatggcctcagccaggatggctcatgtctgtgccacgtggtctccagctggttagctctggcgtgttctcattgtggaaacagaggtccaagagaaagattagaaacacacaggtgtttaatttaggatcttgaagatggagagcactccttcaatgattaagatagacttgagatggagattgagattttattacttcctgggggatacgtggtgcacctgggggccacacacacgcggggaagtcaggggcggcaggtggggggtgggggggaggtgtgggcctggggcactggctttcactggggtccaggatggggaacatgaaagtccggtagtggttgggcactttaaagcaagcaggcctgagatttgaaacaaaccaatgcaaagtcctttcctggacggaggtgttattttggaatcctgctggcctggaggtcaggtgtgggtttggggaaggagctctctgggctgaagtagaggaaagacagcaggaatttatcatctaagttaggtggccaatcagacgtggaggctgaggtagtatgcgtgccgtaaacctcaacacccacagactcttgcacctgggctccgaactagcagggccgctgcttttgccacattgtgttggcagccagtcaagaggccagcccagggtcaaggctcctggccacgagagtcactgcagagtcctgctgccatggtggggattaaggagggggagaatgcaggcggtcagttcagtgggtgcccccgtgcctgaccaccaagccccagaccccgtgccagtgcttcacgtgcctcctctcatttagttcccatagtgaccctacagcaaagggattacgagtcccttcccaccgtggtgtcaacctgtgcctggccatggcctagggcgaggaagtgttgagcccagctctgaacccagatctgttgacataaaaggcatctctgtgttttctgcttgggtcctggcacagggctccccaggttagaggctggctcgacccttcactagctgtgtgacctcaggcaaattgcttaactgtcctgggcctcaagatttctcatctgtaaaaggggcttactgttggcttcctcccagagctgtgttctcaatgggaagaaagcctgcagtggacaccaggtgcaggggaggcctgccacagagcagagctccactcatggctggcgtcccggatgctgtggttccaagtcctgaggccctgctgagagggtggcggccttcgagccctgggctgcatcctgttcacgcacccaggccaaggcagcagatgcggctttcctgaggctgaaccatgcctaggagtccttggcctcctgagccttccagaatcctgggggcctcagtgagctggagttcaggatctgtgctgcgagtttccctgcgggcaatgtcggcatcctctacctgccagcacctcctcgaggctaggccaggctgtgggcctctaggacctctggcctgcagcatccggggctttgaggtgaagcttctggttgagatcagaattgtgtgggctggggctctggtgggacctccacccccttgtccactcctcggcctccatgctgggaaagtgggcttggggccaagttgcagtgagattgagcctgctttggccctcagagagtgaattcctgcctctgccgctcgtggctgtgtgacctcaggcaagcgactcaccctctctgagcctcagtttctgcatctgtacaatggggcggtcctgttagtctcaggattactgagaggagcaggcgggctaacggcagccagcacagagtgctgctccgggccacgggctgcttgcctcatcctgccagaggttctgcaggaactggggtggcgggggagggatgagaagagggctttgtgttcttgtttcttcaaacagatgtagatgtgtatcttctggtggccagaagttgtcccctctggcaaaagagcagaggagccaggcctggcagggttgggcaggggccgttccgctgctatgtttgccactccagctgcctccagatgtgcagcagcgtgttcctcactggctgtctccctcccatgctgcactcttgtttcggcccctgccaactgcgtcagcaaacgcgcgagctgcgagacccctccttcagccatactgcctggctgcaaggctggcttcccacagacaaggggaggggcaccctcctctactgagtctgcatgcggggccctctttgccaccctcacaggtcaccctgcatcagtggagcatttattatgtgccaggcactgtgttaatcactggacgcgtatcagtccattatgtgtcgtgaccccgtgaggggatgtcatcattatgtccattttgtagacgaggtgactgaggcccaggcaggttaagtgaattgtccatggttcctgaaaccagtgaagtagacgtttgccaacccctgacttggccccctgcaccgggcacttccacctcctgcctgctgactccctgagtttgcctggctgcccagtgtgagcaggcatttccctgttgtgggcagactgaggcttcaggactgtctggatggctggccctcaaggggcaaagctgagcccagggcaagctggcaggcctcaggctctgcactcgcccccctgccccaacccctcaggcctctccctggtaccttcctggtcaaggtctaggccggtggacctggtgggactgtggttccaagtatagtcaagggccacataaggacgttttggtcagtgatagaccccatatataaaggtgggattagcaggtaggcaagcctgcctggcacagagggcccagaacctgggggtggaggagtagggagagagggagtgagaggctttctctcctgcttccagccccgtcctctagcctgcccccctcaccttttgggtgccagagattcagcaggaaccacaaaggtgaagacccttagggatgagggtccctgctgttaactccagcgactgtggccagctggcctttagaatgcatgcaatggagaagcagcactagaagtctgggagtgaaacagcttgttggaaagtgggggccgtggggaccagagactgtacctagaacacaagggcagtcgctcctgctgttgccctggggccgtggaggcctggcatggtccaagattttggattttctacaagaagcctgggatctggaacttcatatgacagctcccaatttgtaaatattagcaattcgttcacatatttttaaagcacccacaaagtacactacaggcacctgcttgctgccatagcttggactctccctctgccacccctcctgacaccactaggatgacacagaggtccagtgctgggtgaggagctggctgagagctctgcaggtgcagaggatgggggcccaggagccctgactccaacccaggctctctctgcccagacctcccatcccagctgagtcagagctggtgggatcagtgtcatggtgaggctacatggagggctgagggcagggacctgcaggttactgtgcagtacctggaccagcaacagtgggagctccacccctggcctgcaggggagactggtgagagccgaggctccagggagtagccgtggccataggtagaggcaactgtgcctgtatggggaccccaggatgccaccctccaggccagcctccctcaagaaagagcagggctgacgggtggaaggtgggtctagggcagatagggagtgggcagtaggctttggggaggatggccgtgcgggtatggtggttgggaatcagggactgtccgcaatgccaccacacaggcatgggcgtgagatgagcagcctcaagctcatctctgtgtgctcctcacatgctcacacgggaggagttagagtgagctcagatgcccaggtagagatgccatgttggcggtgggaacttgagcatggagctcagggcacaggtctaagctagaggtggaagctgatcagagaatggctgtgcttctgtcccttccccaccaagctggcccacctggcagttggggctgggttggtggtgggtgagtgatggaggacgacctcacaattcctcatctgtcaccgtgtggcccctggagcctggatgcaggagcagggaggccaagggtcttgccagaggttgcttggctggtgggggcatggctgggctttgagtggagctctctggcttcctggctttgtgcctcacaccccccaccagccgtggccatcaggatagaagtgtttcctgcttggcgtgaggctggtgagcgtgttaccctgacctctcctaggcacctttgatcagtgctgattgcttcactttgagtgtgcagagtggccagttattctgcaggagcaactagacagaggaaggatgtattttagtggggggtgtgcatgggggaatcagatcaatcagtgcctggtcaagttctaggaaggcgggcctggtggtacagtcaagcgctgcataatgacatttccatcaatgatatactctatatgtgatggtcccatacgattatggtgaagctgaaggagctgaaaaatgccttttgcctagtgacagcgtagccattactcgtgtttgtggtgatgctggtataagcaaacctaccgcactgccagtaatacaaaagcctagcacatgggctgggcgtggtggcttatgcctgtaatcccagcactttgggaggccaaggcaggagaatcgcttgaacccaggaggcggaggttgcaatgagccaagatcgcaccattgcactccagcctgggcaacaagagtgaaactctgtctcaaaaaagcaaaacaaaacaaaacaaaaagcctagcacgtgtagttagttacagtgcatcatacttgataatgaatgtctgtgttaccagtttatgtatttactatgtttttgttgttattttggtaggcctagggcactactgtgcgctagtgtgttatttggctttctacttatttgaaaaatagttaactataaaacagcctctggcaggtcctttgggaggtatccaggagaaggcattgctatcataggagatgacagctccctgcatgttactgccccttaagacgtcccagcgggataagatgtggaggtggaaggcggtaatattgatgatcctgaccctgtgtaggcctaggctagtgtgtgtgtttatgtcttagtttctttttttcttttttcttttttttgagatggattctcgctctgtcccctaggctggagtgcagtggcgtgatctcagctcactgcaacctctgcctcctgggttcaagctattctcctgcttcagcctcctgagtagctgggattacaggtgcccgccaccacgccaggctaatttttgtatttttagtagagacggggttacaccatgttggtcaggctggtcgtgaactcctgacctcgtgatccgcctgcctaggcctctcaaagggttgggattacaggcatgagccaccacgcctggcgtatgtcttagttgtttttttttttttttttattgaaatggagtcttgctctgtcacccaggctggagtgcagtggcgtgatcttggctcactgcaacctccacccctggggttcaagcaattctcttgcctcagcctcctgagtagctgggactacaggcgcatggtgccatgcccagctaattttttttttttttttttgtattttagtagagacggattttaccatgttgcccaggctggttgctaactcctgagctcaggcaatccgcctgtctcagcctcccaaagtgctgggattatgggatggagccacctcacccggcctatgtcttagtttttaagaaaaaagatttaaaagttaaaaaaaaaaaattgaaaataggctgggtgcggtggcttatgcctgtaatcccagcactttgggaggctgagggcggatcacctgaggtcaggagtttgagaccagcttggcccacatggtaaaaccccatctctactaaaaatacaaaaattagccggtcacagtggcgcagggctgtaatcctagctactcaggaggctgaggtaggagaatcgcttgagcccgagaggcggagtttgtagtgagcccagattgggccactgcattccagccggggtgacacagcgagactccgtctcaaaaaaaaaaaaaaaaataaataaataattaaaaaaataataaaaacacatatagagtaaggatataaagaaatatttttctatagctgtacaatgagggcatttatgttttaaggtaagcgttattacaaaagggtaaaaaattaaaatttataaagtaaaaacattacagtaagctaagaggaatttattattgaagaaagaaaaatattttaaactaaatttagtgtagctgaagtgtccagtgtttctaaaatctgcagtagtgcacagtagtgccctaggtcttcaaatgcactcaccactcactcattgagtcacccacggcagcatccagtctgcaagctccatgcatggtaagggccctgtaaaccaaaaataaaattctaaggccccccgccaccaaccatctaactggacttccttctcagcaggcgctcttaaaatttaacttgaaagactggttcaggccatgaagggaagtgggggtcagagaggcctcattatatctctcacattaacttcagcacagactttaagtctgataagaaacattttacagcctagctaaaagcttcatctgcatgataaaactacaccatgcacaacctcttatcccaacccaaacatcattcctttctattgatcccaggtctttagacaaactcaaccaattgtcaaccacaaaatgtttaaatttacctgtggcctggaggcaccccccaatcttgctttgagttgtcctgcctttctggaccaaactaatgtgtttcttaaatgtgcttgattgatgtctcctgcctccctaaaatgtacaaaaccaagctgcactccaaccaccttgggcacaagtggtcaggacttcctgaggttgtgtcttgggcatgtatcctcaaccttggcaaaatactttctgaattaactgagacctgtctcagattttctgggcctgcaggccctatacaggcgaaccactttttatcttttatatcatactcttactgtgccttttctgtgtctagctttgtttagattcacaaatacttaccattgtgttccagttgcctgtagtactcagtacagtcatgttctggacaggtgtgtcgcctaggagcaaggctatatcatgcagcccaggtgtgtagtagtctatgacacttaggtgtgggtaaggacactcttatgtcctcacacgatgacgacaccacctaaccacgcatttctcagaacgtgaccccttcgttaagtgacgcatgattgtgtggggtgaagggaaatggaaagctgccaggcggaggcacggggcgtttggttctggaagggccccagcctggccctgtggcttctcattgggaaccctgagctccaggtcccagaccaccttggctttgctctggcagagcacggctggtggctgctcccagggtacctgctgcctcttctccaggcaggacttctgagtcaacgcctccccggccagcacggatcacccgaggctttgcagaagaccacgctggacagtgctggtgccccactgcctgtttacttctaagagaaaaaaagatccagtttatattatgtgatatttttactttgattttttatcaatcattatttatgtttctaaaaaggtatgtttacgtttctcatagtaaatactggtgtgggaacaccaaaattgctatgtagttaaatatctcttattaaactgtacgtatgatgggctggaaattaagcgagaaagaaaaagcaacagaattaaatcatttataagattcatctataagtaacacaaaacatcattctaagaatcagaattacatcaaacttcagtttgagcagaagtatagtctcttaggtaatagcagttccttaaataataatgaaagagagaattcatagttctttctgagaagggacagtgcacacttttagtgccttgcaagttccacacattctttttaaacagagttaaacttgtcaagaatttctgtgcttctcctgaatcagggcaggccagagttgtgcaagatacttttctctcttttgcatagagttggcccctagacatcgcaacaaaaataacccatgaaaatgcggatgacagtcgcacacatcactggctccctggaaggctgtggaagggtgaggcttgtccatgggtcctctgactgcgaacataccactttccagagctttctaaggagcagctggaagtcaaatactatggggtctcacagcccctcccacccatgttgttgaagcccaccatcaagccccctttggtaactgtgactctcccagccacagctcactaacatcccagggttccacctggaaccccagtccacactaagcagctgggacagactttcagtggggctatttgagggggaagggggctcagtgaagaagggcctcagcctcatcattgtccagtgctctctctcatttgggacacacacacacatggatatttcagtcttgacactgtatcttgcaactctaaaaaatagcgatattctctaatattatcacataccatgaccctatacttcacacaattaccaattccctaatgccttctaatactccaactatattaatctctctcttcttcttcccaaagggtaccgtatagctcgttttataaaagcaatgtctaatcaaggatgattagatatttggtttatttttggttgttaatgtctcctgagtttccttctttcttaaagtttctattgaagcataatgtacatgctcttgagtgtcttttaatccagattaatataacagtactcgtcttagagctttttattagagtaaaatgtatagacagtaaagcaacaagccttaatagaacagcccagcaagtttcttcttatgtgtaaacccaggcattccacagtcaagatagaaagcatttcaagcaccccagagttttcctggtgccctttctcagttcttaaccccatcgctgctggaaaccattattttgacttttatcaccatctattactcttgccaattattttttatttttttgtagagatggggtctacctatgttgcccagctgggtctcaaactcctggcctcaagcaatcctcctgcctcgccctcccaaagtgctgggattataggcaggagccaccatgcctggcctaactcttgcctagtctttaatttatttatttatcgagacagagtctcactctgttgcccagactggagtgcagaggtgccatcttggctcactgcaacctccgcttcccaggttcaagtgattctcatgcctcagcctcccaagtagctgggactacaggtgcccaccacgatgcctggctaatttttgtatttttagtagagacggggttttaccatgttggccaggctggtcttgaactcctgacctcaaatgatctacctgcctcagcctcccaaaatgctgggattacaggcgtgagccaccatgcccagccctgttttgttttctgttcttgaatttattttgaatgatgggaacatacagcgtgatcttgcttgtgtttggcttctttagctcaaggtaaggtatttgagactcatgcatattggtgcatatagcagtagttcatttttagaaaattactccttatgattccattgtaggaataaatcatagttttaaaaatcagttttagtgtcgatggacatttgggttccatgctgcacactgttgctgtgagcattctcgtctgcgtctttggaagacttaggcatccatgtctgttggatacatactgaggactggagttgctgcatcaaaggttatgtttaatgttagcagatactgccaaatggttttccaaagtacattgccaatttgcatccctaccagccatgcatgagagttccatttgctccacatttctgccaactctggcggttgccattctttgtaattttggccagtctggaggatgtgcagtaatagctcactgtggcctttatttgccttctcttacaagttatgatgttgtctacattttcatattactcttggctattttgttgtcatttgcctattttaaaattaagtttctttgtcttattgattcataggggttttaaaaatatgttctggttatgagtctcttgttggattccacataggtgatctcattctatgacttgcctttttactctcttaataaaactttctgatgaattcattgcaaatgttgtcatctgaggaacacaagttccaaattggaatgaagtatcatctattgatctatatatttatgttagtacattttgtattaacaaatggcccctagacatctcacatggggtttcaccatgttggccaggctgcccttgaactcctgacctcaagtgatccacctacctcagcctcccaacgtgctggggttacaggcgtgagccaccacacccggccaatgttttctggcctcttttttctgttccattatctgtctttgcaccattaccactccgtcttgattactgtagccttgtagtaatttttagtatctgctagtgagagttttccagcattgttcttctttttcaagattttgtgtcctgtttaagaaattgatgtctctcccaaggtcataaagatatttttctgtaatatcctagatgttttattgttttaccttacacatttagctccttagtgcatctggaacttgtttctgtgtatggtgtgagtaggaatcaaaattcagttttttactgatagacattcagctggcccagcaccatgtgttgaaaaggccatctttcccctactgcgttacattgttagcttctccaggaatccagtggctgcatctgtatggtctgtttctggcctctcttttctttttttttttttttttttattttgagccagagtctcactcttgcccaggctggagtgcagtggtgcaatctcagctcactgcaacctccacctcctgtgttcaagcgatcctccttctgcctcagcctcccgagtagctgggattacaggtgcctgccaccacacccatctaatttttgtttatttaatagagacagggtttcaccatgttggccaggctgctctcgaactcctgacctcaagcaatccacccacctcagcctcccaatgtgctgagattacaggcgtgagccaccacacccggccaatgttttctggcctctcttttctgttccattatctatctttgcaccattaccactctgtcttgattactgtagccttgtagtaatttttaatatctgctagtgagagttttccagcgttgttcttctttttcaagattgtttcagctgttctgggtcctttgcatttccattgaaatttggaattagcccttttaaaaggctgctagcatctcaattggtattgtattgaatctgtagctcagatttgacagaattgacatctcaatattaagtttccagcccatgaacatgatatatccccctatttattcaggttgtttttattttcttttgggagtgttttgtcatttttagtgtagagttcttgtatatctttaattagatgtattcttagctaattgatgtttttaatactattgcaaattgtattgattttaaccctttattttctaagtatttctggcttatattagtttgctttggcaacagtttatttagctcattctgtgagttgggaatttgggctgggctctgctgatgggggccaggtgtggctgagctcgctcaggtgtttgtggtcagctgggagctcagctgggagatagctggtctgggatggcctctgctgggatggttgtctatgctctctcatcctccatcagcccagcccggactacagagtcccaggagagacagcagaagccacaaggcccctttggatttcacatgtgccatatcctgttgtccagggcaacatagtcacgaggtcagcccagattcaacaggtggggaaatagatgccacttctcaatgggaggaactgcaaagcattgaggtgatttctgcagtcatcacagataggatggcaatattcacactgaatttagcagccacctctggagggttggatcttcattggagtcctgcacatgttaactacccgggcatgggttaaagttaatctgcacactcacattgtgatataaacataaggaaatgttttcaagtttgtctctggtagacaacagcctgggctttggggacaggcagagctgcattccaatctcagtacagtcactttcttcacctttaaggggaaggtaattggctgggcgcagtggctcatacctgtaatcccagcactttaggaggctgaggtgggtggatcacgaggtcaggagttcaaggccagcttggccagcatggtgaaaccccgtctctactaaaaatacaaaaattagccgggcgtggtggtgtgcccctgtagtcccagctactcgggaggctgaggcgggagaattgcttgaacctgagaggcagaggttacagtgagctgagatcgcgccactgcattccagcctgggcgacagagtgagactctatctcaaaaaaaaaaaaaaaaaaagtggaagataattgcccctagcctgcagggttgtggggagaattaagtgggtgacatattcagaagtccccagcacgggcggctgaattaagtgggtgacatattcagaagtccccagcgtgggcggctgtaaccattagcaagtatgaattcttcttctctcagccctggaagcagccggtcttaagccagtgtacctcgtcttcctctgcccctgacactgcaagcttttataacactcattttacctccacttcagagttgagctgagttacagttgacaagctggtatcttgtaaaatgtatagacttttaagtgaacattttcccagttcttttctgtggttgtctctttagattttggagccattatattttcttcccaggcccaggagtcaagcattttttctggagacttttggaaagctcgtagaccccagtgggtgggtaggatactgagggtgcggttaaacccaccctccttgacgtttgggggctgcttgttgaaacatgggcagagttccgtcgctcagagacccacttgcccgggcttgatgggctgggggtggtgctgggcagggcagaggtccctgctatgatgggcttctctctggatggagcagaggtccctgctgtgatgggcttctttctgggcggggcagaggtccctgctgtgatgggcttctctctgtgctcagaccctgtctctcaccattcctgggctcaggggacctgcagcttgggcagctttgattcctgtcctggggattggggataacctcacaaaataagcctgtcgtttaaaccctgtatgtttaaacccttgggcacatcactctgcctccctgggtcttggttttcccagctgggtggtggctgttactaaagtgatcctggctccgtgggctctggagggagggggagccctagcccccgacctgggcccaggaaacagcttttgccaggcttctcaagctggcagagctgaatggtcaagctggctttcaggtgacactcagctggggacacagagggaccccagagcccgggctcccaggtccagaccctatgcaggatggtgcacagctgagagcctgctgtgagagtgggcttggggaaggggccagaggggtggcagggagggccttgcttcccttggaagaactgatgaagatggggacttgaacttccgttcccttctttcctttctttgatgcttggctcaggagcctgcactctggagccatgcagctggggtgagatcctgcggctgccccggctgggtgtgtggtctggggcaagctgtgccttctctttccacagctgtctgctggtctgcaaaatgggggctgaggctgggacgttccttctagagccagagggaagataccgtgggtgcagggtggggtctagcaggcagctctgccaagcctgagatccggccggttggctggactggccaggctggggtgtccagacagtaaacacccacagaggagaaggtgatgtgagggccacagaaagcagtggggatgcagaagccggtgctgagggggctggctggggctgctctgcctgctgaggaaggcatccctcaggctgagttgggtgagctcaggcagagcccgctgcctggccgctcctgctgtttcttagccatcccctgctggtttctgtgatcccggggaggaaggcagacccaggttcagaaaccctttctgtctgtccattttacagtcctcataaaaaaaaactcaaggcgcctccacagaccttcaggtaaccctcccaccctgtccctccacacccccaggagaacaccaaggctggcgggaacatcagggctgcagccttctgtgtgctgtttgctcaggccccacaaatatcctgtccaaacaggggcctggcggagatggccctgtcaccaccctcctgccaggtgtggaaacttctctgcagcattttcaaagccggaattctttaaggctttaatgtcaagggactgggactggctagagcggtcatgacctctgcactggattgttcagggaacccattgtcctatgatcaaaggagcttagaatcctcagaaaatgggtaatacctgcataagataagaaacaaatacaaattacaaaaggggtaaacagtcagtttccttcctccctccccagggctgagtccttccccaagatagccacagttaccagtttcttgggtatccttccagaaataatccatgcatatccatgtatctttttaggaagacaaatggtagcttattagagatactattcaggattgacccttaaaaaattcttcatagtacatgtggaaattctttcatgtaagtgcatgcagatctaacgctttttaacagctgcatacgattagatggatatagcatcagttttgctttgttttgaggtaaggtcttgctctgtctccaggctggagggcagtggcgtgatcactgctccctgcagcctagacctcctgggctcaaggcatcctcctgcctcagcctcccaagtagtggggaccacaggtgcatgccaccatgcctggctaatttttaaaattttgttgggagatggaggctcactgtgttacctaggctggtcagcatcagttatttaatcactgccctgcaggtgggatttaggttgtttctggatctttgctgtcacaaatgcaggtgcatcagaatctgtgatgctcctgtttgtgttcatgggagcatctcatctatcagcagattagatccctacaaggagaattgcagggtcacaaattttttacactgcaatgcatttttattattttttaaatcacataacatgacattttccatttttagttgtgctcttccaaggcataaattacatccacctcgttgtgcagctgtcaccaccatccacctccagaaatttttcatcttctcaaactgaaactctgtctccattaaaccctaactccctatatccccactcccagcccttggcacccaccattccattttctgtctctatgaattgactactctaaggaccccatacaagtggaatcatagtctttatccttgtgtatctggcttgtttcacttaccttgattttatttttaaaatttattatttaaatttaaaaaataaattagttttttatttattatttaaatttaaaaaataaatttgtttatttatttatttatttattttagataaggtcttgctctgttgcccaggctgaagtgcggtggcacgatcatagctcaatgcagccttgacctcctgggcttaagtgatcctcctcccttagcctcccaagtagctgggactataggcacacaccatcatgcctggctaatttttaaattttttgtagagatggagtctggctgtgtttcccaggctggtcttgaactcctggcctcaagcaaccctcctgcttcagcctcccaaaatgctggtattataggtgtgagccactacatctggcctggatctatttttaaaagactcttttagtctttagtcttagagttttctgatcatactacctttttcagtactgtctttgtttgggaggagagcagttcaggaagtgtccacatgggcagcaggacagaaaccatagggtcgcccctgacaccccactccagttaccaccgtcctgatggcagtcagcaagagttccctccttttccttataattttacccccgaacaatcttgcttcattcttctctgttgttgagtctcacatgaaaggctgtgtgcagtattcccctgtgacctgcctctttccctggtgcagtgttggtgtgctccttgtgggttattgcacgtggtggcagtgaggtggctggcatcatgtggtcacactgcagcctatggaccctttctctcatttgtgggcacttggaaaccacctggagaccaccagaatactcagggtcgtgggtgtggcgccttctgctttaccaggggacagtgagtggttttccagagtggacctgctctgtgccacttggcgtgggaacagcagggttcctgctgggcaagggttgtgctcaccctgctgccaggcccggagccctgatgctgtgaagtcaaccgtggcagtgtgttctgaagctgggatgttgctgggccatgtcactgccaaccccaggaggccagagagaatctctgagttgaggctgggctgtcagagtgggagagcacctgcgtctctctttccacagtgctgctgagaaccggcaggtggggaaggcattgctccccctcggcctgagctcctgcaaagcagcaaagtggacagaaatggagaattctcgaaaagccagaggaaagaggaggcagggtaggcgtggctgaaggctgcaccagcttctactgctgaagggatggttgctaatccttccatggatttgtctgcccctttgttaattaacttggaaagtagtcaccaagcgtcttttatgtgccaggagacaggaggctgtgtttactgagtaccagctatttgccatgcaatgagtcttacgttcccacttgtgaaatttgggtggggagagttacttgcccattttacaagcaaggaaatggaggctcagaagccgagtgactcgcccaagtgccccagccagtgagtggtagcccaaccacacacctgtgcttccagtggtggaaggacatgcctgtgctcatcttgtgaccctggtagcatctgctacatagaagtggtgtaaggggaggtggccagtaaggatttgcattcttccttgtcatttccctaaggctgtgcccctgggctccctctcttaaactcttagaacctctttttacgcctctggggcagggagatcatcccaccgacctcttgttgttgatgtgagctttacatgagatgatatacaccaagagcctgaagtatttcacccagccccagattttaccagggacctggtctgtgctgtgtgctgggcactggagaccctgaaatgattaggctgattcttggcccatgagaccctcccaatctggtgattgggacagcctgccacccgacagggacatcatggtcgaaggacatgagtgaagtcagaggagggagctgcttttcctgggtgctagacagagcctgctggacgcacagacaggcagggagtcacatttggactggctcatgagggatgggtagttggatactcgccagttggccaaggtagaagaagggcatcctagcatggaacagcgtgtgcaaaggcgtagaacaagagaaggtgtatgtggctgggagctgagtctgggctgtgctgtgaaggccctgagtctcactccagagagaggcactttatcctgtggggcagtggcttttctgtgggatctgtggagccccaaggctccccaagatgactcagggatgtggaaggccagggcattgtgaggacgaccaggtaagatgatgtgatgagggttgagtaggagttagtttagatatggaagttagggagaccctctctgaggaggagagacccccagaaagagaaggagcctgtcccatagagagtgggggcagcagatggcacagggagaggtggaagattccaggcaggcagcatggcaaatgccaaggccttggggcaggactgagtctgaggagctcctgagtagagagagtgagtgggagagtgagttagagaaaggaggtcaggaggggaagtgggcaggaccccaccgtgtaggactttgtaaggaaagtggagaccacggggggtcataggcgcaggagtgatccaatctgatttgtatttgtggacagtcattctatagccctgtgggtgatgggctggagggtgacagaagtggaagcaaggagggcaggagggggtggtggaggaggaggtggctggtggactgagatgcctttggaggtggccctgtgagtgatagactggagggaggcgggggatgagggattggcctgggagcgtcctgaggatggtagggcctttgttgacacaggaagacccagggagggggtggcttgggaaaatccggagctgagcaaattccagctggggaagtgccagggagacatctggggtggtttcttggccagctgtgggcatgtgcatgtgacatggggggcgggggcaagaggaaggtggcattggaagcttagagatgagatcagccaggccagcgtgtgttggagaagagaagaagccccagggttgagactccaaaagtctggtgctcaggaagttaaaaaacacgacagagagagagagagagagagagagagagcgagagagagagagagcgatagagagagagagagagcgccaggcaggggctggggacctgtgagaggtggtctcagaaggagacctagaggagaggaggtgactgctgggcggagccttggagaatcagggtggagggcgggggcctctggacatgagatgagggtactcactcatcgtgctgggctttgcctggctctgcctcccacattttggatggcacctggcaatgctactcatggcacctgcacaatttcccctcctgctgcaactgggtggccctcccagcataagggtcacagctcctgagctttgtttgagaaggaaggtggccaggagagaatggggggaatcctggcacctgatcaaggaggagcaggcagagagcgccattcaacacccacgaaagcagagccacctctcgagctggtgatggttagagtcccagagacgaccttcaggatcggctgcattaggtcacctgtgcaacagacatggggacgctcaggcctggagaagggagagtaagaggggaaattgaagcttgcgacttcttttttaattttgtacacttttttttttttttttgagacggagtcttgctcttgtcacccaggctggagtgcagtggcgccatcttggctcactgcaacctccgcctcacgggttcaagtgattctcctgcctcagcctcccaagtagctgggattacaggtgcccaccaccatgcccagctaatttttgtacttttagtagagatgggttttcgccatgttggccaggttggtctcaaactcctgacctcaggtgatccgcccacctcggcctcccaaagtgctgggattacaggcgtgagccactgcacctggccatttgtacacatttatggggcaggtacatgtgaaattgtgacgtgtatgtgattcacagtgatcacatcagggtgttgagggtgtccatcacctgactaccgtgcatttttgttaagggtagtcactctgcttgggatttctaactccccagctcatctgtgaaataggaatgctgacagttctcactcttagtaactgtgaggttcctgtgctgggaccctgcctggctggttgctagcgctgctatatttcagctgttactgttatcctcattgggcatcccactgatgtcatctggctaagagccagggaccataatctctgtaaggcaatcttggaagaggtttagggaggaaggattcggtcctgtagaagaatgttgtgagtctgagctgtgcagaagagaggataagccgcctgggcagagttgcctcctgtcaccagaagtattcaaataaggagagtctcccacatgcccagagtgtaacaagaggggacgagacattgaatggtggcgtcactctcagtgaccacagagactgaagtcaggactctggcatcctgggaggtggaggcaggactctgcctggcaccttgtgctcctgagtcctgggacagacatgtctgagccatgttccattcagatggtgagcactgatcccggcctccgacacagcacctctcagttgcccagggtctcctagattcattcagcaaatactcattgaacacccaccatgtgccagggggctgagatatggctatgaggaagatagataagagaccctaccctctgggagctgacattgcaaaggaggaaacagaggactgagaaagtaaactcatccacaagaggctctcacagtgctgactgctgtgagagggttatttatttgtttctttgagacaaggtctttgtcacccaagttgaagtgcagtggcacaagcatggctcactgaagcctccatctcctgggctcaagcaatcccttcccctcaggctcctgaatagctggaaatgcaggcatgtaccaccatgcctggttaaattttttctttttaagagacagtcacactatgtttctcaggctggtctcaaactactggcctcaagtgatcctcctgcttcagcctcccagagttctgggattacaggctatggattttatttctgaagaagattctcttttttctaaaattatctctgtaaattttattctaatcctgcctttatagatttggaagttactttcgtgtatggtgtgatgtgggtcccagcatcataaattctttccctgcaaagtttgaatgccaccttcatcatatattcaattcccgtatgcacataggtctgtttctgaagtcttttctcttccattgagcgccttgtcttcttgttttaattattagaactttgaagtgtattctgataccgttagagaaagtctaccttctctgttcttatttttcagaaatgttctcgggtattcttaagcatttcgttttttggatgaattttagaattaacacgacaaattctgtgacagttacactttgctttggttggaatcgcattgaagttgtagagtaagtagaggagaattgacatctttaaggtacatattagatacatggtatgtattttgaataaagtgtatgttatacccattagacaatcaaattttcgtcttcatgtgaatcaagcatgttcactgtagatttatttctaggtttgtttctcttttgaatgggaattttttcctattaacttttctatttaattgttatgggggtataggaaagccactaatttgagtgtgttgtttttgtttttggctattgtattatagtcattattgttaattgtattaattctaatactttgtgagttttgagtctcttggattgtctaggaagatgaaaccataacatctgccaataacgactgttgtttcttctttctattatttctttggcccttttttctttctttctttctttttttttttccccaagacgagtcttgctctgtcgcccaggctggagtgcagtggtgcgatcttggctcactgcaacctccgcctcctgggttcaagcaatttttgtccctcagcctcccaagtagctgggattacaggtgcgcgccaccaagcctggctaatttttttgtatttttagcagagacgaggtttcattatgttggctaggctggtcttgaactcctgacctcgtgatccgcattcctcagcctctcaaagtgctgggattacaggtgtgagccactacgcctggcctccttttttctttctttttttttaagtttttttttttttaattatactttaagttctagggtacatgtgcataatgtgcaggtttgttacatatgtatacatgtgccatgttggtgtgctgcacctgttaacttgtcatttacattaggtatttctcctaatgctatccttcccccctccccccaccccacgacaggccccagtgtgtgatgttccccatcctgtgtccaagtgtgctcattgttcaattcccacctatgagtgagaacatgcagtgttggttttctgtccttgcaataatttgctcagaatgatggtttccagcttcatccatgtccctacaaaggacatgaactcatccttttttatggctgcatagtagtccctggtgtatatgtgccacattttcttaatccagtctatcattgatggacgtttgggttggttccaagtctttgctattgtgaatagtgctgcagtaaatatacgtgtgcatgtgtctttatagcagcatgatttataatcctttgggtatatacccagtaatgggatggctgggtcaaatggtatttctagttctagatccctgagcaatcgccatactgtcttccacaatggttgaactagtttacagtcccaccaacagtgtaaaagcgttcctatttctccacatcctctccagcacctgttgtttcctgactttttaatgatcaccattctgactggtgtgagatggtatttcattgtggttttgatttgcatttctctgatggccagtgatgatgagcattttttcatgtgtctgttggctgcataaatgtcttcttttgagaagtgtctgttcatatccttcgcccactttttgatggggttgtttgattttttcttgtaaatttaagttctttgtagattctggatattagccctttgtcagatgggtagattgcaaaaattttctcccattctgtaggttccctgttcactctgatggtagtttcttttgctgtgcagaagctctttagtttaattagatcccatttgtcaattttggcttttgttacccttgcttttggtgttttagacatgaagtccttgcccatgcctatgtcctgaatggtattgcctaggttttcttctagggtttttatggttttaggtctaacatttaagtctttaatccatcttgaattaatttttgtgtaaggtgtaaggaagggatccagtttcagctttctacatatggctagccagttttcccagcaccgtttattaaatagggaatcgttttcccatttcttgtttttgtcaggtttgtcaaagatcagatggttgtagatgtgtggtattatttctgagccggcctccttttttcttgttttactgcatttgctagtatctccaggacaatgctatatagtagcatggcccgtgggcattatttttgtaatatttaataattcagtgggggatgtgtctaatgttcccccattgagtatgatgtttgctatgtgcttctggtagacaccagttctcattcctctcagtgcctcagagcagaacagtaacaggttgtgatggaagctgttttccctgttttacagaaaaggaatgaaaacttaggaaagcttggtaacttgccgtgcctgctaaggcaacgcagccgatgaccctcagtgagctcttgctccggttggagtgtgcaggtgccgtccttcacggcatctatccctcagccctgtgcccttacgtgaactgctcaggacatttagagggctttgtgggccttagcacctacacagccattcagtcctcatacagagaaggacactgagtctggagggaggagaagcggctgtcagtggtaacgctgagatgtggacccaggcccatcaggctcagaggcactcatctgttacttgttgccctcagcacgaatgtctaggcattctgtataaacttgacttaggaatgtcactttagacctcaggggcaaacgcttgggttaattacacgtctcatttcttggcatggctcttattatcctctttgcaaggctcttgttttatttatttattaatattttatttcctttcatcttctttctccattcccatccaccacctccatctgcatagctgacagtttcatctcatcagtgtgttttttgctgtcatgtgttcttgcaaagtatgcattgttattttatgtgtgatagtttaaatttgtatagtagaactgatttggcttcttccttttctcccttagtgctgtgttcctccacacttctgtgtgttggtgtgtccagctcatgctgctgtgtgtgtatccagtctattgtttctgacagctcctgcatgtagcatggccccagattttcctcatcctcccccccagtgatggacacccaggctgtccgcaacccctttccacaaataacacttgacatgggcatccttgtactggttgtgttacgggctgtcgtgaggacttccctggcacagacaccaggagcagagcgtctgggtccttgatgttgcgtgtgcttaactgtataagtggtgccacatctctccagctggccgcagtctcctctcccaccctagacacatggacatgcagcagtgtagaggaatacagcactaagggagaaaagggggtccccacctctgtgtggcatttctcactcttactcatatttctagtttaatggatattttattattattttttgagacagagtctcattctgtcacccaggctggagtgcagtggctccatctcagctcactgcaacctccaacccccctccccatccctgggctcaagccatcctcccaccccagcttcccgagtagctaggctaactttttgtggagttggagattcgccatgttgtccaggctggtctcgaactcctgagctcaagtgatgaacccaccttagcctcccaaaatgctgggatacaggcgtgaaccaccacatctggcctaaggagtattttactttggagttcttttttctcttgttaattttcaggagtttattatgttttgtagatggcaattccttgtcagttttggacattccagaaacatttcttaatatgtcagcagtctattatatgtgtacatggagttctttgttatacatattggaattttgaggtaatcaaattcattaatttttgtaacctatagcctgtgcctttgagttttaagacattctcccctacctttgactccttccagcctccccagtcacaaatacagttgaaccttgaacaactcaggagtgaggggtgctgacccgactaacagtcaagaatccacatgtaacttttgactcctcaaaaacttaactaatagctgactgttgacaggaagccttactgatagcacaaatagtcaattaacacatattttatatgttatatatattatatactgtattttttttttgagatggagtttcactcttattgcccaggctgaagagcagtggaatgatctcagctcaccacaacctccgcctcccaggttccagtgattctcctgcctcagcctcccgagtagctgggtttacaggcatgcgccaccatgcctggctgattttttgtatttttagtagagacggagtttctccatgttggtcaggctggtctcaaactcctgaactcaggtgatcctcctgcctaggcctcccaaagtgctgggattacaggcatgagccaccgtgcccggctgactatattctgtattcttttcttgttgttgtttgtttgtttgttttttccccgggacggagtcttgctctgtcacccaggctggagtgcagtggcacaatctcggctcactacaacctctgcctcccaggttcgagcaattctcctgcctcagcctcctgagtagctgggattacaggtgcctgccaccgtgcctggctaatttttgtatttttagtagagacagggtttcaccctgttggccaggctggtcttgaactcctgacctcgtgatctgcccgcctcagcctctcaaagtgctgggataacaggcatgagccaccgcacccagcctatattctgtattcttaaagtaagcttgagaaaaaaaaatgttattaagaaaatcgtaagagaaaatatgtttactattcatgcagtggaagtggaccatcataaaggtcttcatcctcactgtcttcaggctgagtaggcttaggagggggaggaggaggaggggctggtcttgctgtcttaggggttgcagaggtggaagaaactgctgtgttgttccaggggtcaagtgtgtattcaacataaaacttccgtgaatttcctggatgagcttaaacttcccttgctgccactgctgctgttttcgtatctcttgccctgtcttagcatcttaggttgggttccttagaagcagagcctgagttggggggtcttgtgcatgtgttggttcatttggggagacctctcaggagaaactctgaggagtgagggatgagaggtggacaaagctgtggcccacgtgaggtctgaccctgtgggagctctagagtgtgagtggcccccatagaactggctgctttgagagtgggggctgagctctggccccatgttaacctgttatgggctgggctcctcccagcccccatagggaggactccacctcgcagacagttcaccaaagacagttgtgttgtgagctgttagcgaccagcatgcacagcagcaggggtggatgagtttgcctgcccagtaaaggagacctggacaggcccctgcatatctgctggacttggtgacttatgaatggtgactctgcctcatgttgctatccacaggctccaccaaggacctgatcgagacttgctgcgcagccggacagcagtgggccattgacaatgacgagtgcctggagatccctgagagtggcactgaggacaacgtctgcaggtagggtgggctccctggagcaggcggagctgcccatttgccttctccagaaccctgcttgcctaggaccccaggctccaggcagcccggagagagtgcaccttcacatgcctctggggcatgagggtgattgggtgtggctgccgtgcgccatctggccaggctttctccaggggtggaaagtccaagactggtcctaggaacaaaccagccacataaattggtagctggcctagtgagcaagatccgaggaatgtacaatttgaaacaagttttaaaggagtgctgtcccctaggaatagtcgggtgctcccctcaccacattctgcagttgctgccgcactcatgccactcaggctttctctcctctgccctcttcctttctctgctttgctacccttgggtcttcaggaggctggcctctcactgtgctcccttgctgctgtgctggttgtttcttctgactctgataccacagcaaagcaatcctttatccccatgccttcccttttccaggcccaggagagctcttggtcagctgctcatgctttgtttttttccagggaccccgtctaacctactcatttttccaaataagaaagattaagttcagagaggcagtgtgattcactcaaaactacacagctcactggcagcatggctgggattagaccccatgtttcccaatgtccagaccactctgcttcctataaaaaaaatttatgttctaaccttgtctttcccttcagccattctaccaatatggggcaacttaggagttagagcatgcagcactgggacccctggagtttggggctaagcggtcctagtgcatgcttgcatccgtcttgtggacgtgtcccacttcagggggtgctgagccctgtcccccgtaatccccgccgccctgtcctggctctggtctctgcagctgatttgtcagccacctctgccccaggcagcccaacagtgactggcaggcagtgaccagggacccggaggctgtgctcctccaggctgacctgccagccttttctgggattaggtctctctgtcctccccgaccgttgtgggggtggggactctgatgccaacccctctctctcagaggtcatgaacacacatctccgagtctagtgggacccaggcctgcatctgcatggttaagccaagaaatgaaacccatgcaacccagtggaggttgtgccggctctgccacctgcaccggctcccttgctgtggaccttgggcagagcttccctcctctgagcctcactcactttccactctgggaggatgaggtgggcgactgggggctaagttaccccctctgtttcaggacagcccagaggcactgctgtgtctcctacttgcaggagaagagctgcatggccggcgtcctgggagccaaggagggtgagacctgtggggctgaggacaacgacagctgcggcatctccctgtacaaggcaagcctgacctgtggccttcaaggcagggtggggtggggcggggcgggaggctggcctgggcctgaaggtcctcgtggcccaagaagttaggctgtccttggggctcctcctgggagtgaccctcacgcctggggtggaaggactcttaatctgcgcagaaaacatcatcagttattatactgaccaattaattcacagaatatttgtagagcaccactgtgtgccctgggcatcagggatgtagcagtgagtaacacagatggcaattcccgccctcccagggatttctttctggccaggaagacagaggaagatcacgatgaatattttagcacctggcgtggttgcaggcgattgtgctaaggagaaaaacttaaggagaggtgggataagtagtgtcagggctggggagggactgcagtatcagctgacagtggccagggacagcctcactgaggaggggacatttgtgcaatgcccggggtgggggatgtctgtgaaatgctttcaggcagagtgcagcacatgcaaaggccctggggtcagagcctgcttggcatgtctaggctgtgtggctggagtgcatcgagtgacagggggcaggtggagctgagcccagagagatgtcagggctcctggccatcatcggaaggactgtggtttgactgtgggtgaggtggaccccatggggagtttgagggtctcttctggcagttgtggggaccggttattgagggtgtttctctcacatgggaggtgggattgggatggggtaaaaccccaccaggcaacagtggtgcagagaacagtgtgaactaacacacaggcgaggacgttgggaaatggggtgtgtggtccagtggtctggcagcagtagagacaggccaccgggagtcctcaggctggaccataaaggacagtaaatgctgagagctttcggcttcaagcagtgtctgtaaagccgtgggagggatttgcagcaggagatcagtttgtctactagagctcatggtggccactggcggacagggtgtcagtttggctacaagtaatggaaaacttcctggaacactggtttttctctcatatgctgcaggctggaggaaggcagggctgagttagaggagtgagaggctccatggtcatcaggaatggggcacaggcatagtggtcttgccctgccagctctcatttgccacctcttggtccaggatgaactccagaaaggggcaggagagcccccttgttttaaattattattattattattattattattattttgagacagagtctctgtcacccaggctggagtgcagtggtacgatctcgtctcactgcaactccacctcccgggttcaagcaattctcctgcctcagcctcccgagtagctgggattacaggcacctgccactacgcccagctaatttttttgtgtttttagtagagcatacgccaccatgcttggttttgtatttttactagagatggggtttcaccacattggccaggttggtctcgaactcctgacctcaaatgatctacccaccttggcctcccaaagtgctgggattacaggcatgagccactgcgtccagctgaaattagttttgatcatggtgaaatacacatgatgtaaaattgatcgtctgaaccatttgtaagcgcacagctcagtggcatgaagcacattcacactgttgcgcagccgtcaccaccaagcacccaaggaactttcttatcttctcaagctgaaactgttcccattaaacactaactcccattccctctccctgtagctcctggtaaccaccattccgctttctgtctctgtgggtttgactcctctagggaactcatgtaagtggaattatacagtgtttgatcttttgtgtctggcttatttcacttagcataatgtcttcaaggttcatccatgccatgtgtagcaaatgtaagtgtttccttcctttctgaggtgcaataatattccattgtgtggacagaccacattttctgtatctgtccattcatcgatggacacttgggttgcttccaccttttggctattgcgaatagtaatgctgctgtgaacatgagcagaagaagagctcccttttttgagggcagactgtagttctgcttagatttcattggctggagcttcatctcctggctacatctagctgcaaggaagactagggaatgtagtgtctttattctgggaggtcaggtgccccagtgaacatgagaaaaaagggaaacagacattgggatggatagctggctgtctacagcagaggtgagggcaaactatgacagtggcacagtttcaggaaaccttccagaagggacctcatcctgactgaggagcgggagagggaattgaagaagcccaaggtctcaagcctgggtgatggtgacagagaccgctggatggttctggcatttgggagaggattttgacttcaattttggtcatcttggggtcaattttttccttaaaacaactagtattagtgagaggaccctgttgacagggtctagaaacgtttagaatccccttttctgtctttatgtttgaccctggactagttctcttttcttttcttttttcttttattttccttttcttttcttttattttcctttctttctttctttctttctttctttctttctttctttctttcttttctttctttttctttctgtctgtctgtctctctgtctgtctgtctgtctttctttcttgacggagtctcgctctgtcacccaggctggagtgcagtgatgccatctcagctcactgcaagctccgcctcccaggttcatgccattctcctgcctcagcctcccgagtaggtgggactacaggtgcccgccaccacgcccggctgatttttttgtatttttagtagagacggggtttcactgttttagccaggatggtctcgatctcctgacctcgtgatccacccacctcggcctcccaaagtgctgggattacaggcatgagccaccatgcccggccagttctcttttcttagcctcagcttttctatctataaaatgaggataataatccatgtctttttgggtggttgtggggatcagagataatgcaaactaagtgttaagtatgtgatgggccttcattagtgggaagtgttcaacactgagagatgcaagaatagagtatcagttagctgttgctgggtaacataccatccaaaacctagtggcctgttgctggcttaatgcatgaatttgtggtcagctgagtacttctgctgacctgagccacgctcagctgatcctgggggcgggggtgagtgcttgcttatgtggctgctgtcagctgacggctccactggagctagatgacctaggatggccttggctgggatgacttgtttctgctccctgcagtgtctcaacccccagcaggctagcatgggcctgttcagttatgatgtgcagagttccaagaaaataaatagaagcattcaaggtcttttgaggcctaggctaagaactggcacaccatcatgtgtatctcattctattggccaaagcaagacagaaggcacaaccaagaggttgggaaatacacactttctcttaatagaagcagctgcaatatcacattgcaaagacagtgaacacagaaaagattgaataattgttgccgttattgcaaccaaaatactactgtattttaaaataaataaaaccaatttatttttgaagaaaagcagcctgggctagcgtagatctacatctttaggaacctagtcttctatttttatgtttaattatctttaacttgtagcttccatcttcagggtcacttcatggcccaagttggctgctaaagctccagccatcacatatgtgctccaagaaggagaaagagggggagcaaaaacgatgtacttgattcaagtagagtcatccccagtttaaagccctcctgaaggctccgctgagtgaatctaactgcaaaggcccctgggaaatgccatcttttaactgacttgaatagaattggggtttgctagtaaacatgaggggataatgagtgtggctggggggttatagttccttcaactaaaggccatttacttgttatctgtttcaaaagacttacattagtcctacctgtgccagacttgggaaatagaggcagaggacccctctgccctgggagagcgcatagtctggcagaggagataagataatggtgaattcatctccatttatcagtccctcccctgagcctagctccaggctggggccagagattgggcagtgataactgtctctccctgcagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagaggtgagtgctgctcttccctggctgcggcatatagggcgaaggctggttgacctctggccttctgtggggaccctgggtccatcatcacctgtggcttgagacacaagttctgctctaaacagagttctgaggatggtgatttcattgttttctgtggactacccactccaccaacttaaccaccaactaccacccatcaccctttcactgtccactcaccaccctcccctctctttgtctatacatcttcctccctgtctactttgtctatacatcttcctccctacccacttatcagtttgctctttttccatccattgcacttgtctcccacccatcctcccatcctcttgtccatctctccatccattcattcattcactccctcattcatcctctatcccatcatctgtccatccatccatccatccatccatccatccacccatccacccacctacccacccaattatccatccatccatccatccatccatccatccatccacctacccacccatccacccattcactcacccacccatccatctatccatccattcattcatccatgtatctatctacctatccactatccactcatccatccgtttgtttatccatccatccatccatccctcatccatccatccatttatccatctacctacccatccattcattcattcatctgtccatctgtccatctatccatctgtctgatcatctattcatctatccatccatccatccatccatccatccatccatccatccacccacccatccgtctgttcatccatctgcttatccatccatccatccatccatccatccatccatccatccatccatccatgcatccatcctcgttgtccttggtgtcacccccttcttcttcccttcttgtgctgtagccactgttccagctgccatgtccagtccctgtcccctagccagggctgtctcctggacccatgaccattagcctcctctgtgcctggtgggtctgcaggagcctgatgagggtgccccagtgagtcagcagatgtcctttttgtacatgggccttggtggccctggggctggtgccgtgagagtcctggcaggcctgctttgttggtgtccacatgttcagcctcaactggttggggaccagatgtccaggtaggttccagaaccaccagcccagttttttcgctgttcctatggaccgtcatctggggcccctgtggatttgtcctgggcacttcatggagtgggaattaaagccacagatgaggtcctggtatcaagattaaactcttggcctctggagtcaggcagacttggttggaatcctagttcctttgcttacctggggcaggtcacacagaaggaaggctccttctcagagccttcactgtggcatctgtcaaatggtcttgtattctttaccttgttcagtgcaaggatgaatgataggatgcctgtcaagggcttttggcagtgcctagtgatgcattcagcattgccaccactgttgctgttaccgttgccgtgcttcagcagctcagagggggaagatgaggcccagagaagggcaggatcttgccccaggcacatgccgggtctttggcacagccaggactggacaccttggctctaatgactcccacttctgccccagccttcctgatgccctgagttttatctagacccagtcagccttggttccgattgacccagatctctgtcactataatgcaagatggcagaagtctgtgcataggggttaagatgcctgctgtccacaggtgccagggctcaggagatcctacaggaagagctcatatcctgtgtggtacaggtgggagaacagatacctggatctcccatcagggtgaggcagaggcaggggtgagtgtgtgggggttggaccaggccagacctgggcagatcaaccagaacagatgtaccaaccacccttgccaatccaatgtgggtacagagagtaagtccagtccaaggaagtgctacttgctgagattggctctaaggggaatggttgagtactggtgtgaaggccaggttagtacccagaagagtctggctgaaggtagagtttgggaggaagtccggcttcaaaagtcaaaggcaggtgggtggaagggagtaggtgggcaacagagccaggcacgatcctggccagagatccatgcttcctcctgtgaggaagatgctggtgagggtgagctgagcctgaatcctggaggtactgtctagcctgtggtgtgctaggaggagccctgggtccaggtctgtccgccgcctgcctgcagtgctgagtctctgcgggaccagaccgccagccatcatggccctgcctggaggcaccggctgggactgattgggctgcagcttaatgtaaacaccctccatatgaaacacgttcctcatacgtgacttcatgcagctactctctctgtgggctctgctgcctgggtggggtgggaaggaggccctgggctggcacagagcttagaggggctgtaggcctccccctgaagtcctggctgcatgctttccccacagttgtcatacaaagagcttcccaaggcagctcagcctcaggagccttcttttccactctcacctgctccccagcacaaccctgggagatgggtttattccagaatctggaggcacagagaggcctagtgctgcccaagttgacccagctagggaaggcccaggtcagtggtcacatctgatccaatagagcccagatttggagccctttctgctgctaaggatgatcctccttgatgtcactgaggtcaggggtctgaatccattgtaacactttagtgagagcttctttgtggatctgaccctgtcctattgtagaggactcagtgatgaagacttggacctggctctgatgggttcattcttactgcttgaggtctgttcattcatttgcccatccattcatcaatccatccatccatccatccatccatccatccatctatccatccatccatccatccatctacctacctaccagtccatccatccgtctgttcatctgtctgtccacccatccatctacccatccactcatccactctttcatctacccattcatccatccattcagccccacacccattcatccatccattcacgtatccatccacctacccatccttccattcactcatccacccatccacccactcacccatccatctatccatctactcatccattcatctacccatccatctatccatccacccacccatccatccattcagccaaatactcattcatccgtctacccatgtatccatctatccacccatccttccatctacccatccatcctccttcattcatccacccatccagttacaacccatccacccatccatccatccatccatccatccatccatccatccatccacccatccacccacccattcattcacccacccatctacccacccatccacccacccatccatctaaccatccatccatccatccatccatccatccatccattcatccaccccccccacccccccacccattcattcacctacccatccacccacccatccatctacccatccacccacccatccactcactcacccatccatccacccatccatctacccatccatctatacccatccgtctatctatttacctgcccacccacccatctatccatccatctatccacccatccacccacccacccatccatccatcctgcttcatccatccttgctgtctgctgggcacacagaggtcttgatgaggacctgcactagtttcccaaagctggttgtctcagccacctactctgaccaagctggctctgtcttgagctctaacccctgtcctagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccaggtaagggccctgatggccagggcaggggctatgggaagggctgatcttgccagggggtgtggcattcctggggtgcacactgtggggtccttcacttcctgttaccccacaagttggaacccacagaagcctgaagcttccagtgatgggggatttgtgaggcaggaaaaatagaagctttcttcctggggctccatctgcagggacctggccccagcaccttgtcccatattcgagcgcagggacaggctcaggccacagaggctctcaccaaaacccagctatctccccagtgctgggcccatggtgatcctgagggatttcctcccagtcactggtcccagaattgattggtttttaatccagacactctttttcctttcccccctctcttcttccttgcctcctttccttctaccccctctgcccccagtagctgagattgatctttcccaaggtatatgcacactccaaacctcattttcctctcctgtgaaatggggtgggggattaaatgtcagtgccctgtgtgagaagggcaggtgcctggaagtgcctgaggcctggctgaagacctgagacctccctgcaacccccactctgctctacccatgacagagggtcaccctccacagccggaagccccacaggagcctgcactgaagtcagaattttcccaggtggcctctaacaccatcccgctgccactgccgcagcccaatacctgcaaaggtaagcagtgtgggtggtgtctccaggacagggcccagggtccagggggtgggtctgggctgcttgcaggtggtgagctgtctggtgctgggtatgtgcaagatggcccctccaaagggtgtgcttctgttttggggatgatgggcttaccctgggctgagtgaggagctgaggaagtcactggggagatgtggtgtggggacagcctagggcctggtgtgtgaccccaaaccagccagttagctgctttttgtctccattcttgtaacgttgaggtagtcaaatcctggtttgccgacctgttgtggaggctgtgttcagcgctgtgtagaaagtcctcttctttgttgttcttctcctcattcccttcccctgcttttttccctgcccccttccctttctcttcttccttctctcttctcctccatctccccattgttcttgctgtcacgcaaggcatgggctgggatccgagtggtgggggaggtagacccagaacgtcgtccccgacgccagacggtgttggagcagacttaatggatgaacctgtgaaaaggaccaggagtggcgttccttgtctcccagcatccctgccttctaggggccttgtttctgtgtctcactagtaggttagagccagggatggggaatgagccagtgtggaccaaggccagggcctggtggtctctgatttctgtgtggtttcctccagacaatggaccctgcaagcaggtgtgcagcactgttgggggctcagccatatgctcctgttttcccggctatgccatcatggcggatggcgtgtcctgtgaaggtgagtgccttggggtgccctcctacctgtgcaaacctgagttggcctgtgatgggggcctccaggtgggggtggctgagacttaaaacttgctgagtttgtgcaggaagagtcttggctgctatgatgagcacccctagtggagcaggttaaacagtcactccctctcaccgtacgtgcggtgtatacatgcactccagggtgggcctgcagtgtggctgcataggaatggggcccgggctcctcacatggtgtcgctccgcatttcccggagcagtgcttctcctgccgagtgtgcacctgagtccctggaggcctgggtcaaacaggcagtcctgagattctgccgaatccccaaagatcgagtcaataggtctgggtgggtgggcctgagaatttgtgcttctaacaaggtgatacggatgctgctggtccgcggacaccacctccactcaccttgcccttgagggttgccctggtctgtgcagccatgtccaggcctgggtggagagggggaaggggaagcaatgccggttgttttaagggcagccagaagtgtccccgatggggagtgggagggaggctggacagcaggaatgcctggctgaatctgttcccaaatgaaggacactggtgatgattagctgtccaaggatcacataccttccacccccgtggccccgcctaggtctgggtcttgtctttgtggggcctctgtgggccaggaccccccactgtaaaatgaggccattggatccagcacctgctgggttggttcccacagtgaatggcttctgaagaaccaagctgagaggtctcaagactctacctcctgcctgggggcaggacagaaatggagtatgcagagtctaggaagtatggcagttctggctcagagatgagaccctggtgggtgtctgggggagaacagagtcaagtctgcctgggtgaatacccacatccctcccagaagctgaaagcccgtgtccatccccagccgagactgttctgatgtggacaaacaccgtcctacgagcccagagaggacagtagacttgcccagggtacatgacgtggcagtgaccggcaggccttcctctccgatgctgggggcagctctcaggtccaggtggtgctgggttctctgggccccgccccccatctcccagggccctgaagatgtaagagctgcatcttttctggggcaggcctcctttgggcccagccctgtgaggcccctctgcctgtgctgctcatgcagcctagcccatgtctgcgcatccccaggaccccctccctcctctggaagccctggcagtgaaagctggggtccaggttgcaatgggcattcagagaggcacctgctctgcggaggagcgctgctcaactctgctgcattggaaataatcaagtgagttccaaacgtgttgagcacaagaatgattaaaacacttccagattttaggtttctcttggtgtgaaatctgcatacaaggggcccacacccctgtccccttttggatggagcacagacactcagtgtcctggagcccctgtgggcccttccctggtttatgtggctggcctggtcccctaagtactggactttgcaagctctcgggggcatggttctcttggcgcccgtggatgtgggaagtatcgagtgcgtacgggaggcagcctctggtcctgtccccactgtgaccgtgggcagccacccaccctctctgagtctcacctcaccaccgtccttactggggcagtggggaccagctctgcacactcacacttgggcccaaggcccagctacacacagtcaggcggggaggccccagacaggcccctgccccttgctgggtctcattctcctgtcactggatgctccgtggcagcccatgtccctctaacagtccttctgtttttcctcctgcggctgccactagaccaagacgagtgcctgatgggtgctcacgattgtagccggcgacagttctgtgtgaacaccctgggatccttctactgtgtcaaccacacagtgctctgtgccgatggctatatcctcaatgcgcacaggaagtgcgtgggtaagccagggccccgcctgccgcccgccgtcacagctctccgctctgctccacgccaagcccaccacactgtggccacatgccaaagggcctgccctttgcatgtgagctctcagcacagccggcatctccgtgctctatgtcgtgcccttgtgtcctggcgtcttgtcccgcttggctgccagctccacccggaggctgctttccccagggacgtgtctatgtgtcagggaactggatgtgtggcctggtggatcagggaccccacctgggctgcaggaaaatgagggggtcagacatgctgggagcaggataggatgtgtggggtctggaggcaggaggcctagccaagcaggacccccagaagctccgtggccttggatgaatgactcgtcttcccccagctgtggttttctcatctgtagtaaggaggctgttgatcctcttttgacgattgtgtgacatgtatgtggggtagcacagagcctgggcaccgtgagcatgctacaacagctacgtgccttccccagggtcccccgcagagctggtggatggaggatggggtccagcagagcccgcctcgcataccagcttggcgttcctttgctatgtgaccttgagcagcggagctctcctctctgagcctgcctttcctcccctctgaccgtggggccagaggactgggtgagggctcatacccggcacctggcctgcacatcgcccgggttggtgctcagtgatgcctcttccttctcctctcttaggccccatgtgggccaggcgccgtggctctgggagtgctctgtgcgtacatgtctgcagcctctgatgttttcagagaactgtaaacccttgtgtcctccagtttgtggtcccaaacggagatagacccaaagtagctgggactcagggcagacggtggtaaatgccatcacagagacacgcgcagagggcgaggtcattccagctggtggcatcgggttagcatttggaaatcagtaagggcatgcagcgtagaaggaacagctcaaataaaggtatagaagtaggatcagaacctagtgcgttcagggcatgtgaccagagccccgtttgtcttctctgtgcttggggaccatgtccagcctggacatatccccttccttcctcgcctttcaccactgggcacacgggcccatggtgctgggctgaatgcctgctgcagacatgtttgccctaggcctctagccgttggcacaacatgcgcctcctgaccctgcttgccagcagccggccagctcttcctgtctgggttgggtccgtgtgtgtacgtctgggaaggcggatcccaccagggcccacgagcacccctcccatgatgccctgccctctcgcggtgcctgagtacgcaggcttgtctagctgcctggagataaaacatactaaaagggatccccaggcagctgcaaagtgggttctgggaatgaaagagcaagggcacattccattcagcaaaattgatgagctcacatgcattcctttctttctttccctccttgttcatcctgtacaaacccgtcagcacctcttcatccttccatgcccctcgcacacgtgttcatcccgtcgtgttagtacctgccgcgcgttctttccgtcatttgtacgtccacaaatgtccactgggctctcctgcagttcatttgtttgctctgcacttgtttattaacccaggcaggtgagatgcgaggcttatgctaggatcaagagtgtggcctttgcagccagcctgcctgcctgtgctgaaatcctggctctttcaatttttaatcataagaccttaaaccagttggttaaactctctgagcctcagtttcctcatctgtgaatgagataacagcacctacctcaaagagtcattgtggggattaaatgaattagtccatttaaagaagttgctactcttgtgacatcattgttatgattcaaccaatgtttcactgaggcaacctgcagaggtagtaagctccccatcactggaggtatgtaaatcaaagtgggacagtattgggtgtgacctgtgccaaggactcccctgtgtttaccatttgccttttgtggtctgtactttgaagactgtcttgggcacagggaaaagtgttgcaggtggtccaggctgcaagatgtgagggaggcagccccccagctctgagccccccatgaagtggtgctgcagcagtgcttgaatgatgggtacaagggtacagctctgggccgggcactctggcttccgttcttgatctgccacatggctgtccgtgtgactctggtccagtcacagcactaccgggaggctgatttcctcctctgagaaatggggcttgcagaacgatgtcctctaaaccacctgaccctggtgagcctccgctcatggtgctgctgttgttaccataattcctccaggctgtgggaggctcttgggttatgggcatttctggggtcctgggaatggtctccctctgtaagtccagcctgtaaatcagaaatctttatcttgcccagccaagccttccttggaaaccactggcccagaactttccctttccctcctccccattcccagccatccccgggtctgcctggcctggacactgtttggttcacctgtgagtttgggagggtctctttccccagggccttggcctccacctctccacctggtcctctagtcatccttgtagactcagctcgaatgtcaccactcctgagaagtggctctgatggtccagaccacagcaggcagttctctggccagagcccccaagcctccacctgcctgtccttgagggccggggctggggccgacacacccacttggtcacaggagcctagcacagagttatgtgtgtggaatggatggataagcaggggactagtgcacctgaccgccgccacaaggtgcagcaccaggagggggtagatgggtcagccttccacactggcttagcgctggccttggggcggtttctgagttggtggcctctgtggcccctgggcagttcctgagttggtggcttctgtggccactgtggcccgggggtggtttctgagttggtggcctctgtggccccagggcagtttctgagttggtggcctctgtggccccggggcagtttctgagttggtggcctctgtggcctggggtggtttctgagttggtggcctctgtggcccgggggtggtttctgagttggtggcctctgtggccctggggcagtttctgagttggtggcctctgtggcccgggggtggtttctgagttggtggcctctgtggcctgggggtggtttctgagttggtggcctctgtggcccggggacagtttctgagcctctgtggctccccacctcccttatgcgtcctctctctccttcactggcttctcctctccccaactgcttatccctggaatctcccaggagctggtccttggcctcctctccgtgtgatctctcccctgggtggcctcagccatctgaccattctcaagttagtattcccactcagaccccttgtgtgaactccaaggcatgtcctcagctgcctcttcaccctcaaactctcatggccagcagggctcccaccttcccctgcagcctacacctcacagccggccctcactgccacctgtccagctgcttggccagaagctctgggcccctcttcctgcctcaccttcatctcatccatcagtgggttttgttggttccagcttcacaatacttcagaatctagccacttctcccagcccattgaaggtagtccgagccactgaatctcctgcctggatcctcacccctattctccagcccctgccagggatccttgctccaaataaataagaccactttctcttctgcttggaactctctatggctccctccattcctcctgctcaccctctttctcccttccctcccctgcagcacacccacctcctggtgggcccttgaacctgcacagctggcttccttctcagggcctttacatccctgacgcctctgcctggactgtctgcatggcccagtctgtcatcttgtcacatctttgctcagatgtcttcttttctgagaatccatccctgacccatcccgcccagcgccccccgctgtacctgggcactccctgtctcctgcgtcctgctctgttttatccatagcactcatcaccacctccatttatgtttgtttatgtatttattgtgtcctctccccttgagtgtctgccccacaagggcagggatttctgtcttggtcactgatgtacacccagtgccaagaacagtgcttggtgcatagcaggtgctcaataaatctttgttgaatgaagggatgtttgggtgccgagacatcagccacatctccgaatggtgagctccctgagggcagggcctggagctctctccctcctggtggcccaaggtctgctggctgcactcagccactgtcctggggactctgcagcctctgatggcctcgctctccctgcagacatcaacgagtgtgtgacggacctgcacacgtgcagccggggcgagcactgtgtgaacacactgggctccttccactgctacaaggcactcacctgtgagccaggctatgccctcaaggatggcgagtgcgaaggtgagaagggcccagaaggaccaactggaggccccgccccatggccagttttgccccgcccctccctggtcccacccctgtcctgccctggccacccttaggcctggccacgcccctctccatcccctcctttctagcaagctccccttagttgggtttcctgctggtgggaagaccccacaatggtggtgtttggggcggagatgggagtctgaggcagggtgagggcaggctaggtccaccccggctttgctcctgcctgctggtgtctgggtgccagttatcccccttgctgtggcctggtttgtacattgaggtggagcccacagagggttcactctgtcccttttactggaaaattctagccttctaatcagagggaggggtttcatccaaccctttcaacaagtacgtcctgagctgctcttatgtgcctgccgggtcctgggtaccagggatccagggtggggtgctgtggcccttctctgaccttgtggttggggcagcggggtccacacaggcaaacagagatggcagagtgactgggggctgggggcccctgtaagtggtgggttcaaggaggcccctggaggaggtgacgttggagttgagacctgaatgagaagctcctggggagggtgttcaggcagagggggcagcgtgccaaggcctgttgggtgtggggaggaagcactcttggcatgttccagaaacagaaagacagtctccggggttggagccttcttgctacctgtgctacctccctaaagtgtgaacacatgaccttaccttagagatttaggcacacggtggggatatccccacttccgccccctgcaagtgtgggacagcggctaacaaagcaggcttgggagccagtcccccgggttctggtcctggtccagtgctccccagcagtagagccttgtctctgcctcagcttccctccttgtaagatggggcttgtcatgacatctacttcttacggctgtgtggggtttaaggaaataaatccatctcaggtgctcagaacaatggtgggaccaaagagaagcgcagtaaacatggtcacgttgttattactcctgggacaaaggccatgccggcaacaatgtggctgtgccagcttcccagggagatctttgtggccatcagggtcatgggtctgagggcggggatgtgtgggcagggctgctgagtgtaaaggcaggacctgccccccagcccttgacacccagcctctccgctgcagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtgggtgagcgggggctgcagggctggggatcatcagcctagggctctactggaggcattgtgggggcttttagggctttagagaccagggaggcctggcttgctgctccattcctctcccagcccccttgtccctacctgtgaatgggcatgtcaagtgttcaaccctgggggcaccactgtccccaaagtgtagctgctcctattaccttgagctgtgaaaccttggctgagttattattcagtggcctctgtgaagctatctgtggggttggactggatacgaatgagtatcccttttttttaaccagtcagcagtggctatgtgatagatcatgacctggcacagacatctacacacatccaggaagaactgcaataccagtgtccccacacagtactgcatgtgacacccactgaaatttcccattttcagagaatgctagtgagacctcctagagtgattccatgccgtactcgagggttgagacttaacagttttacagatgccggcctagtccccaagtgggtctgagattctacccgctctgcgccccccatcaactccttccaaaaaagggtttgcttagtctctgtgcctctaaaacttcttgttaatgtgctgtgcttccctggcagctagacccctggcacgtggttggtgtagttatcctagcactcagcctcgatcccgccctgcctccagctgctctgttgggcagatgtgagagggcgtagggccagccatcaggtgcttgggttctgggaggtgtatcccttgggtagtggggcacaggggtaggacagtctggccctgcaactctgaccagggcaggtctggagcccaggaccgaccccctcccagtgtggccctgggaggggctggggcctgggaggacaccatgccgggctccctgtcacctacacctgcctctgcagacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtgggtaaggccagccgcctccgccctgccagccagcccggcctgcccgcttccccacccctgggaggtgtgtgtggagggagccccaggcctcaaggtaccctgctcaccccccacagacgtgaatgagtgtgagacaggtgtgcaccgctgcggtgagggccaagtgtgccacaacctccctggctcctaccgctgtgactgcaaagccggctttcagcgggatgcctttggccggggctgcatcggtaggtaggctggtggccaggacccctggggaacacctggctggtcccctgccctctgtgcactccacctccccatgcccagcacctccactgcctgagtggggcccacctgctggagtccacaaggtcgccttccagctggcctcatcctcctgctgggcctgccaggacctggctctggcccccgcccccaccttctcagtccctcctgtctcatctctgtgcctctgcccctcttactctggtctttcctgcttccctcggtctctgtcaccatctcttcttgtctgttgctttgcctgtgtctgtccctctggcctcttcctctcgccttcctccaatacccttgctgcctccccgccacctggtctctttgcctctctctttccctgtcctggcctctccctgtctttccttctgggtccctctcccacttagcctccccttcggccctggatggcccttgggggtggagggagctggctttagggccacctaccctgtacctgctgcctgccctcccacagacgtgaatgagtgctgggcctcgccaggccgcctgtgccagcacacgtgtgagaacacactcggctcctaccgctgttcctgcgcctccgggttcctgctagcagcggacggcaagcgctgtgaaggtaggctggccctcatctctgaccctatgccgcctggtatctgtagtgggcagacccgccgtggaaggcccagagccttctgtgacccttcacccttacaccttcaccctcacaccttcacccatgctggcccttccttcctcctctgtctggcccaaccctctctggcctccactctcaccttccttctgttgttttctgccctgaattcccctgctgaggtcctggggctccagctccctcagtccagagaggctgggtctctgtgtcatctgtacccacaaatagggtatctgaggcatccaaggtccgtgtacctacctgtgcgggacgcgcctgtggctgagggaggggctgtaacattattcccatgtgtgttcatggtgctgttggccccagctcagtggggactggtgtggagtaaggccaccaggctgctcagtgagggggcgaggggccaagccagaaggccatggggtcttggccccatttacctggcacggtctttcccagcccctccccagcctggaggcaatttcctcattttctcctggtgaggtgagttggctgagacccctgggaggccatggatcccttcccagtcaccaggcctggcaggagagctggccctcgcataggtcaaccccagtccaggccggggagcttggtgggcctggctgtcagacagcatttggatgggctctccaaggcagacttgggccctgccatgactgcctgctggtgtccctgcagacgtgaatgagtgtgaggcccagcgctgcagccaggagtgtgccaacatctatggctcctaccagtgctactgccgccagggctaccagctggctgaggatgggcacacctgcacaggtacctctcccctgtccaagggcccccttccagagagtcactcctttcccttgtgccaggctccccgagagtccctgctgggccatggacacagaaaggttttagcatcagatctgagttcaagccccagccctgcagtttcctggctgtgtgaccttgggcagattgcctctccactctgacctcaggttcctcctctgtaaaatgggaagaatggtcctgacttcagggggatgaagacctaagtttacataggtgcccatgactggcatctgattgtcccctcagctggtagtagcagtcacggagcagccctagggcataagcactggagtgggagtcctgttttgcttcgtggccttgggcaactctcttctactctctcagtccacttgtcttcatttaaaaaatgggcccctaagctctatggctgtgacagggacaggctgactgtcagtggctgggctctgtgggtggacgaggttcaccaggggctgaacctctctctgacagacatcgacgagtgtgctcaaggcgccggcatcctctgcaccttccgctgtctcaacgtgccagggagctaccagtgtgcatgccctgagcagggctacaccatgacggccaacgggaggtcctgcaagggtgagcaagtccccccacacgcccccgcctccatcagggccttgggcaggctccaagcaggcacagaaaagctcacacagcttgcgtgcacttggagcccccacacccagtgaataaatgcaggatggccaatgctaccagtggccatgttaactgaggttgtgcctgggatgaagaacgtgacagtcttgctgctgctcaatccagcttagaatcttccaggcttgtgctcagctctggaccctgccctgagagtggaacagagatactatggggtgtttctacggaggcacgaagcctgcccagtgaggagacggcagaagagccgcaggggtcccaggcagtgtcccgagtctctgcagtgttatgcagggacaaggggatcaggcaggtctgtggacccagagagtagggcgggatcctggggagtagagaagggtgtcatggggaggcttttcccaaccctggtgcagaagggcattctcctcatcagagctgtgtagagctgggaggggctgcacaatgggagggtcccccactcccctgctattgaggatgtacaagagctgggcagtcacctgtggaatttgcaagagaggggactgtgtccctggatagagaccgtgttctgtggtatttaatgttcctcctctgctagagagtcgtacttctaagttcagtgccatttgccaccggattctgggcctggtaagccaccagggcaaggtgaggggccaggacacagaaggggtcattgccccaggagaaccaaccactcagccccatggcctcttggcctctcgctccctcggcccctcggtcccttggcgccgcagagctcagacctcctcctgacttcagtggccaggtcttcctcacacatggagctgagaacctggagttccctggggtgcagctttcggggtgtgaccagggtcctggcccagccttgggcattttcttggcccgcaaaagcagaggggtcagagttagctcccagaagggtttggagttagctcagcacagtgcaggctggtggttgctacctgtcagtggatcctgagatcaagtcgatagacttcagccagctgcctgtgttctcctttccattagcatagaacagaaagcagcatagggcagagtggagtggcgtggcatggggcaggtcagagtgcagtgtgaccctaggttccagcccttatgtgtgtacctagtcccaatgcacaaggagtcctttgtgtgggtggatgcaaacgtatcagagtcgtaagttaagtcagaagaccatgagaagaccctataaatcactgactgggaggcctgctcggcccacagaagctggcttacttaggtcttgctggctgcaaagccctcttcttgttaattaaaaaaaaaaagtcggtatggactccgtaaaaggtaaggattctattcaccgtgtgctcagctcggcaggaaatatggctttatccttctagattgtgatttcacatgtgacaccaaggccctgttcctcctggtggcagaacacaagtgtggccacttcaaggaagccccatcagacactgcagtgacatttgctcttggaggagtttcaggatgcaaacctgtctgcattgaggacagactctccctggctgtttattttctgacctacaccaaacaccttgggggtgctcaggacacctggatgcccacatgtgcctggctagccactagagagggcttcccgggacctggcatatgcccatcgtgggtgcacctgaccctagcgcttctctcctgcccgggcttgcccgccaccccgtctctgcatcctcttcttggggtggctgctcctctgccccgacgacttgctctgtgttgaagaactggcgaggccaggtcccctctgcaggcccccagtgtgccaccagccccaccaggaggttggggcaaggtagagccccacacctgcacatctgccgccctcgcttgctctccagaccttccttctggaagagccttctgactcacatggtgggcaagggcacagtgggggctgccggctccccggcctcatccatttcacaggtcactccatgtagccacttctgcagctcctgaccttcagagctaagaggctgtcctcttctcctgttctggcttgggccaaaccctgaggtctctcggctcaaacagggtggggggaggctggcttgggggaaagaatgtgttggataatgtccccgttagcctttagcctctctccaatagttaaaaaagaaaaggacaggaaaatccgaaggaatttagactcagccctctcacctggcatgcacactccatgaaggtagggccctatctgtccggctcaccagcatctagagcaatgcccagcacatagtaggtgctcattggacagttgaccccatgactgagctgagtgggaaccactgctcatgtttgcatgcatttccctccagtctttcccttagcagatataaacacactgcaaacacacacacacacacacacacacacacacacacacacacagctgaaagtcactctgagtcccggtcgtttctgtgtagtaagagcccatctctgcatgccactcgatggggcaggccagctttgagcagcactctcggtcttgcccctgagctgttgtgggcttctgggcctcaagtccttcagaagcccttggaagcctctcttccggggctgaattttgcaggactcccctgtttcgtcctttttgctctgtcacccacttttgcacatctgagttgcggctgaccctggctgtctctgatgaggctgtgatggcagccctggatacggggcctagtccagctcccacgttagcctgcgctctccaggggcctggcagcgccgatgggcgaggccctggggcgttagggaagacctgcgactgaccgcctcccgcgagcttggtgaggccaggctgtagccgctcacccttcttggcccttcccttctgggcatctccatcagcagcagcccagagccaaagcaaaaagctcccacgtccttcctgccccacccacataagctccagggtcactggagcgggccaccgggggcataggccaaggagcaggaggaggccctctccatgtggagtccacgagtgaataatcagcagcctgggaccacccggttgggctctaccctgcctggcctcttgccgtgttttctcccactcacttctgcgccaccctggggcctattttacggagggagggaagtgaggcctggagaggtaaatagatgtgagctgacccgctacaagagagcctggcagccaagagcccagagtctgaggcggtccgggggtattgagtcctggcgttgccctggcagctatgtgaccctgggcacatttgtggacacctgcacctgccccgtggggttggcgtgggtgcagagtccctcaagcatcacagggatgtcaggcagtaaactctggaggcaggctgactattggtattattactattatgttgttgttattgttaggagtcagcttggcatcatgactgggtcccagattttggcatcaggcatgcctgacttgctgccccgctcgctgctgtgtgatcttgagcaaggctttgcccctctctgagcctccacaccctcctctgtctgaggaagccagtgaccctcgctgcacagggctggtgtgaggactgagtgaggacaaattcctaaatggtgtcaatatggaggattggaaaacaaaaactgaagccctctgtggttgcccctggaacaccccctgcccctaccccacgggactttctggaggcctcctgaggcggccctctctgggctgagcagctcatcctcaaagtttctcaagaacccatttctaagaccttttgtcctccagggtgcctgtgggttacacacacacacacacacacacacccacacacacccctaccccacccctgcttctctgagctttcgtgaatggtatctattcatatgtctgttgacgtttatatgtgtatgtttctttgtcccaaatgggccttctgtgtgtttgtttctgtgcacctgtggaggtgtgcgtgtgctcacgtgtgtgctgaacctatgtgcctgttggagttgcacatgtatgtttgcttctgaatgtacaggaagcgtgagcacgtctgttgctcatgggggacattgactcatagctttgcgtctcggagtcgggacttgcaagtgatgggtcttggacttccatccagcaagaagtattgagcgctgctccatgcaggcactccactgggcactggggacagcatgggaatgagaaagacaaacacccctgccctcctggagcccaggttgaggggggacggtagaaacatacaaaacatgcagccataccaaacagcctcggtgtgttgcagagcatggagccataggaggatgataaaatggggtgggatggagggtgatggggcaggaggaccactgtagagtggtcagggaggccatcctggagggggtgactcaagatctgagagttaaaagatgagaagcctccagcagtaggaaaagctggggatagcgttccagcagcagcaaaggccctgggtaggataagggtcaggctattggggcagcccaaggatgtccagcaggactgtggcctctgtggaagagaaggagcttagagaggccagagagccttgcactgtgtggcttggcatccaggggagggagctgggctttattctggagcgcgagaagccttgggagggcatgacatgaggtgattgacactttagagccaggccccctgctgcggggtgccgagcaggtgagatggggcatgtgtgtgcagggaggcacgcgggctattctcacaggtccggctgccgtggggcccaggcctttcatgcaggctggggagtttcaggctgggtcccccagctgtggggaccctgccattgcccctcttctcccccagacgtggatgagtgtgcactgggtacccacaactgttccgaggctgagacctgccacaacatccagggtagcttccgctgcctgcgcttcgagtgtcctcccaactatgtccaagtctccaaaacgtgagtgtccccaccccagtcccagtcccagggagcctgtcctggtcctgtactatccagggagaggctgagagatgggcgcctgccttgatcacctccctctcgtcccagcccctgactgctgggtctgtgggctaggtgaccaaaacaaatataagtagcttttagagagttcagggttgagagaaggaaggggaaaagacacacagaaaacaccagccctcttcctcatacacacacatggtagttactgctgtgtgaccagttatcccaaccaacatttagcaccagaatacaacagatacttactctttgtcacgcagtgtctgagggctaggagcctgggagtggtgtagctaggtggtctggctcaggatctcaggggctgcctgtccggggtgcgggatcctgccactgctcatggggctctgggcaggaggcctcagctccgcatcacatgagcccctccacaaggctgcttgtgacatgccactccccagctcagtgtatcagaagtgccagcggcagccccttaacctcacttaacctcagaactgacagaccgctactctgccaccagccacacggcccggcacttgggagggaccctgggagggacactgggtgcactgggaagaagggagaaggaggaggaagggaaggggagagggaaaaggaaggagaaaggaagaatgggaggatggcaggagggaggaagaaaggagcatggggacaggtaagagctgttaacgagcctggccagtgccatgctaaactcacccattccagtgagccggtgaaggttttattaacctcatctcgcaggcaaggaaactgagacccaggggacgtaaggggacttgcctgaggcttcccggccattagggagagagctggcccttgatcctgccgctgagctgtgccatctgtgtccccgtctggggatgaggggggtgggcgagctgtgggtgacccggcctatcctccctgcaggaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaactataaagtagtacatgtacattatataaaaaaaagttcaactagtatgaaagggttataaagtaacagaggaaaacgcctcttggtcccttt

SEQ ID NO: 36498 - DNA, 11778 bp, Homo sapiens
cacctgcaccccgcccgggcatagcaccatgcctgcttgtcgcctaggcccgctagccgccgccctcctcctcagcctgctgctgttcggcttcaccctagtctcaggtgagtggggcggggagaggcccggcgcctagaggggccgagccacgagcgccaggatggagccaggcggaggcgtagcctctggaggctggggaagtgggaattccgggggcggaagtggcggggacccttggagcctagggtgtggggtccaatgtgctggaggtggagagaccactgatggctgcaatttgggaggattctgtgctgaacgcggacactccgtggctgcagtgggctgggggtgggggctgctctgcctcgacctcggaagctccgagacgctcagctgtgcggcgtcccctagggctgagatctgagggccccgacgccaagggttagggagctctcgtactcccaggggtcagggactcctggtctggaagaaggagtctctgggggctgtaaggggactcctagggccagagactgagaattccttggggttaaggtttggagcaggaggtgggcatcctctggggctggcgctacgccccaccctcgactgtcccgggcctcccctcccaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatggtaaccccacggcggccgagcgggaacggggcggggccgcgctgggctgggaggaggtgggagggcccgggttccgggaacaggggcgcccccggacccggggacccccgggaaagtcaaggcggttgaaaccagatccgtcagtcctctccctcgcacggcccaggggtagacaaaggcgtcgttgaaacgcagccaagggggggtccccacccctagctgggattcgagtctctggtgcatgacgggcttccgggcacgcacagccgggacattgttccccgcggcctggggacccggggccgcagtttccttctcgaaccggccgaagcctgccctgcgggaaagcccggagcctggggcgctcacctctcctcttggagtccctccctgggggcctcccccagccctggggaaagactgggagagcctggcctggcaagattttccccaattcctctgtccaggcggaaaggaactttacagatttaggaaaatgccccgctcatcttaaagatgtgtaagggagcatcggtgagaaaaaaatgttcttgcccaaggtcacaccgccatcccatggctgctggagtcatagtgagggttcagcttttgcctttcaggccaactggctgagtgattcgaagaaagtgaggaatcctccctggacactgtatcgcccttcgtcgtctttcagtcaatctcttccactctaaggattgagtgagcgcgagctggggactctctcaaaggtgcttgctggagctgcagtctccaccaggctatcagaacagggggtggcttaaacagcatggaatctcagctttccgttctccagaggaaaatgctgaggattagaggcagggataggacctggagagaaccaaggtactgtaatgatgttctttatccagaatacagcccctgtgacttttcctctctgttatttccttgaagatgccagcacaggctgggaaggtttgtaatacggtgacccaagacaccgatcagcagggaggtggtaagtggagggggactggcagcccaccaagggcagcttcaaggtcatgagtcccctcctctgggccagggagaggaggaccagaaggagagaggaagatttggagagaaagcaggcagcagccagatgagagaggtggaggagcaaaggagggagtctttgctgtttgatggatgaagaatttgttcccttatctcagatggacagactgaggcaggaagagggacaaggtcagatggcctcctgagccagggaggcagcctggaggtttgaatcctagttctgccattttctagttatgtgatcctgagcatgttgtttacctctctgagcctctgctctaagatgggaataattccaaactctataggattggcatgaggactaaatgaaataatgcatctaaagtgtctattagtgagaagatactccatacacagtggcttgttttgatcataaatggttccctatttatttccagggcagcccaatattacaggttcctactcctttcaagagaatgaatttctttgtattaggaagtcaagactgttggcaacttaacaacatttttttttgtatttatgctttaagttctggggtacacgtgcagaacgtgcaggtttgttacataggtatacatgtgccatggtggtttgcttcacccatcaacccgtcatctacattaggtgtttctcctaatgctatgcctcccctaattcccaaccccccgacaggccctggtgtgtgatgttcccctccctgtgtccatgtgttctcattgttcaactcctacttatgagtgagaacatgcggtatttggttttctgttcttgtgttagtttgctgagaatgatggtttccagcttcatccatgtctctgcaaaggacatgaactcatcatttgttatggctgcatagtattccatggtgtagacgtgccacatttcctttatccagtccatcactgatgggcatttgggttggttccaagtctttgctattgtgaacagtgctgcaataaacctatgtgtgcatgtgtcttgggcatttgcgttggttccaagtctttgctattgtgaacagtgctgcaataaacctatgtgtgcatgtgtctttattgtagaatgatttataatcctttgggtatatacccagtaatgggattgctgggtcaaatggtatttcttgttctagatccttgaggaatggccacactctcttccacaatggttgaactaatttacactcccacgaacagtgtaaaagcattcctatttctccacatcctctccagcatctgttgtttcctgactttttaaggatctccattctaactggtgtgagatgttatctcattgtggttttgatttgcatttctctaatgaccagtgatgatgagcatttttcatgtttgttggctgcataaatgtcttcttttgagaagcatctgttcatatccttcgcccacgttctaatggggtttttttctcgtaaatttgtttgagttcttgtagattctgtatattagccctttgtcagatggatagagtgcaaaaattttctcccattctgtaggctgcctgttcactctgatgatagtttcttttgctgtgcagaagctctgtagtttaattggatcccatttgtcaattttggcttttgttgccattgcttttggtgttttagtcatgaagtctttgcccatgcctatgtcctgaatggtattgcctaggttttcttctagggtttttatggttttaggtcttacatttaagtctttaatccatcttgagttaatttttgcataaggtgtaaggaaaggggtccagtttcagttttctgcatatggctagccagttttcccaacaccatttattaaatagggaatcctttccccattgcttgtttttgccatgtttgtcaaagatcaggtggctgtagatgtgtagtgttatttctgaggcctctgttctgttctgttggtctatatatctgttttggtaccagtaccatgctgttttggttactgtagccttgtagtatagcttgaagtcagttagcgtgatgcttccagctttgttctttttgcttaggattgtcttggctatgtgggcttttatttggttccatatgaaatttaaagtcgttttttctaattctgtgaagaaagtcagtgatagcttgatggggatagcattgaatctataaattactttgggcagtatagccattttcacgatattgattcttcttatccatgagcatggattgtttttccatttgtttgtatcctctcttatttcgttgagcagtggtttgtagttctccttgaagaggtccttcacctcccttgtaagttgtattcctaggtattttattctctttgtagcaattgtgaatgggaattcactcatgatttggctctctgtctattattggtgtataggaatacttgtgatttttgtacattgatttgtatcctgagactttactgcagtttcttatcagcttaaggagattttgggctgagataatggggttttctaaatatacaatcatttcatctgcaaacagggacaatttgacttcctcttttcctaattgaataccctttatttctttctcttgactgattgccctggccagaatttctaatgctatgttgaataggggtggtgagagagagcatgcttgtcttgtgccggttttcaaagggaatgcttccagcttttgcccattcagtatgatattggctgtgggtttgtcataaatagctcttgttactttgagataccttccatcaatacctagtttattgagtgttttagcatgaagggtgttgaattttatcaaaggccttttctgcatctattgagataatcatgtggtttttgtcattgattttgcttatgtgatggattacgtttattgatttgtgtatgttgaaccagccttgcatcccagggacaaagccaacttgatcatggtggataagctttttgatgtgctgctggatttggtttgccagcattttattaaggattttcgcactgatgttcatcagggatattaacctgaaatttttttgttattgtgtctctgccaggttttagtatcaggatgatgctggcctcataaaatgaattagggaggaggctctctttttctattgtttggaatagtttcagaaggaatggtaccagcaactcctctttgtacctctggtggaattcggctgtgaatctgtctggtcccagactttttttggttggtaggctattaattactgcctcaattttggaacttgttattggtcgattcagggattcgacttcttcctggtttagacttgggagggtgtatgtgtccaggaatttatccatttcttctaggttttctagtttatttgcgtagaggtgtttatagtattctctgatggtagattgtatttctgtgggatcagtggtgatatcccctttgtcattttttattgtgtctatttgattcttctctcttttctttattagtatggctagcagtcagactattttgttgatgtttttcaaaaacccagcttgtgaattcattgattttttttgaagggtttttcatgtctctatctcctttagttctctctgatcttagttatttcttgtcttctgctagcttttgaatttgtttgttcttgcttttctagttcttttaattgtgatgttagggtgtcaattttggatctttcctgctttcccttgtgggcatttagtgctataaatttccttctaagcactgctttagctgtgtctcagagattctggtatgttatgtctttgttctcattggtttcaaagaacttatttatttctgccttgattttgttatttacctagtagtcattcaggagcaggttgttcagtttccatgtaaggttatgcggtcttgagtgagtttcttaatcctgaattctaatttgatggcactgtggtctgagagactgttaggatttccgttcttttgcatttgctaattagtgttttacttccaattatgtggtcagttttagaataagtgtgatgtggtgctgaggagaatgtatattctgttgatttggggtggagagttctgtagatgtctattaggtctgcttggtccagagctgagttcaagtcttggatatctttgttaattttccgtctcattgatctgtctaatattgacagtgggggttaaagtttcccactattattatgtcggagtctaagtctctttgtaggtctctaagaacttgctttatgaatcagggtgctcctgtattaggtgcatatatatttagcataattagctcttcttgttgcattgatccctttaccattgtgtaatgcccttctttgtctcttttgatctttgttggtttaaagtctgttttatcagagaatagaattgcaacccctgatttttttttgctttccatttgcttggtaaatattcctctatccctttattttgagcctatgtgtctttgcacttgagatgggtctcctgaatacagcacaccaatgggtcttgactctttatccaatttgccagtctttgtcttttaactggggcatttagcctgtttacatttaaggttaatattgttatgtgtgagtttgatcctgtcattatgatgctagctggttattttgtctattagttgatgcagtttcttcatagtgtcgatggtctttacaatttggtatgtttttgcagttgctgattccagttgttcctttctatgtttagtgctcctttcaggagaccttgtaaggcaggcctgttgatgagaaaaatccctcagcatttgtttgtctataaaggattttatttctccttcatgtatgaagcttactttggctggatatgaaattctgggttgaaaattctttaagaatattgaatattggcccccactgtcttctggtttgcagggtttctgcagagagatctgcagttagtctgaagggcctcccatagtgggtaacccaacctttctctctgggtgcccttaacatttttttcttcatttcaaccttggtgaatctgatgattatgtgtcttggggttattcttctcaaggagtatctttgaggtgttctctgtatttcctgaatttgaatgttggcctttcttgctaggttggggaagttctcctgtataatatcctgaacagtgttttccaacttggttccattctccccatcactttcaggtacatcaatcaaacataggtttggtcttttcacatagtcccatattttttggaggctttgttcattcattccttttcattattttttctctaatctcatcttcattctttatttcattaaattgatcttcaatctctgatatccttcttctgcttgatcaattcggctattgatacttgtataggcttcatgacgttctcgtgctgtgtttttcagctccatcaggtcatttatgttcttctctaaactggttaatctagttagcaattcctataaccttttttcaaggttcttacctttcttgcattggggttagaacatgctcctttagcttggaggagtttgttattacccaccttctgaagcctacttctgtcaatttgtcaaactcattctccgtccagttttgttcccttgctggcgaggaattgtgatcctttggagaagaggtgttctggtttttggaattttcagcctttttgtgctggtttctccccatcttcgtggatttatctacctttggtctttgatgttgatgatctttggatgggccttctgagtggacgtcctttttgttgatgttgatgctattcctttctgttagttttccttctaacaatcaggcccctcagctgcaggtctgttggcgtttgctggaggtccactccagaccctgtttgcctggctatcaccagcagaggctgcagaacagcaaagattgctgcctgttccttcctctagaagctttgtcccagaggggcacccgccagatgccagccagagctctcctgtatgaggtgtctgtcagcccctgctggaaggtgtctcccagtcaggagacacggaaatcagggactcacttgaggaggcagtctgacccttagcagagctcaaatgctgtgctgggagatctgctgctctcttcagaaccggcaggcaggctgaagccacatccacagctgccccttcccccaggtgctctgtcccagggagatgggagttttacctataagcccctgactagggctgctgcctttttttcagagatgccctgcccagagaggaggaatctagagaggcagtctggctacagcggctttgccgagctgtgttgggctctgcccagtttgaacttcctggtggctttgtttactctgtgaggggaaaactgcctactcaagcctcagtaatggtggacgcccctccccctaccaagcttgagagttccaggtcaacttcagactgctgtgctggcagtgagaatttcaagccagtggatgttagcttgctgggctccatgggggtgggatccgctgagctagaccacttgtctccctagcttcagccccctttccaggggcgtgaatggttctgtctcactggcattccaggcaccactggggtatgaaaaaaaaatcctgcagctagctcagtgtctgcccaaatggccacctagttttgtgcttgaaacccagggccctggtggtgtaggcacccaaaggaatctcttggtctgtgggttgtgaagaccgtgggaaaagtgtagtatctgctccagagtgcactattcctcacggcacagtccctcatggcttcccttggctaggggagggagttccctgacctcttgtgcttcccaggtgagatgatgccctaccctacttctgctcgccctccgtgggctgcacccactgtctaaccagtcccaatgagatgagccacgtacctcatttgaaaatgcagaaatcacctgccttctgcattgattcactgggagctgcagactggagctgttactattcggccatcttgaaagctgaacctaaatcttttttttttttgagatggagtctcgctctgtcgcccaggctggagtgcagtggcatgatctcagctcactacaacctctgtctcccaggtgcaagcgattctcctgcctcagcctcccaagtagctgggattaccggtgcatgccaccacgcccagttaacttttttgtatttttagtagagcggggggtctcgagtcctgacctccgatgatcccacccgcctgagcctcccaaagtgtgggattacaggcatgagccactgcacccggtgatctgtcagccactttccttgtcctctacagctaatcacccagttctgtgcctgtgttttacacacaaaaacctgcacatatttatagcagctttatttataattgccaaaagttggaagcaaccatgatgtacctcagttgatgaatggatttggctgggcctggctcccctctatctaacctgggaagtggagtgtgattgtgtgtgtgtttgttagtggaaggacgtgtggtttctctctgcatggatgaatgagtgtatttggagggtcatggtgctgagagactgcaactgggattcggtctgtgggtatgagtgaagattataagtgtgtaacccctcacatgtgtactgtactttacactttaagtggcagcatagtgcttaaccatggcagcagcagttaacacatagactctgcagctagatttcttggggttcaaattctgcctcaattctgtgtgaccttaggcaaattacttaacttctcagtgcctcagtttcctcacttgtaacacaaggaaatattaacagatccctccccttcttttaggattattgtgagaattagaagagttaatatatgttaggggcttgatacctggcatgtaataagagctaattaagtgttcactgttataatttctcataactacagagtagtttgatatttcagggagaaataatatatgtttgtttcccactgctttcacaacaaccctatgttgtaattagcactgttccactggcacctaaagacacggaggctctgggagatttctggccctaggccacgaaggcccacttgggactcaagctgaggtcctgtgattccatttgggagcaggaggagggatttgcaggtgatcttcctgggcctcctgagagcagctcaggtgcccaagatggactcaggcaggcagctctgctgtatgtgaagcccagtgaggggcagtgggggggccatgctgcaggtacaagttaatctccctgtatcgcctctgcccacttacccttactcctttttctacccagataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgaggtaagtgaacgggaaagagaaagtgcattgatggccaggtgttgtgggaaacaggagaaaacgtcacccaggcggaggtgaagggaggttagttgcagggacagttgggaaaggtataccagtggggtgaccctcagcctgttctaaaagaagagtgaaaggtgggtagtctgatgagctgcattggggaggctgtctcaggcagagggaacagaataagcaagagcttggctgggtgtggtggctcatgcctataatcccagcactttgggaggctgaggtgtgcggatcacctgaggtcgggagttcaagaccagcctgaccaacatggagaaaccccgtctctactaaaaataccaaaaaaaaaaaaaaaaatttaatgggtgtggtggcgggtgccacccacccgctactcaggaggctgaggcaggagaattgcttgaacctgggagacagaggttgtggtgagctgagatcacgccattgcactccagcctgggcaacaagagcgaaactccatctcaaattaaaaacaaacaaacaaaaaacagcttggtggtacccttgggttgaaatctcgtggttgtcatgtgctacttttaacaatttctcagcaaagtaacctgaagataactgatagaatccaatagtgcagagatgagcaattgaaatctagagagggggtgtgctcttggtgcccgagagggaactatggtttctctaaactaagctatggtctccctggagccagggctctcagatgccaactgcatggataggctttgcagtcaagaagaccttggttcaaatgttagctctgacacttacctaaccttctcacctccctgagtcacagttatctcgcttataaaatgtagctaaataagatctaattgatcagataatcccattttaacctaaagaagaaggcatggcagaacttcctaatagtagaaggattcttggggagagaaatggccatgacccctcaggaaggccacagtggacatctgggaccacagtatacccaggtgcctgctagggatggtctgaccacagtatacccaggtacctgctagggatggtctgaaggagaagagtatgtctagaacctgtagaaaatgcaagcagagcccccagaaggtgaggctttgctgtgtgggtgtgtgggatggggtggggtcaaggagctggtctaggatttaagctgcaggtactcctgcctagtctaatggatattgttgttgatggtattgttataattttcttcctccagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagc

SEQ ID NO: 36499 - DNA, 104569 bp, Homo sapiens
gcccagcctgcctggagaaaagtgtctgctcctagccaagatctcctcatcacaaagtaagaatatcaggtggtggaacccccatcatacctgtccccttcctatacctgggtctgttgggtagatgcagtcctttttagagaggcatagtattctcagacctgtcgccacaaattgctccccactcattctttccctatactttgtgtctttgaaacctctttatcttctatgtttaatatctagactatactttcttcatggaattctagatgtgtaaatttacagggctgggagggtccatatctagtttaagaccctcattgtagaaatagaaagaggcccagagaagagaagggagtgggccaaatccacaaaatccacatagctgattactcctagagcaagtggggcgagaaccttggtcacttgactcaggacagtgacttttcactcttctctctttccaccaggaatgggaatgacctttgactttaaacaaatccagactccagttttaccctgaattgttgggggaacattttgttttttttttctttttagtattttcaattcttccatgtcttagtttttagggtgttgacctgtgttaatccaggctatcttctagctatatctggtttcctcaggtggaaaatgttaaatatagttaatataaaatttcactctagaatctgctagaaatgacggaggcaaagttaatgtatatataaaaaaatccaccagtgactggtggccagtaggctttcaataattgtgaagtcccttctacccccttgaaagtactgtgtttctcccctaagcagcacattgtgtgtggtggtttcatggttaaaagtttagacagacccagcaaatctctcttctcttttacttcctaagtgtgtgaccttggacaagttaccttccctctcagagctgaattttcctcagttgtaaaatagagagaattagagtattcatctcacaggataattgtgagacttaaataagagaatgcatgtaaaatggttaacatagggcttagaatgtagaaaaaaagtcctttgttttattgccaattttatttttacttatgactaagcagccatgacctcagaataatagtcagggctgacaattgtgcttcagagcaagaaggggaagaggtggtgagatggaggctctttcaatttctacctcatttcttaaatggagctgttgaaatctacccatgagctttggctggccacactgacagtgttctcctctcagcaaagaccaattagcaagtcctgataacagaagtacaacccacccccttgtaattcctcctgagatcctaaccaggatttgtaaaacacccggatatgggtaaagaaccatcccgggttttgtatcaaaccaggccccagaggaacaggacattccagtagttttgtttctggaaaagagggcacccagcccttccccctccctcatcctcccatcccagtaaaccctgccaaattggaatcctggacttaatttaggagaaaggccctgtaaccaagatactgactgaacatggctggcggactcaggctggggtctgcagtgcagcattaatgggccgctgacatgaatatggagtagttttctctagcaaaggtaagctttcttttctctcttttcaaactctacctcacctgccttcctgtgcaaaaacgtttatttagctgggtttaagggagtcctggccactaggagaaaaagtcagtggccaaaaagttggaggaggtttggctgatgtgcaggaaagttaaaggagacaataggctccttttgttcctctcgccaaaatagccaggactacactggcttgtctgtttcagggccaatcctggagccatacagaatagttcattttcctgtcgaaatagcttgctcatcttctgtttcacaggttgaggaatttattgaggtgatggatctgaggattatgtaagtgggaactcagttacttaaaaataaccatgtttggtttcatattttgagaccagattggcacagagtaagccaataaatgatagcttaactaagctaaacatctgaatttgagtagtcttagtttctacatagcaaaaatcttttagaaatcattggttcaaattctggctatttttaacaactggctgcgtgactttgagcaaatccttgcacctctctggtatcagttttttatacatcaaatgagggtgattgaaaaagatggtttctaaaggtttcatgcatgtgtgaatctataacacgttcagtttttcattactcagcatctattatatgacaagcaatccttttgctagggactcaaatatccatggttttatttgggcctcaagacaatcctgtgaaaaaaatatcatcccattttttggatgagatgactaaggctaaaataatttattgaaaggtcacatagctatcacagacaagagataggatttgaatcaaggtctttaacttcaaatcggtatgttttctatcacagagttaagaaagcagaggaccaaaaggtgaattttgatggagggtttattaggaaggctgctgagagattgaagacagggccccaaagatggctcagcattcctttattcagttgagtaatcctttgtttaggatgagcctgtctagcccaaagtagtataactgagaaagggagatggagggagagaaaagagcattgtcgcaataaaggaacagtttgcaaattctagggaacacagcaatgcaaattgttatgaataatagggaccagacccaggtgacactgggatggcaggaaggtaaggtaaaggtaagggaggcttaactttatattggctgatcttctctccaggttggcacaaggtttcagtatatcttaactaaactatccaaatagcctagaatttttctttcttttttccttcctttgagtgcctattccttctgccttcctttttattttgtattttttacttttttccaggattctttctcaacttacttatttcatttctccttttatttcttcctgttctttttcctcatcagtctggttcttctctatgggcttagctgagaaaaaaaatatccttgcccaagtgaaaagcttacacagggctttcacatctttcatattatttgacctttattacaaactaatgaggggcccaaagtagagacaatcctcatttaagacatgaggaaactgaggctcaggaagttagggacttgttcaaggttatataaccaataaatgatgaatccagagctagaacttactattttctggtgcctgaacgctttccactgtaccatgaaatatctaagtggttatattttattttatttatttattttttgagacccgtgtttcactcttgttgcccaggctggagtgcaatggtgcgatttcggctcaccacaacctccgcctcccaggttcaagcgattctcctgcctcagcctcccgagtagctgggattacaggcatgcaccaccatgcccagctaattttttgtatttttaatagagatagggtttctccatattggtcaggctggtcttgaactcccgatctcaggtgatccacccacctcggcctcccaaagtgctggcattacaggcgtgagccactgtgcctggcctaacatctaagtggttataaaggattttatgggtttttcattttttctgctcttttagtatatgataaaaccaaattaaacagcagcaataacaatgacaaattcaaatttgaggaggatagaaaggatgtcaataattagaaggaagaaaaatacttatcaggtgcctactaagtcccagctgctgcaaaaatttatcttatttagatatagagtaaaacagtacttaaacctaagtttgtctgactcaaaagttctagttctttacattataccatgttgtttccaagaagagagttcagcttgggctgtgtgcattttcatacctatgtttatattcctgtatgcttagaatgtgttaccatatatgggaatttatgagtgtgcacatatttattgctattcataaaatggaaaatctttatggccctggcaagtttcatttccaaactatttccttacttgcaatagtaatagccactaataccttttgatcacttacatgtgcccttaaagtacttacagatcttaattaagttaatccccacaaaactctatgaggtagctaatagtattaataccatttgaaaaataaagacactgtggctaaataaatgaagaagtttcccaagtcatacagctaggaaaaatggagccaagattcacttaggtagcctgataccaaagcctgtgccctggatgcaaaatcgagtaagtattccttatctctcaagatcttgagaattatataagatggcagatatgaaaaacacattgtaatctggaaactgctaggggtatgttaggtggcatttcccaccactccccagattctattgtttaagccatttggatcataagtcaccactgttgaatgcttgttcactgtatgctgatggcctgtactagtctctcccaggaatattttcagttttatcatgtgtttctccagttgtggagctcttgcctgggacagttttctgtctaggtaaatgagttcaaggcacaactgctttgttgacacctctctgagaaagaagattgaaaggggtccatgttgcattcagacttggaatgaaccgaggacactccctccctgttgaggattccaaggcatgactatttgtgtgaccatatatagagctatgtgtaggtgtatgtgagtacgcctgtgtttcatcagtgaatgtaagtattggcagcatgtgaaagctggaaggactctttgagagctcattacataccacatttttatggttctgcacttagattatcacacttctgtgactccctcaaaaggtaagaactatatagtccagctttatatagtcaattattttatagatgggaaaaatgaggtgaagaaacttgcctaagttcaccctgaacaagtattagaacttgaaccagacccaactgatggaaaaatgtatacttgtgcttctttatgtcactttaacaatagctgttattgcccatctacttggcctccatcgccatgtcgtaatagatacacagcgacctctaaaaaatgacattctctctcaaggagtgtgtagtccaatctgggaaatgaagacagttcatgaggcaggtcatgagatggaaaggtaacaataatacagagtctgacttaatctaattgggtgctatagacagtaagtagccctgcagaggacagtgatatgaagaggctaaaggtggccttctggagcagttagtattcaaattaacccttggagtaggaatatagaaagtatgatggatgtgagactgtagagatgaattaacaaactgcagccaggagggaaaaggaagaggaaggcaaccagtagttactactgcctactatgttccaaacatggattatacttgtccgtttcatgtaagctttctgatttatttctccagggctgatattattatacccattttacagatgagaaaactggttctgagtggttaagtaatccccaaggctacacagctggtcagtgggagagccaggttttggaaaaaaggaccccaaaacagatcctctcttacatcaagagctttctgccaaatataatatggaatctagggattaacacttgggtcactgctgcgtatggagaggactgagagtttgtgaagtagtctataagtttatttcttaaaaagggtaaatatctggggattttctatccatatgtgaatctgtgcatatatttgattctcaattttttattaacaatgcctatttcatatgcttgggttgaagatttagcgaaataatttatataaagcactggacatggtgctactatgtaatgatctgtcagtgaatagtagccattatcatcattatcattaatataatctattagttatatctctgcctacatgagtatgtatgtctgtttgtaaagtgattataactgcatgtaattgcttgtttcagaatgtatgtgttttttcatagatatggctgttgctataggcatatgtatgttctctgtgtatatacatgtgagtgtgcaagtatatttttgtggaaggtagtacagcatggtgattatgctggagccacacttcctgggctcaaatcccaactctaccgatttttatctagatggccttgggcaaactgctttacacctctcttctgaagtttctccattgtaatatggggataataatggtgtctacttcatagggtggttgtgaggaataaatgatttaatctgtgtaaaacatttggaacagatgtaccatgcacatacgataaatatagctttattattattattctgaagttgactaagattttatataacagagtgattttatgtgtaaatggaagtgtgtgcatctctgcttttaggtaagactacatgtacctgtgtgtgcaagtttatgtatttatgtgatgttgtctgtgtttctgtgtttgactgtaactgtgtatggtatcactgagtgcttcgtcctagtcccaggaagtctaacgtcctgtcttatgcattgaagtgagaggttagaatcttgggtctgattctgactcaggattagacctatgaaatgaatttatgaatagccttgggaatcagcagacaacatttcttctgagaagttcaaaatacttccctcacatactgtcatttatttttggttcattgttaacttttgaagtataatacacataaagtgcacaaatcgtgtttatagctcaatgtattttcacaaactgaacacgcttttacaaccagcatgtagatcacaaaacagagcattacttagaagccctcctcttcccttcccagtcacagaatcctacttcaaggcaaacattatccttacttctaccagcatagattacattggcctgattttgtactgtatttaaatgaaatcatacaatatgtactcttttgtgtctatttttttaaacattacatttgtcataatcattcatattgttgtgtgtagttgtagtttgttcattattattgctataaagaatttcattttatgaataaaatgcaatgtattcattcattatagtgttcacgaacattttgactgtttctattttgggtttatgaatattctagtaaatattttttagtaaattctcacttgttgttaagtacaatttatagaggataggaagtggcaacaacaatgagtgttccccttttgcctatgggaaaagagaggcaaagggagaattagtgttagtggcccaataaggcttctggtgcctgtttcctgattcttgggacagagcacattcttcctgctacaccattgaaaaaactggatccagatctctcttctgaaggaactagtaatacatgattagcagcacgggtgactttttaactatgcccttcaaaatccaatcattgaaaacttattgaattaaaaggaatcaggtaagttaaagaaactgggctaaatgggttttgctttctcagtcactcaacctggctcttgcctcttcagttttctggacacgtagaaagcccctttgttctctttcttctacaccagcagtttttatttgcctgtttcccagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatgtaggtttaatttcttgtggtatttgaggggaagttatgggagcactcttgaggtcaggaagtagcctcttgaggcccctttcccagggtgtggtagcagccagctcctgattgctccgagctgtacatactcagtggcagatttcctgggaagaaggctagttgagtcagaagccagcatttcatctggagtttgccgtaacatttttagagtcctaaagagaattccatatttgctgttttctaatctcatacccacaatgcttacttatttaataacaactgtttgactttaaaaaagaataatgaaatatatacagtgtttgtaagatgtatgggtgggagctatgcttctatagtttggtgaagctactgtatatttatttcagatatgtgaaaatgtgaaaaaagaaagtaagccttagaatcaaggaattaatggtaataattctcacttatgtaatactctgtgacacagaccatactagaaatttacatactttgtctcaactctcacaaaaactctagaaggtaagtatgtgtgtagttattttatagatgagaaaactgaggctcagagaggtcaagtgacttatccaagtcctataactagtaaatgaaaaagataggatttgaacctcgataatgagaatgtaaactaatactcttctcaccactctgtccctcatagatcccacaggattaacctttcctgatcttagaaaatagcaagtgctccacaaatatctgttaaagaataaatgaatgtacgaaaaactattttgtgaccatgactcatttttttctctccaaagctttggagttttccaaagttgattgtaatatctctgagttctctgagaagaattagagtatagtaggaataacaactctgtcttttttgacacaaaatattcatctagtttcagagtcagagtccttgtattaatttttttgagggaataaattcattatccttcatccctaatactttgtagtaatattccacatttattgaacttttactatttgccactgtcctaagctcttcgtgtatttgaattttttttttttagtcaccagtaaaagctgtctgagttaggaactatgattatttccattccattttacagatgggcaaattgtgttcagagaagttaagtaacttgttcaacatcccactaatttggaagtggcagagtcagcaatcaatccaagtggcttggctccaaagcttggagttataagcactatgccctaaggcctcccatatgtatcagaatgatgctaagtcaggctacattgacgaggagtcgatcacttaaggagtcagtccacagttggttgtctctttgttactgcatattgtgtcaagctatgtgaaattgccttttatgtgggtttaaagtggtcaaatatgagcaatttcatatgctgatatttgaaatttttaatagttaaatctaaaactttcatgttttgatcagtacaatgccatttcctcttgttttgtcctaaacaaagatagtcactttttggtcagtatcctctggaaaaggaacctctcaaggcttgaagatggggggcaaaattatgactctttttcttctttcccagagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggtaaaccattccaccgtttctttcccccatgcccaacaaatatcacttttcctttattgccaggtgaaggagaagaactggtagtgaagattttcttttcttcctatttatctgaggtggcaaagactctcctcagagtaaacaagggtgggcactggtatcagttctgccattcatatactgtgtgacttggacgagtcattgtctctctctgggtctcagattccttctcagaaatgtgaagacacagtctacctcttaacacaaggaactatttgaatggcatctccatagaatatttgaatattctatgaaaagaaaagagaatgctataaatgtgaaggattgtcatcctagtgtcacagtcttctgaaagttccattttgtttttccctaaaggggagttcagcttatttatctctatctcccttattcctggcccagtaatttataatactgacaacagtgagtaagaggaatagaaagggaagtcagaagactctggctgggccactaaatccctgtatgatcctggacaagttacttttccttagttttctcttccatacaatggagaagtgaaccaattaatcattaagttgactgcagactgaaattctgtgattgcctgcttttttattttaagtgagtgtttgaagggagggaattctgtcttcttgcttctatgccaccagctttatgctatggcattaccagatcaggccaagctgtacttttcctagccacagaacttttccagtggctacaagctttccacccattgttaatgtgaggactggattttttaggttaaatgttacctaaatctgtgctctccttaggttgtgaggaatactatgtaggtcattagcatgctacattttataagactggacctagggttctacatgtcagctctgtcttaatttatgtatttgccacggtccctcacttattctgggcctgtgcatgtacaatttcatttctaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggtacaggtcccaagaataagctatgaggtgtagtttgggacatctaggggtagcagtgatatggttgaaccacctacatattggacagcagcctgaggagtgctaattcagcactcttgtttattagcaagaaaaatctctgctaaactcactttgcactatttttttttttgcaatttcattactttttttctttgtttgtgggttaggaacaatttttttttcaataggttattgtggtacaggtggtatttggttacatgaataagttgtttagcggtgatttgtgagattttggtgcacctatctcctgagcactatacactacaccctgtttgtagtcttttatccctcgtgcccccccagccttttccccaaatccccaaagtccattgtatcattcttattcttttgcaccctcacagtttagcttccacatgtcagtgagaacatacaatgtttagttttccattcctgagttacttcacttagaataatagtctccaatctcattcaggtcgctgcagatgccgttaattcattcctttttattgctgagtagtagtccatcgtatatatgtaccacggtttcttgattcacttgttgattgatgggtatgtgagttggttccatgattttgcaattgtgaattgtgccactataaacatgcatgtgcaagtatcttttttgtataatgacttcttttcctctgggtagatgcccaatagtgggattgctggatcaaatggtaattctacttttaattcattaagcaatctccacactgttttccttgtggctctactagtttacattcccaccaacagtgtaaaagtagctgttccctgttcaccacatccaagccaacatctactgttttttgatttttttttgattatggtcattcttgcaagagtaaggtagtagcgcattgtggttttgacttgcatttccctaatcattagtgatgttgaggattttttcatatgtttgttggccatttgtatatcttcttgtgagaattgtctattcatgttcttagcccactttttgatgggattgtttatttttttattgttgatttgtttgagttcattgtagattctggatgttagtcctttgtcagacgtatggattgtgaagattttttcccactctatgggttgtctgtttactctgttgactgttcctgttggcgtgcaaaaactctttagtttaattaagtcccaagtgtttgttttgattgcatttgcctttgggttcttggtcatgaaatccttgcctaagccaatgtctacaagggtttatctaatgttttcttctagaatttttatagtttcaggttttagatttaagtccttaattcatcttcatttgatttttgtataaggtgagcgttaaggatccagtttctcttacatgtggctagccaattatctcagtaccatttgtcgaaaatggtgtcctttctacactttatgtttttgtttgatttgtcaaagatcagttggctgtaagtgtttgggtttatttctgagttctctattctgttccactggtccaagtgcctatttttataccagtaccatgctgttttggtgaaatggcattatagtatagtttgaaatcaggtagtgtgatgcctccagatttgttttttttgcttagtcttgctttggctatgcaggcgcttttttggttccatctgaattttagaattgttttttccaattctgtgaagaatgatggtggtattttgatgggaattgcattgaatttgtagattgcttttggcagtgtggttattttcacaatattgatcctacccatccatgagcaggagatgtgtttccatttgtttgtgtcatccatgatttttttctgcagtgttttgtagttctccttgtagaggtctttcacctcctcagttaggtatattcctaagtatgtatgtatgtatttattttttcagctattgtaaaaggggttgagttcttgatttgattccctgcttggtcaatggtagtgtatagaagagctactgattttgtacattaatcttatatccagaaactttactgaattcttttatcagttctagaagctttctggaggagtctttagggttttcaaggtaaactatcatattgtcagcaaacagtgacagtttgacttcctctttacatatttagaggccctttatttctttctcttgtctgattgctctggctagcatttccagtactaagttgaagaggagtggtgagagtgggcatccttgtcttattccagttctcaaagggaatgctttcaacttttccacattcagtataatgttggctgtgggtttgtcatatatggcttttattacattggagtatgtcccttgtataccaattttgctgagagttttaatcataatgtaatgttggattttgttgaatgcattttctgcatctattgtgatgatcatgtaattttttaaaaattctgttcatgtggtgcatcacacatattgacttgcatatgttaaaccatccttgcattcctttcatatgcatcaagtgagtatgaaacccacttgatcacagtggatcatctttttgttatgttgttggattccattagcttgtattttgctaaggattttaggacctatgttcatcagggatatcggtctgtagttttcctttttttctttttattattatcatactttaagttttagggtacatgtgcacaatgtacaggtttgttacatatgtatacatgtgccatgttggtgcgctgcacccattacctcatcatttagcattaggtatatctcctaatgctatccctcccccctctccccaccccacaacagtccctggtgtgtgatgttcccattcctgtgtccatgtgttctcattgttcaattcccacctatgattgagaacatgcggtgtttggtttttttgtccttgtgatagtttgctgagaatgatggtttccagcttcatccatgtccctacaaaggacatgaactcatcattttttatggctgcgtagtattccatggtgtatatgtgacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatggaagaaaatttttgcaacctactcatctgacgaagggctaatatccagaatctacaatgaactcaaacaaatttacaagaaaaaaacaaacaaccccatcaaaaagtgggcgaaggatatgaacagatggtctgtagttttcttttctggttatgttctttcctggttttggtattagggtgatgctggcttcatagaatgaattaaggagggtttcctctttctctctcttgtgaaatagtgtcaaaaggattggtaccaattcttctttgaatgtctggtaggattccatggtgaatccatctagtcctgacttttttggttggtaatttttttaactgccattttaatcttgctgcctgttactggtgtattcaaggtacctaattcttcctggtttaatctaggaggattgtatttttacaggaatttatccatctcatttaggtttctagtttatgtgcagaaaggtgttcatagtagccttgaatcttttgtatttctgtggtgtcagttgtaatatcttaacgtttcatttcttaatgaggtcatttggattttccctcttcttttcttggttaatcttgctaatgatctatcaattttatttatttttttcaaagaaccagctttttgtttcatttatcttgtagtttttttgtttcaatttcatttagtttttctcttgatattggttatttcctttcatctctagggtttgggtttggtttgttcttgtttctctagttccttgaggtgtgaccttagaatgtcagtttgcactctttcaatctttttgatgtaggcgtttagagctatgaacttcccttttagcaccacttttgctgtatcccagaggtttggtttttataggttgtgttattattgtcaatcagattgaagaattttttttttattatactttaagttctagggtacatgtgcacaacgtgcaggtttgttacatatgtatacatgtgccatgttggtgtgctgcacccattaacttgtcatttacattaggtatatctcctaatgctatccctcccacatccccccaccccatgacaggccccagtgtgtgatgttccctttcctgtgtccaagtgttctcattgttcaattcccacctatgagtgagaacatgcagtgtttggttttttgtccttgcaatagtttgctaagaatgatggtttccagcttcatctatgtccctacaaaggacatgaactcatccttttttatggctgcatagtattccatggtgtatatgtgccacattttcttaatccagtctatcactgatggacatttaggttggttccaagtctttgctattgtgaataatgccgcaataaacatgcgtgtgcatgtgtctttatagcagcatgatttataatcctttgggtatatacccagtaatgggatggctgggtcaaatggcatttctagttctagatccttgaggaatcaccacactgtcttccacaatggatgaactagtttgtagtcccaccaacagtgtaagagtgttcctatttctccacatcctctccagcacctgttgtttcctgactttttaatgattgccattctaactggtgtgggatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttatttttttcttgtaaatttgtttgaattatttgtagattctggatattatccctttgtcagatgagtagattgcaaaaattttttcccattctgtaggttgcatgttcactctggtggtagtttcttttgctgtgtagaagctctttagtttagttacatcccatttgccaattttggcttttgttaccattgcttttggtgttttagacatgaagtccttgcccatgcctatgtcctaaatggtattgcctaggttttcttctagggtttttatggttttagatctaacatttaagtctttaattcatcttgaattaatttttgtataaggtgtaaggaagggatccagtttcagctttctacatatggctagccagttttcccagcaccatttattaaacagggaatcctttcgccatttcttgtttttgtcaggtttgtcaaagatcagatggttgtagatatgtggtattatttctgagggctctgttgtttttcattggtctatatctctgttttggtaccagtaccatgctgttttggttactgtagccttgtagtgtagtttgaagtcaggtagcgtcatgcctccagctttgttctttttgcttaggattgacttggcaatgcgggctcttttttggttccttatgaactttatagtagttttttccaattctgtgaagaaagtcattggtaccttgatggagatgacattgaatctataaattaccttgggcagtattggatgaaatattctgtatgtatctgttaagcctatttgttccaaggtatagtttaaatccactgtttctttgttgactttctgtcttggtgacctgtctagtgctgtcagtggagtattgaagtctcccactattattgtgtttctcccactattattgtgtttctatctatggcatttcttaggtctattagtaattgttttataaatttgggagctccagtgttaggtgcatatatgtttaggattgtaatatttttctgttgaacaaggccttttatcataatataatggccctctttgtctcttttaactgttgttgctttcatgtctgttttgtctgatataagaatagcttctcctactcacttttggtttccttttgcacgaaatgcctatttccaccccttgactttaagtttatgtgagtccttatgtgttaggtgagtctcctgaagcaggagatggttggtgacttcttttccattctgcatttttgtattttttaagtggggcatttaggccatttacattcaatgttagtattgagatatgaggtaccatagcattcatcatgctatttgttgcctgtgtaccttgttttttttttatttttttgtttttgcttttcaaattttatttttgtttcatagatcctgtgtgattgatttatgccttcaagaggttccatttttatgtatttcctggatttgtttcaagatttagagctccttttagcagttcttgtagtggtggcttggtagtggcaaattctctcagcgtatgtttgtctgaaaatgactgcatctttccttcatatatgatgcttagttttgctggatacagaattctcggctgataattgttttgtttgtggaagctgaagatagggccccaatcccttctagcttgtagagtttctgctgagaaatatgctgtttatctgataggttttcctttataggtgacctggtgtttttgtctcacagctcttaagattctttccttctttgtcttaactttagataacctgatggcaatgtacctaggtgataatctttttgtaatgaatttcccaggtgttcttttttttttttttcacagctgtatttttttttttcagtcattatttgtttgtacagctgtgtgaattttttttttttttttaattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtatttggtttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaaagtttaaatctttaatccatcttgaattgatttttgtataaggtgtaaggaagggatccagtttcagctttctacatatggctagccagttttcacagcaccatttattaaatagggaatccttttcccattgcttgtttttctcaggtttgtcaaagataagatagttgtagatatgcggcattatttctgagggctctgttctgttccattgatctatatctctgttttggtaccagtaccatgctgttttggttactgtagccttgtagtatcgtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcggagcctgttattggtctattcagagattcaacttcttcctggtttagtcttgggagagtgtatgtgtcgaggaatgtatccatttcttctagattttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattaattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagaattctgtagatgtctattaggtctgcttggtgcagagctgagttcaattcctgggtgtccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttctattggcttggtagatcttcctccatccttttattttgagcctatgtgtgtctctgcacatgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacctgacctttctctctggctgcccttaacattttttccttcatttcaactttggtgaatctgacaattatgtgtcttggagttgctcttctcgaggaatatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgcagaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccccccagttcgagcttccaggctgctttgtttacctaagcaagcctgggcaatggcgggcgcccctcccccagcctcgttgccgccttgcagtttgatctcagactgctgtgctagcaatcagcgagattccgtgggcgtaggaccctctgagccagttgtgggatatagtctcgtggtgcgcggtttcttaagccggtctgaaaagcgcaatattcgggtgggagtgacccgattttccaggtgcgtccatcacccctttctttgactcagaaagggaactccctgaccccttgtgcttcccggtgaggcaatgccttgccctgcttcggctcgcgcatggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatctttgctcctcctcccccaggtgttctttgtgcttcttgtatttggatgtctaggcctctatcaaggccagggaagttttcccctattgctcctccaaatatgttttcaaaacttttagaattcccttcttccttaggaataccaattattctttaggtttggtcatttaacataatctcagacttcgtaggggctttgttcattttttcttattcttttttctttgtctttgttggattgggttaatttgaagaccttgtcttcagactctgaatttttttcttctacttgttcaattctattgatgagactttccagaggattttgcatttctataagtgtgtccagtgtttcctgaagttttgattgttttttctttatgctatgctatctatttccttgaatatttatcccttcacttcttattttttttgttgttgttgttgtttttattatttcctttcactgggcttcacctttctctggtgcctccctgattagcttaataactaacctcctgaattcgttttcaggtaaatcagggatttttttttatcttggcttggatccattgctggtgagctagtgtgatttttttggggtgttaaagaaccttgttttgtcatattacctgagttgggtttctggttccttctcatttgagtgggctctgtcagagggaaactctagggctgaaggctgttcttcagattcttttgtctcaaagggtgttcccccatctctccctccttttttatggatgtggcttcctgtgagctgagctgcagtgattgttatctctcttttgggtctagccacccagcaagtctacctggctctgggctgatactggaggttgtctgcacagagtcctgtgatgcgaactgtgtatgggtctctctgctgtgaataccagcacagtatttggggtgtctcccgggtcctgcaggagcagtccatttccttcagagggtctgtgggtcctcttgggattcctggtgtgttcatgaagggtgctggagccaaaattcatgatgcaagcctccacatgctgctctgtccatccgagtctgagctgcaattactcctgactcttgtccaccatgatgatcctacgaaccttttttaaaattattgttattaaaaacaacaaaacaccaaacttttctcctttttattttttttcttgcttcacttttaaatctcaaattagtcattataggagtcaagtcgcattgaaatcagatatgtagtaagagtttagatatggataagattgaaagtgtggtcatcagggttttggaggattttgctgataataggatatgtcagacttgaagaccagagggtggcaggaatgtggtcaggttcaggccctgggttgaagacataggcagggatggtaggagggaattattgtagatcctatgtgtcctaacatcaagtcctaggttcaactgaattggtggttttaaatggggagtttggaaatggaaattaatctaagagggttatttctgcttttctgttgcttacagattcttaagacccctctctttctattcctttcttatgagtacccctttcagcttactattgctaaggaaaggatcttctcaagggaaactgtcttacttgccctaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatggtgagttgggaaaaggtggccacattgtgacagggaacattgttggagggtatccactgggcctagtatttggtggatgctttcacatacatagtcctttttagtcatcacgagggcaaggagtagtagatggctcttccctgttttacatgtgaggacactgaggctcctaagattatgcagcagataaatggcacagctaaaattccaaccttggtctctctgactgcatagattgtgctcttgccattaggctattctgcctcataatgtggaatagcacacagtctaaagttatatagtatatggtcaattactttgctgtgggttgcccactgatacaattaatcaatattgatttgttttaaaaaggaagaagttagcagaattatccactttgtggagaaaaatggtttctttcaagctaccttgcttatatctcccatcgtactctgtgcttatgtctataaggacattgaccatattaattaaattgaaaaagaaactaaaggcacagaagaaccgaggcatgaatattgaactgattttaggaatataaacaagtcagttttgtttttgtttcattaaggaagtcatttactggccattcatgacaggggtgggctaaaaaccatacagtccccaaaggaggtggaaattcagaaggaagatgtaaaggatggcttggatagctcaactttttcttgaattttataccaattgattataaaagccatgttaattagtcagccaatttgacaattgtcctgtggaaatttttagaatgaaaccaccctgaaagaatagcctgcaaaataactaaattccttagagagcttcttcacatttctggtttggaatattggctgtaagcatttattagctctatggcattgggaaagaagtaacttcacctctctgagtcttggttttctctctctctctcttttttaatgagactaatgatatctgcctatttctcagggatgtttttgagatttaaagaagataatacataggtcaacacagtgtgctgtttataacctcatttaaatattatctattattgtcaaatggtaaggcttcttccatttggctgtcctttcctaatcctgatattttctttgggttttcttttgcagcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgaggtgagatccaacatttctgaccattgggttgtaagagagaggtatgataatggtcaagggaggctgggtttctggcctgaagccataaataagtcctccagttgaggcatcttgggataaaggatagcacactagattagaagtcaggggacccaggttttttcctgaatctgctgggaaacttgctggataactttgggcacatctctctgtgtttaatcttccccatcttgaacataagacagcctggggatggataagtagacttttaatcagctttttattatttgcttagaattctaaacaattaatacctggagacattttcaacatattgaacagggagtgaaggagagattaattaaaagagagtaacatttctgtaggagatcatggtgtattgtgggtacatagttacactctggttggaactcaatagaagtaggagtggaaggttttattttcaaagggagaaacattaatgtcattgcagagcaatgtattgaggagcatcagatgcatcagaggggaggaagagcgtatgaagcaatggaaagaatagtagataagtggttaggtttgaatggtagtcttaagtttgtgaaaaactttatatgactttagacaggtgtctttccatttctaggtcacatttgccacatccgtaaaatgggaaagttggtctaaatcgtctcttaaatcctcttcagctgtcattttctagaattatttgatttatggtaaattagaagggtgtcagaaaaatgatatgtgagtacttgaagtggattttagtaggttaggagttgtagactaataggataataaatcttgggtgttaggtttgacacaataggggacagttacatgtactccattatccagggtatgtcttagccccaaagcttcctaggtaagagagtataaatatggattgggattagagatgcagcatgatagtggaataagcatagaccttagagacagacatgcttggattcaaatcctcgttccatcacttgtttagccacctttgataaatcatttcacttctctgagcctcttaatagaagtagtgatgtatacctcataaaattgtaatgaggttttagagtaaaaatgtgattttggatcttagagaatagggggatgatataaacaagatagtagatataagaaaataaaatgaacaattaagatctgtagttgaaagatgagagtttaactctcaactccacctctgactagctgtgcaaccttgggcaagttatttaacctgtctgacctttagttttcttcatccgcaaaaggggacattaaaagtctatttcatacaatggttgtaaggattgatagagataacatatgtactccctgggactgaaattttaaaaaagatgtaaagcacctgacacagaacctacctaacataatacatgttgaagaaaataaatattttttcctctcccttcatcatacctcaagtttctaatttacaaatttcaaatctccctgggatgctgtgggatgctaataaaataatatagctgagtgacctctataagttgctaagccaatataagacagtaccatccattgccattgtgacgcaatgtagtatattccacatttgaaaacactacttagaatctacattttccttacggtcccaagtctgaagctttatcttcactgatagaagatgttctattattttgggagcttcccagtttacaaataattaacccctattttaaatttgatgctcctaccagccccatgaggtggattttcctattctctcctttggcaaaagagggaagctcagattgaggaagtgacttgcctaaggtcctacagatagtgcttaaagcttgggcttgaactcgagtttccttacttctgtctctgtgatgttgctacaatgtgagcctttatgaagaggcaggaatgagtatctagtaaatgcatcagtggtggtataagcaagtggaggtacctgaattctaccctggactctctctctcagccatgcactttaagagtgagagaaagcggcccattttggagcaggagtaaagagagtagtggagggtgggtggaggaaacactaacagaaggaggaaggtgagtcctctgggttaaaatcctattggatagaatggggtcagccataatgttcttccttcagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcaggtaagaggcagtgggatccctctctttaattctttaattggtccagctccaaacatttattatctttcttccagaaatctctcactttactcagggatccaaatcattgtctggctggggttacatgaaccaactgttagccaagttcttgtgtccccctggagagcttgctcttggggagatacaggtagcaaagctttttgtggggttattccatatccccacaaagggtccaaacagagtttgaagttggtcctactataattcctggccattttcataaaggaaagcccaggtgggaccagttcttgtatcagttgaaatagcttttattccaggtttcttcactttacccattatttacctccttgctccttcatttcttttctatagtctgaatgaggcatttgagcaggggtataaaaagcactctgagaaatgtaggaagagaggcagcctgctttttggctatcacatgcccattcttttgaaggaatttctccaagttctcctgcctcatccatgacccagatatgggcaagatagagtaggaggttagtgccctactcagttgctgggtcttaagtcataccactcactgggaaatcgatgatgacaggtcttccacagaggaggcacttgataggtaactaagagaggggttgggggaagatccttcatggttatacttctagcaggaaataatagagtaaatctggagaaaacttaggaaagttggtgtttgagtctcagcatggattctacgatttccagctgggcttattaacatagtgggctttcattttggagtgaaaggattattaatacctaaggatgattaaggacagatgtagactatgaatctctggagggcagaactggtcccagtgcctggaaattataagcaagaatattccaacttacactaaaatagaattccaataatttaaaatatccaacagtaagggagattgtctcctctggatatgagtttcctatttttggaaaggctcaagcagaagctgtatataactttctagtggtgccaccaaaggagatatcttcactggtgggagttaacttagatgagctctgaggtccttcctaaatataaagattcataacttggtgagactaagggtgagatgggagtctatttgatacctaatgaaataatatcatattttcctttttatacatcagtatctcagataagtttttccagaagagctccagccgaattgggggcacttactggaaagtgcgatatgaagcctttcaagatgagacattccaagagaagatgcatttggaggaagataggcatcttggaatcctgggtgaggaatttttaaattatgaaattcatttactagagccagagaattgaggaagactttgaaactgaggcctggacatcacttaggagcacattgtagaccagcatctcccaaagtgagtcttatgagatgattgttttgtgaaagagttatgagtctgaatgtgttttaaaaccactaagttaagcagttaaatagtgctttttatgctacaggatttctaggagccttaggtttatttttgtttatcatgaatctccactttttttcagtgaatatcttccaataccactgatgtacagtacacatttttagaattccttctctagaagtattcctaaagggctatataaggaagtaagactgtataggttctcagcaatctggggccagtagcagattggcatgacatgcagacatacttgaaataggaggaatgcagaataggcttagagtctgaacttgaagaaggtatctagaagggctaaaccaaggttagaagtggtttagtagcatgatggaaccagaaaataaaataggccagatggaaaaaaaactttggaaattaatataatggaccatactcgggataggtgtgtgccagttgattctagatctgataatggacaatagatcttacatcagctggatagggagatacaatgaggagaaatccaccataggaaggagagatggtggtgagcctgaaggaattatcattggctggacttcagtatgagtgcccagtctttgagatgaggtgaaacattagatgtggaaattgaataggaaaccaagctagaaactctgaccaagagttagagccggaataagtgcccagttttggtactttttgtctgcttcaaagatgacctaagctagattacatgtggtgggtaatgaagttcagaagagtccaggagttgtggctagattacctagtacagtgcctggatagaagatatcataattctctttgctcagaattggtttcagattgaggcaagcacagatcttagataggtccacaaagacatgtagctatgggatctgggacaataaagtaagtgaaaatgagattggggctgacaatgggatgagagaaattgctggcctctggtcctggctgaatggcttatcaaccatttaaatttgcataggtaaattccacttctctcagctgaaattttctcatctgtaaattggagttaataatttttgccctatatgccttaaaatgatgtttgagaatcaaaataagataatggatttcccagtgttttctgtaattgtaaattgcaatatacttgaaaggaattgttcttattattacaaagaaaagttttttattttcttcttcactttcactttccttttctttccctccctcttcttccatttccttcctccctgtttatccctttcatcattctcattgtctctccttcccattttccagggccagtgatccgggctgaggtgggtgacaccattcaggtggtcttctacaaccgtgcctcccagccattcagcatgcagccccatggggtcttttatgagaaagactatgaaggcactgtgtacaatgatggtgagccaacagggtttctagtaaatgtgggctctaggtggtaccatgtgtctctagaaaacaaataaatgggagatggagaggatgaagtaggcagaattatttgccatatgtggatgttgttgaatgaatgaataatataatagtaaaacagagctgggcttcaataataagagaaaatttcttttaaatatatttaaatatatcctaattttaaaaataagtttattatagaactctgaaaagcagacaattacaaagtaaataagcatcatttatagattgtcatataaattttgatatacctttaaatatttttatgtgcttatacaagtctatatatagagatatgtgatcatatggtttgtacagttttgcatcctactattctcagttaccattgtattgtgtttgtttttctatgccattaaaatgctacaaacattttaatgactataaaacactttatctcaaggatttgtcgaaatttatttactttttcctctattgcttggacatgtaggtttttttcagtatttttgaatattgtaagtcaggttgcaatgaatgaatgcatatatcctagcttgcattttggattactgtatcaggagagaatcttagaagtgagagtattgtgtaattgattttttactttatctaagaatattaatgcatgctaattctagccaaactataaaagaaaaactgaaagcataaagagcaaagttgcagacaaatctagaatgaacattctataaggcaactggtctagtctcttcaagaagtcaataccatcaataaggggattagagacataacaaatgaaatgtgcaaattttgattgattctgcttgtaaaaatagctttaggagacattttggagataattgcaaaattcttgatatagactggatattagatgttattagggaattttcttaggtggaataatggcattatagcgacataggagatgcgtgctaatatcatgatgtttgtattctacttccaagtgattcaacaaaagcaaacaaacaaaaactgtatgtatgtgtgtgtagatgtatatacacatagagtagataaataaagatggcaaaatgttagcaatagactctaggtgataggttgatcattgcactattttttaaagttttctgtatatttgaaaatttgaaaagtaagaaataatgaatgaataaggaaaggtaggttaaaaccatcctaaattatagccccttgttataagctatactagaaatatccttccatatgtttctttgaatgtttttataaacctttcttcagaatatatttttaagttggggaattgctatatcagaggctatgtacattaaaatttttggtacctacacccaaattactctctggaaagatttgcagtcctatcagtttagagttccattagcagtacctgaggaggactccttttcttacaacctcatcagcactggggaaatctttttaatcttgtcaaaatgacagtcttgtaggcaaacgacagcatcaacaaaactcactgttgttttgatttacatttgtttgattatttcatgttgaacattcagtatttattgcatatattattctacttgtgcatatgaaccttttaaagaaatagctttgtctacattttggtgtactttttttttttcaaattttgtctatattttttttcaagtgttattcccttttacatttacactctttataggtgagtgagtagggtaggtgccatctaaaccacttcttaccatcatgcattattacaatttgtaaaatctttgctaaattaatttgtaaaaaagttatctagctattttcaattgtacttctttgattactgatggcatgaaaatttgaaaaaggtctgtgcattgcttgaccatgtcttgtgtccattttagaaattacagccttagtgttttatatatatatgtatatatatacatacatacataacatatacacacccacatgtacataatacatattaaaagaaaaaaattaaataatcagagctgttcaaagatgacatggactataatggcaggtagtgagtcccccatcactggagagttttaagcagaagtagggatgtaagagcagattaatgtatgttttcaagtgagagatgttccaaataagtcttaaagtccatttttagtcccaaagtcctatgattttggaaaactgaaacatagggaagattaaattgctgcatttcatatagcaagtaatggaagaacgagaaaataaactcatctcttgactccttgaccagagttctcctcattattcaatattccatgttgctgctactgctgctccaaaatgcctttgtagttcataatctttatttcactgtttggagctgatgattctcattctagtcaatctaagtaatgagtcccatattttcactacaggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcaggtattgtcagggttatctggctggaaagcctgctgggagaaggatgaagctgggttgctggataggagttaagcatggaactgggttctaaagtttagggaatagaagaaaaataatcaagctggtccatcagaaattaatagttggtgacctcatactatcttgcatgttattttttgtactgacaaatatatatcttccttagccttgcagataattcatgatatcctttcatcatcttcttctttcctccctccttccctccctccctctctctccctttccctctccccctctccctttccctctccctcacctcggtggcccctaaaccttgctcctgatccataaatctgctttaatatttgcttgtcttcttttgtattcagcccacaatttctagctgtgtaacattgggtgagctacttaacttctctttgactccgtttcctcatttgtaaaaatgggataacgatggaagaagacaccttggatttctgtgaagattaattaaaataacccatataaagtgcctagcacagtgtctggcacatattaagcactcagtaaatgttagtggtaacaataattatcactgatattacttatcttttattttctagtttccccccaagaccctcccctgcttttctagccacctcccctcattcctctccccaggtgattaccatctctcttcttttacactctatacctcttatttcttatcctatgctccttccctgcccactttcatacagtcttccctgtcaggcttgtacttttattgtgacattcttctctcatctgcaatttgaggttacctaaggaaaaactgctgcagctctggataggaggtatggtctcaaaatgggaaaaggaaatgggaaagaatctggcatcccttgatctgtaacgacacagtctacaactgctgaaactattgtcattattccctctactttcttctattgggcctgcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatggtatggggagtacttttgccctgggctaaattgagggtcccaagtaaaatctaactttaaccgtaatcatgaccaatcctgaaaacactgattttattggtcatctctgtccaagaggcgagctagattgagaggctcaaccgaacacaacagatcttatacttagtacctttgggtgctgtgtcctgtgttacacagtatgggggaaactggaagaaagtactgcaaaatgagggtgtgcacaagaaatctacaagagattgtgaagaataagccagatgatacctttccaatcttatctcccctcttccttatattttagtaccttgggtcccccccccccatactccagccaactggggctatttttctttgtgaacatgctgatttcatgcttttgcagtgctgttcccttcacttgaaatgctccatctcttgattcccattactagttagtttcatcatttggaaaaagtaaaaccatctcatgagcaaagttcattccagttagaatttactgagcgcctaattggtactaggtaatgtgctaggtgctcaggcagtcacatagatatagaaaaaaaatgatatgcttcctgttatgtcaatccagtgcaggaaatagatttgtaagtaaatcaccagaaagtatatcagttacaatccatggcaactgatactgcagaattttgtgggataaaattttcatggatcgaagagagagtaaagtatagctgaacgaagatacgacaggtaagtggtaggatgccatagaaagagaccataagggaagtttattccagaaagaggaaatcatgtgaaaagtcaacaggtattatcaaagcacctacaatatttaaagctttggtaatgcagagaaaaatagagctcacaggacaatggtgtgtgtgtgtgtgtgtatggaagaggatgggaggacagactgcaggtaggggtaccagagaggaggctattttagttcaggccagggaggatgagggccagaaccagggcagtagcagtgaagatgaagaggaggaaacaggttgagagctgaagatggaattttcagatccccaacacgtatgggggcgtggaaaatgagatctatatggaaaaggaacaatcagagtggttgtaaaaggaccagaaagtatgttgccacagaaaccaaggaaggagagtttcaagaaatagggaataggagagattggtgtgtgtgtgtgtgtgtgtgtgtgtgtgtgtttggtagtggagaatagttcaatgttgtcaggatgtggatcatggtggaggtgaggccagaaaggacagttgagcactcatcccaaagacagagatattcacgagtagagttaaagtggcatagagaggaaggcagaggtgttgaggatgactcagcagtttcaagttgtgtgaaaccatagtacatagctgatgccatgctcctggccagtgctggagtagtctggtctcatctccccaccttgtcttgtgtttttgttttccagccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttggtaagtgccttagcagctggccctagaggctttgttgggtatagggccaggaatggggtcgggaagagggagggatggtgaagagaaaataataggcatgttaagggttctaggaagtttttaaaaacacttgtctttttcttcttcaatgtgctctccatgttctggttacttggattccctactcagctgcaggcagaatagttagtagaaggtggaggaagctcttttctggaacaacagaagggaagttgggatgttgctcagctttagtgaagttcttatatggcagggagtggacttgacaacacagagattttataggtacagtacttttattgggaggaaggtcaataaaatgcacttataagtgctatcaaattgatattctgtgaggctttctacagactcatttctgatctctccctctctctttctctttctacccatgatgcgccccaccctctgccccctgccaccccgtgtgtgtgtttgtgtgtgtgtgtggtgatgtaacaatttcagcctggaaatcagaacacaggagccctagttcaggctctttcattaacttgctgcgtaactttggtctaattacttcccttctctctagctagatttcctgccttgattctttcctttctgccttccttccttctgtccttttgtcctccctccatctctccttccctctatatcctttttcttccttttatgaagatatttgactataatgtttcttcagattctatgtatttctagaatttcataatagagcagttatcttttctttagtccctatggtgtatttttttttccagccattagatggcaatagtgtttgtaagaacaacctgtcagctccacgcagttcctattaaacttttgttttactcctgtaaatttcattcatatctggggggaaaaacatccttgaacaagtgtcttcaacgctttaataatattaacctagtcctgagtttgacaaacacttgacataaagctggtctcctcagaaatagaaaggacaatttggaggctattgcagttttctctgtgagagaagcttgtggcttggactcgggaagtggcagtttaaacgaaaaaataattttgaaggaattgctgataggatttactgatgcaatagataacggtggtaagggaaatagaagaagtagatgtggaaagaaatgagtagaccctttctttcaacgtgtttataaactagtagaagggatcattttaaaagagaggggcacttagccctttaacatgtggtttagatataaagtgcattagaggtggagaagtgaagaatgtagaactctatttgggccaaaatagtcagggagggctttctggaaaagaaacatgaattgagtcttggataatgagtggactctcatagatacttgggggtggggtgggcaggtaagttccagaaagaggataacaaaatgaatgaagatttcaaggtaggaatgaatgagatgtgtgagagaaacagtcagagttccatgtagttggagtgctagttgagtttgagacaatgtgtgggaggtggaactggattggtagtttggtgccaactcatagaaggctttgaaagccaggaagaagagtttgtagtgatgggataagcactgagcagcaaagtaaggaaacaatgagagtaatgttctaagaaatttagcttcttttgatcgacattgagtttgagtatccttgagttagaaatttggagcttaagatctggtccaggcaacttcacaacacagacatttaagactgttacctgcacattccattgtaaaaaatgagtgaaggaccttctaaagctgtcttaggtaagcatccctctgcaatcaagacattctctttctttttacctaactattgaagtctactttatttctttggtacttgataggagacaactcatcaatgtttttcttggaataagaattattacagctatatttacttatttatagcatcacttaactgaacattgaatatgttctatactaagcactgttcacaaattattgtgtttaattgtaaaacaaccaaataaagtaaaataatcctcattttactgatgagggaactgaaaaacacagaggtttagcaattgccacaaggttttatgtgtgcatatatatatatatatatatatatatacacacacacacacacacataatatatttttatatatgtatatatatatgatttatatataataaatgaaagatagggttaccaaccatggcagtttgcctagtactgaggggtttctaggaatatgggacttacagtgctaaaactagaaacaccctggaagaagttggttattctagcggcagagtttagttttaataaacccagtgtatgtagctttggagccggagctcttaacctttgagcccattactctcaataaactttaaatactcttttatctatgtgtagttaaggcaagagccttatctgagactatctgaaactaactcttttctgcagtatgcctagggaaaggcaggaaatcccccaggcactacccagggatgttctgagtcagatttttctctctgatcctccctcagggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacaggtaaggcttcataaatggagagattacacttttagaaaaacattttgcaaatgagaatactgaaattctgagatgaggagactcttatctcaggtctcctaatgtgataccaacagatttgggagatggggctataatgcagctcttatgaattctagctcactgctgcttccatattgatatagggagggaataaagcttgcccacaccttcaccctcttaatctttgtctctcttctttcagttagctggaagtatttaccctgggacttaaattttacaggatttactcaagggattgaatgtctcaagctcagctgtcccttgacaaaatggcattgcatttattaaggtacagactaagctatgtagcagaaaatgtctaaaacagagtgatttaaatatgatagaattttatttcttattcacataataatacaaatatgagcaattcagggctggcaggtgaaccctatcatcctcagcacttgctttcctttctggggccaagatgtctgttccagttgtagctattcccggctatcatgaagaaagaaagaaagaagtccagggcaagcagcattgtctataaggacacagcatggaaattgtatatatcactttttcttatactctgttgttctgaactaattcttatggccataattggctgcaaaaagagtctaaaagatgtaatctctaattagtcagccatgtgctcagctaaaagttaggtgattctattactaaaaaagaaggagagaacggaaatggagatacaaattagcagtctccactactttgtttttggtgctctcactacactttagcaatttttactctttgcgttgttcgttgaaggttgaagtcttcctgctaaacatctaaaaattttactttatttttaattcttgatttttgatgttcagatagacatacaattatgaaaacaaaaatccatggaatgtatgctaagttttctgtaaacagaagcagataactgggctggacatttttttgaagattccatctatcacctctgtctatatacatgctaaaaggaaaatatgttactaattgatactgactttgaaaacactaatttaagccacaattgaattatcagcaactactgagaataaaatttgactttatgtagaaatcagttatttatttagttcctctcacttgtttctgatcagaacccagtgagatacttctaacaagatcttataatttaaaaaaaagaaaaaggaaaagagatatttacatcagttttttaaaaatataatattagttgctagcattcaggtagggcccaagtgagaatggtttttttaataatttggacttttattatagattcaggcagtacatgtgcaggtttcttacatgggtatattgtgcaatgctacattttagaatataaatgatcctgtcatccaggtagtgagcatagtatccaatagttagtttttcaaccgttttccgcatccctcctccccctttagtaatccccagtgtctcttgttaaatctttcttttaattaatttcaacttttattttaggtatgggggtacatgtgcaggtttgttacatgggcatgttatgtgatgctgaggtttggggtacagatcccatcacataggtagtaagcatagtacccaatagtttttcaacccttgccctccaccccaatttctattgttgccatctttatgtccatatgtacccaatgcatagctaccacttataagtgagaacttttttgttttctgttcctgcattcatttgctgagaaattaatggcctccaggtacatccatgttgctgaaaaggacataatttcattctttttcaagtctgcatagaattccattgtttgtacataccacattttctttatccagtccaccactgatgggcacctaggttgattctatgtctttgctattgtgaatagtgctgtgatgaacatatgaatgcatgtgtctttttgatagaatgatctatttttcatgctttttttttttttgagatagagtctcagtctgtcacccaggctggagtgcagtggtgtgatcttggctcactgcaaccaccacctcccaggttcaagcaattctcctgcctcagcctcccaagtagctgggactacaggtgcacgctgccacacccatatattgcccatttttaatggggtgatttgttttttgcttgctgaattgtttcagtttttggaaattttaaaaagtgacttcccgtctctgaacctgggtatactcatcttgaaaatgatgcagtataagatgaaagaacaggactagaaaacgagggagggaaggagcagcagacttgaatctaaatcctggctcactttctggctaacaatgtcacttgtagaataagtcctgtcatctctgtgcaattgattgcacctctggcacctacctaccccataggcctattagaaatatcaaatgataaatctgtttgtaaactagacagaatcctataaggagaaaatctgtaagatttcattccctccctatgtctcaccatcctttgccctctggttgcagcagtagttaatactttcctgccaccttgtatcttgccttttgtaaaactaatttcatcaagacatcattagggctggagctaaagcctgtggcttctgattcttagcccagtgctcttatagtatgaattatataccaaatttgtatttggatgatggcaaacaaggaaacctgccatctttttttttttttttttttttttttttttttttttttttttttgacaaagcctcactctgttgcccaggctggagtgcagtggcatgatcttggctcacagcaacctctgcctcccaggttcaagtgattcttgtgcctcagccacccaagtagctgggattacgggcacaagccactacacccagctgattttttttttaatttttagtagagatagggttttgccatgttgggcaggctggtctcaaactcctgagcttaagcaatctaccggccttagcatcccaaagtgctgagattacaggtgtgagccactgtgtatggcatacctgccaactttaattgtggttatgcagccaatgtggtgagaagtctgacattagaagaaataggggccaggtgtggtggctcatgcctgtaatcccagcactttgggaggccaaggtgggtgaatcatctgaggtcaggagttcaaaaccagcctgaccaacatggagaaaccctgtctctactaaaaaatacaaaaagtagccgggcgtggtggcgcatgcctgtaatcccagctactctggaggctgaggcaggataatcgcttgaactcggaaggcggaggttgtggtgagccgagatcatgccattgcactccagcctgggcaacaagagcgaaactccgtctaaaataataataataataaataaatttaaaaaaaagaaaaaaaaagaaataggtccccccccttttttttttctgtctgtgacatgaagctggttctgacttagcttccccataaatactcaaatgaaaatgaggggttgatggccaggtgctgatagtactctttggattcctctagttatggttacattttcctgagcaacaaggatgggctcctgggttccagatacaagaaagctgtattcagggaatacactgatggtacattcaggatccctcggccaaggactggaccagaagaacacttgggaatcttgggtaagggaattctacttccctcctagtgtttagcagcctgaactccacctagggaagctatgttataccaggatggcctcactattccccattctcaatgttttcatatgatatactggaattatggaatattttatgaaacaaccatgacaataaacagtgaagggggaggaaggaaatcatgaattcatgaaccagattttactgggttttctatagcttcaaggtatgagtctctgaggatggtaagttgtaataaatgctaggggcagaataacttaggaacatcaaaatgtgaaaaaactatatatatacacaaggaatcagttttttcattgtaccgctgtttaattattgctttaggtggtttcccccttattctagttatggtacagaagggacccactgactcctaaagagatcctctcaattctttattgtctgccaaacttatcactctttatcgtcaatgattccacagcaccttgattctttagacccttgggctgttatagatagagggtaggggtgggaaaagtggaggtaattggaagtataatcttgtcattgaagtaccttcatcctgtgggtagtagtaacagtttaaggacttctgaatcttaaaatggagccagccatgccttctaggtcttagaaggatgttttgtcagggtaaaccactaattctatgaagtgctcatatatgtccctttctttaatgctccctgtgctcctgcattaatgaaactttatttatttaattatttttgtttacattaggtccacttatcaaaggtgaagttggtgatatcctgactgtggtattcaagaataatgccagccgcccctactctgtgcatgctcatggagtgctagaatctactactgtctggccactggctgctgagcctggtgagtggggacacttagtgaaagaacaaaggacatgcatcacgtctgcttcaggcttctggatttttccttaaaaaattaatgtacttcagactggagtgatagctcattcctgtaatcccagcagtttgagaggctgaggcgggtggatcacttgaggttaggagttcaagactagcctggccaacatggtgaaccctcatctctaccaaaaatacaaaaattagctgggtgcagtggtgtgcacctgtagtctcagctactcgggaggtttaggcaggagaatctcttgaacccaggaggtggaggctgcagtgagccaacatcatgccactgcactccagcctgggtgacaagtaagactccatctcaaatatatacatacatatatatatatatatatatatatatatatatatatatatatatatgagcttagagacctgaaataggaatatagccaaaactaagccacagcctgagtttttctctatcaaatactcattttctcaatccccgaataggctatggcttagacttggctaatattcctgtttcagatctctatatacccttggatacagtatgagctcctaatcttgactagagagtgatgtgacctaggccacaagctgatcattcagcccttagcccagtaaataaagttcttgtacccttcttgcagactgaattctaaccccagtcacatactaagctcctaatactaaatatagaataatcataatcttgtcaacattctcttttattaattcattcattgaataaacacttactggaggcctactgggtgacaagaacaactttagaatctatcgatgcagtagtgaacacttgctcctgtcttgaagaaacttgagctgttatgatagaaacaggtaaaactggtaactataatccagtgtgttaagtgttaataggagtttttacagtgtgataggcatgtgaagaaaagggtatttaatctaatgtttgaatagtcaggaatggttttccagattaggtgatatctcagctgagacctaaatcagtagttttcaaaccttagcatgtatcaggatcacctagaggcttgctaaaacacagatcgctggaatcaactttgaaagtctctgattcagtaggtgtgtgatggagctcaggaatttgctcattcaaataagttctcatgctgctagttcagaaactacactttggaaacaggtgacctaaaggatgaaaaaagggacatatgggtgaaggtaaagtacagtatggaagaaaagcagggaaaaggaagttccagatttaaagaatgcagtgtgcaaaggcaaagagattgaagttggtgtaaaggaaaaagaatagattctaaaaagatcaatgaggtaaaataagcaagatatggtgattaattggattttgaaggtgagaaagataagtattattgaatgatatcggtgtttttggagaaagattcttaaataatacccagtttttgatttggacaaccaggaaaatagtgatgccattcatcaagatagggaacataagagaaaggtgacttgagatggagtgggaggattggagtattggatgatgatgagttcccttttgaatttgttggatttggtatatttgtaagttgatcaaatataggtatctagacataaagatagacttacagatctggagcccaggaggaaagtatgctctgaaggaatagatgtgggaagcatcaacatctagatagtggttaaaagcataagagtgaacacagttaccccagaagagtatattgaatgagaaagtaaaaatactcagatgagaccccgaggaaggccaatttttaagggaggtaccgattgaaatgtgagcctgagaaaaagttagcaaaataggaggaaaatcaaaatgagattacagatgttaagaaaggtcatgtcaaggatgaagtagtcaacagcttcagctgctccaaagagttcaaataaaataagagcagaaaattttccattgcttatagcaatagggaaatggctgatgattttgataaattggggaaagaagctatattagaatgtattagagagtaatcgggagataagagattgaaaacagtgagtatggcttaattttaagacttaggcagaacaattttaggtaatgagaaggtcagggttgtgcccaaaggctaaagtaaagtggaggcaaaggacactacagttgaggagatctagggactaataggctagagtgttggataaatcatccacatgcaccttgaagtcactcagaaaaatggtggggattgggatggaaaagaggatggtgatccaggtactaaaataatcaataaatgaccattaagagagaagggatacattggaagttgggaaaccagttagaaggttgtagtgatctacaagtgatgataatggcttaaacaaaggtaatagaaaatgagaatggagacaactagataaatttgagagatgttaaggcagaataaataggatattttgattgaatgggtgttgagaagattagggagatggtggaatcaaggttcataaccaagtttttggattaagcacctggatgttggtaccactcacaaagaaaataaatgcaggaagcagggggcagttttttgtttgtttgtttgtttagagtggggagatgttgactttatttttgaaaatcttaatatgagatgccataaaacatcgaggtggaaatgagagagctgtacggatagaagattatcatcagtttgagatatggatctgtaacttggaagagacacctgggatagcataggaatttaacagtcataagtaattacaatggatgatagttgaaatcatgatatgcatgtaatcacccagtgagatagtgtgtaaagtgacaatggcatcagctgagaatgaaactttggaacatactattatttaagaggaggtactctatcttaaataatgtataggtttaaagtagttctaacttaaattacagttcgatattttattttatttgtacaaatgtaaggagtatatgagaaattttgttacatgtatattatgtatagtgatcaagtcagaatatgtacagtgtccatcatccaagtataatatatttttgttaagtatagtaatcttaatctgctatcaaacattgaattcattccattttactgcatatttgtaccctttaaatcagttttcttcatctttccctttctttcacactcaccacccttcccagtctctgttatctacctttccactcttcacttccatatgatcaaattttttagctcctgcatataagtgagaaaatgcaatgtttgtctttttgtgtctggtttattttacttaagataatgacctccatttccatccatgttgctgcagattatatgatttcattcttttttatggctgaatagtattccattgtgtatatataccacattttctttatccattcatcccttgatgaacacaggttgatttcatatctttattattgtgaatagtgctacaagaaatatataagtgcaggtattccattgatatattgttttcttttcatttgggtaaatacctagtagtgacattgctggattgaatagtaattttttagtttttttagaaattttcataccatgttttatagtggctccactagtttacatttccaccaatagtgtgtaagagttcccttttctctgaatccttgccagcatctgtcattattatttttttttctttttagtaatagccattctgactagggtaatatgatctgtcattgtggttttaatgtgcatttccctgataattagtaatgttgagcattttttcatatacctgttggccatttgtatgtcttattttgagaaatgtctattcatgtcctttacccactttttaatgtgttttttttttttttcctcttaacttgcttgagtttcttggtattctagtattagtctcctgtcaaatgaatactttgtaatttttttttcccattcagcaggttgtcttttcactctgttgattatttcctttgctgtgcaatagctatttagttaaatatagtcccgtgtgcctatttttggttttattaactgtatttttgaggtcataaattctttgcctcaaccaatgttcaggagagtttccctccagttttcttctagtatttttatagcttcacatatccatcgtgagataattttgtatatggtgagagatataggtccagttttattcttctgcatgtggctgtgcagttttctcagcactatttattaaagaggatgttctttctccaatgtaagtttttgtcagttttgtcaaagatcagttgttgactgtaaatatgtggcaatatttttggattttctattctgtttcattggtctatttgtctatttttataccatgctgttttgattaccatagccttttaatatattttgaagtcaggtaatgtaatgcctccagtggtttatttatttatttatttgtttatggctcaggactgctttggctatttgggctcttttttggtgtcatataaattttcaaatttttaaaaagttttgtgaagaatgacattgatattttgagaggaattgcattgattctgcagattgctttggacaatatggtcattttaatgatattaattcttttgattttttttatttgtttttatcctcttcaatttctttcatcagtgtttgtagttttttttaaattaatttatttattttatttatttattttaattattatactttaagttttagggtacatgtgcacaaaatgcaggttagttacatatgtatacatgtgacatgctggtgcgctgtacccactaactcatcatctagcattaggtctatctcccaatgctatccctccccccttcccccaccccacaacagtccccagagtgtgatgttccccttcctgtgtccatgtgttctcattgttcagttcccacctatgagtgagaatatgcggtgtttggttttttgttcttgtgatagtttactgagaatgatgatttccaatttcatccatgtccctacaaaggacatgtttattgtggcactattcacaatagcaaagacttggaaccaacccaaatgtccaacaatgatagactggattaagaaaatgtggcacatatacaccatggaatactatgcagccataaaaaatgatgagtgtttgtagtttctattgtaaagctctttcacctctttggttaaaatttttactatgtatttttattattcctaggtattttattattttgtataactacaactggatatatttttgtattgcaatgaaattcttgtatgcaaagttcatttggaaaaataaagaatacctgggcaagaagagccaaaacattaaaaaaaaatactgatgaaatcacactagtgtaacccaatagtatagcatattataaagatgaagttacaataattaaagtgacatgatactgtaaataaaaatcagtaggacaaaacaaacattcctgaagcagacccaagcttctgcctttgtcaatagcaatgggaatacagataatactagtctattactaactgcacaaatctgccttctagaactccatcagcttcagacaagaaagatgttaatttgattagtcagaacctaaaatgtttgctggaaatgtcttaccagtgggcaggattacagtttcttttatctcagcactccctattgcactacccccttccatgtggtaagttgacctatgcctgcaactgggtaaactggatatgtgaattagtacagggtctgtgctgtagatctagctatcttaatttaatgaaatttgagagtcatcagcatgtagatgatatttaaagtgataatatggatgagatcactcaaggagtgagttatacagtaaatagtgaccaaggtggctggattaattcaggtaagagatgatggcagcttggaccagcctgataaagtagaaagggtgagaagttttctaattctggatatattttgttggttaagacaattagcttgtgaattggggtttctagatattcttttttattttcggtagttgctatattttagtcattaatcccttctaggttttaaacatggcagatatcttttcccgatttgtcatctacttgttaactttgtttgtgatatcatttgttgaacagaaatccttgatgtgatgtgatcaaatcaatggaattttggcctcatagtttgtgcttttgaaattttgtttatcaagtccttcccaacccttggtcacaaagacgttctgctgcattatcttctgttaactttataagtttcttttttcacattcaaatctgtaatcagaccagagtttgcatttttatatgctattagctatagatccatttttaatttttctttatatagaaagaaaattttcttaataacatcttctaaaccattcaactttcccccctttgagttgctttgccaccattatttcatgtttagtttctgtaaatatattaatcagtctccaatctattctgttatatttgtcaattcagttcttgcaataatatcatattatttttattattatgggtttgaaatttgtcttactatttgaagaacaaacctcttttattgaggatttacttaggtgtatgttatttttccatatagattttagagtaagtttcaagtttctcaaatacagctaaaattttgattgacattgcattaaatttatagattaatttggagagaatttacatctttatattatttgttggaatggatttccatttattcagatggtcttctatgactttatagttttgtaaaaatgttgtcataaaggttgtacatatgcttggttaagctaatccattaatgcttcttagtttttcttactacttttaaattatatttctaatagattatttataatgtagagaaatgctattcatttgtgtaagttgaacctgtatctagtagtcttcttgaactcccttattagttttactagtttgttgattccagaaatattgagagttttattcttctatctcttattcctttccatttccatatatgtttgccaggatcaccaatactagtgatggtagtggtcatcttcaactttctcccaatctcaagagagtgcatgtaaagtttctctctctttgctatgattcctttttggaaatttatttaaatttccaaatgaacaaacatttatttaaaattttaatcaagataactgacctaaaaccttcagtagaagaataattttaaaaccatcttcggggtggaggagaaaatggtggataggaagactaacttgcagctcccactgggatggacagagcagcatgtgaagatccatatcatgaatctttgctccaggaactacagcagaaacataccactgagagaatccacagaccctttgatggaggtgcattgccgctgcaagctccatgggacagccaagggactgtgagttgtcttgctttctcagttgggaggcttgtagcctggggaaagttctcagccctgctcaccaactacctggaaataaactcagtgctgttggggaggcatggtgcaattgagaccagcctttcggctgtgggctgtcatctttctttcacttccctggtgacctgtgtgatgcagcagaggcagccataatccccctaggaacataactccactggcctgggaaccacacttgcatcccccaaagcagccacagcaagccctgcccaaggagagtctgagttcaggcacacctaattctgcactcctggtagccaaagacaacgaacacaatctcttagaggctctatgaccctgcgtacaacctgacaaaactgaacacttatccaaaggcgaccctatgagaagcatgtatcctccctacacacctgcagctgatgtgttcttgaaagcaccacctcctgattggaggccaaacaacacaaaaccaatgcacttaataaaaatacaaccgaggactcttacatagtccacttcactcccctgctacctccactggagcaggtgctgatatccatggctgagagacatgaagacggattatatctcaagattctttgcagacactccccattgccagtctggagcccagtagctctgctgggtggctggatccagaagagaaataacaatcactgcagtttctccctagggaaaggggagagcaccacatccagggagcaccctgtgggacaaaataatttgaacagcagcctctgagtcccagatcttccctctaacatagtctacccaaataagaaggaattggaacaccaattctggtaatatgacaaaacaaattatttaacaatccccaaagatcaaactaccttacagcaatggatccaaatcaagataaaaatctctgaatggccagaagaaaaaatcagaaggtagactattaagctaatcaaggaggcaccagagaaaggtgaataacaacttaaagaaattaaaaatatgatacaggatataaatgaaaaaatatccagtgaaatagacagcataagtaaatagttatggtatgacaaaatgcactgaaaagtcacagcagtagaattgaagaagtagaatagcttcagaattcaaagacaaggcttttaaattaactcaatccaacaaagaccaagaaaaaataattttaaagaaaagcctccaagaagtttgggattatgttaaatgaccaaacctaagaataattggtgttcgggaggaagaagagaaatctaaaagtttggaaaacatatttgagggaataatagaggaacatttccctggccttgctagagatctagacaccccaaaacaggaagctcaaagaacacttgggaaattcctctcaaacagatcgttgcctaggtacatagctgtcaggttatctaaagtcaaaactaaggaaagaattataaaaagttgggaggcaaaagcaccaggtaacatataaaggaaaacctatcagattaacagaagatttctcagcagaaaccctacaaagtagaagggttttgggtcctatcatcagcctcctcaaactaaacaattatcagccaagaattttttaaccagcaaaactaagcttcgtaaatgaaggaaagatactgtgtttttcagacaaagaaatgctgaaaagaatttgccactaccaagtcagcactacaagaactgctaaaaggaactctaaaacttgaaaccaatcctcaaactacaccaaaatagaacctccttaaagcataaacctcacaggacctataaaacagcaacaatgaaaaaaagccaaggtattcaggcaacaaacagcacaatgaatagaacaataccttacatctcactactaacatttaatgtaaatggcctaaatgctccatttaaaagatacagaatagcagaatagatacgaattcaccaactaagtatctactgtcttcaagggactcacctgatacataaggactcacataaacttaaggtaaaaggggggaaaaagatattccatgcaaagggacaccaaaagtgagcaggagtagctattcttatatcagacaaaacaaactttaaagcaacagcagttaaaaaaggcaaagaggaacagacattatataataataaaaggactaatgcaacaggaaaatataacaatcttaaatatatatgcacctaacactggagcccccaaatttataaaacaagacctaaaaaatgaggcagacagcaacagaataatagtgggggactttaatattccactgacagcactagataggtcatcaagacagaaagtcaacaaaggaacaatggacttaaactatacctagaacaattggacttaacagatatttacagaacattttaccaacaactgcagaatatgcattctattcatcagcacatagaatgttctccaagatagactatatgatagacaaagtccaagatagacaaaacaagtctcaacaaatttaagaaaactgaaattatataaaatactctctctgaccacagtggaataaaatgggaattcaactccaaaaggaaccctcagaaccactcaaatacctagatattaaataacctgctcttgaatgatcattggatcaacaatgacatcaagatagaaatttaaaaaaccttttgacatgagcaataatagtgacacaacctatcgaaacctctgggatacaatagtggtgcaaatgtagcaggacaagctacagacaaaaccctttagacactgagttaaagaagtaagggctttattcgactgagagcttcagcaagactcatgtttccaacaaccgagctccctgagtgagcaattcctgtcccttttaagggctcacaactttaagggggtccacatgagagggtcgtgatcgattgagcaagcagggggtacgtgactgggggctgcatgcaccggtaattagaatggaacagaacaggacagggatttttacagtgcttttctatacaatgtctgtaatctatagataacataactgattaggtcaggggtcaatctttaactaccaggcctagggtgtggcaccgggctgtctgtttgtggatttcatttctgccttttagtttttacttcctctttctttggaggcagaagttgggcataagacaatatgaggggtggtctcctcccttattcccccactttgagaatctcactcaatagtgggagttctcactttcattctcactacctatgtcttcttgcaagacagatcgatagtgattcatatagtacacttgtgccgaagtattttggtgaactaaggtagcaatgaagctttttatcatttgaagaagtacaggtagcaaggaagcagtaagcaggtttctattactattataactcctattataagagttttaaatctttttagcactgggaaccactttccaaacatggccccaggatcgaatccatgccacacttgcacgggcacatgtgccagttttgtcatatttctaactatgtcttcaactacttgcctttgatcgtctatgtgtagacagcaattagtaaggttaaattttctacagacccctccttcagttgctagcaagtagtcgagagccaatctattttgatagatagcatttctcatctgagtttcttgccaggcaagaatagtcaaggctctgctggtcttattagtgattatttctaagacagcttgtaaccatatgattcagttgagcatgtaaatgggggtcgggtatccccacgagctgtcttgtgccaaagtaccaggaccatagtattgtatgattctctcagggggccatgtatcatcttttaaattttctatagctatgcttctctttttgtgggaagcacagacagggaagcccaggagttcacctgtctttgtaggcagtaggaagaaagatggtttaatagtgccaataacacaactacctgcccactggtcgggtattttggtgtaagctctatgcccacaaatccagtataatccagtgggggctgtccagtcccggtgggactctgggtgggttcacagagtttgcaactttgggaatttactaaatggatttttcttagtgtggtttgaactccactaggtggctgtttttgtagtattactatacagtttttgcccgaggcagctgagtcttcccacaggaaaggtgaagtcctttccgactcttgctatacagtattgtctaatgattgaggcttttaggacccaaaagttatcagggtgattcttttgagccaggaattcatcaggaactgggtctgtaggtactaattattgggcttcctatggccattgatctcccattacagttcctctacatacataacaggaagtgacattgagagactgggctacatgctcagctaattgcaaaaacaaatttcttgtttttcctggaatttctggtactggcacattcagtttatcatagaaggtttgaaatactggctcaggagcacgtttataaacttctcctcaaaccacgatatttactcaaggatccagtccaaccccatcgattcctaggtctacacactccccttttttccagcaaggatcaagggggttggttattactagctttaaggggttacactgaccactggtacaggaagggccacttttccttttctgaaggtggacagcatcctttttattttttatccaagtagcctaaatgacacaagaccagcatccacattcatttccacacagtcctaactcatgacaaatgtacttattttctgccatatagcctctttcctaattaaaagaaccacatcttattcctaacattactattaataacagcacaggcatcaaacttcaaggtgacttgtttgggcacccctttttcttttgttttggctaacacattactcatatcatttatgagcccccaccagtcctcagaccttaatcttacttcaaaaactgtggtcatgggaggctcagatggatcataacacacatcaggttggtcatttcctgggctacataccttgcataggatagcatgatacaaacaagttttttttagattcccggtacacttataataatcataaaataataggactgtagcacatttttgtcctacctcagtaacttgatgtatacactgggaacagtcctcattctgaggaaggtcagttaataagtccttactgtacaagtctgaattttaaggaaaatgagtccccgcaatgagttttctcatgcttcggctgtgcgtggaccagtcagcttccgggtgtgactggaacagggcttgtcgtcttcttcagagtcactttgcaggggttggcacagctgctcctgtccgcgtaccactcacagtctactgatgttcaaggatggtttcagaggttgggcctcctagcataaactgagtccaacacctctacacagttatgcttgaccgggctctctgatactgggagcaaggtggcgggatttagggtgttgcaaacttcaatggttatgtggagattttcacatagcaagctttggtacttggttaatctagcatttgttaaccaataatgtcctttggttgtcattaaagttaccacagcatggggggcctttatattcagattttgcccaagggttattttgtctgcttcttgtgctaacagggccattgctgccagggcccttagacatgggggccagactttggaaaccctgcctagttgttttgaaagctaggccactggccttggccagggccccacagtctgggttaaaagtccaactgccatttttttctctttctgatacatagggtgtaaagggttttgtcgggtcaaatagccccagggctcgggctgacatgagtttttcttttaactcgtgaaaaggtaattgctgttggttgtaatagatgtagtttatccaatttacatttttattaactgtcacctaccaaaatattgactcaaatcctgcagctatttgatttcaagcttttaattaatctggtattctctgtgggactccaattgcatctaaatggatgtgagagtcaaaagacccataaggggcttctcttgtgttacgatgtcttatttttcctccctatggttgatgaaatgccagggtgaaagggatagccaattggactaatgtacaagtgccactccagttatttggcagagtgcccagtgaaggtctaccacaataccaccacacatctgctcagggatgaacaagggctgactgattagtaagctcttgaaaatgtttaagctcactgcatcctttcaggtctccaaggaatgctaagtttcctccctgtcatgagagacacaaagtgaacttatgttgggagacggaggttggatggcccttgggggctgacccgcagggtgccagactttgggatacagcagagagagcttggcatgacttattactccaggctgtagaatcctggaaaagggttaccatgcagcccacacctggttgactggaggaccaccttagtggaaaggggacaatctgggcctctggcttgccatgtgcacaagcataacaattgcttttttttaacgtgtggatggaatatttgatccattccaaccaggcatttgcatcttggtatgctgtcttaattgccaaagtttgttttaagtctttaacttctatgatcctctagtaaaatgaatgtatgattttgggaaattaaaaaaactggttggggcagtccatccttgctctctagtggtccacagaatgttgggccaactatggcataaaagctctacatttggggagcaagactcctggttgacattggagtctttattgaaatttccccagattaaatggtcctaatttactaatgcccagtctgaggagagtcaggagggacagaggtacttttctgaagtagagagctgtctttgacttggcaagtccccacagggtataacaaggcaagcattaaatacaatagtttgaggcaaaatcgacttggttatgttaataaccagacggtcagcaatagaacgaggaaagaagaaagagcaatagaatagatgaaagagttaaatttttcttagctttagtttggtagggttttcccctgagactgcagtctaggagtctggagggggtggcgctttaactcaggtgtgatgagtccatcccttttctgctgtacgaacagcagtctcggaggttagcagcacaaggtagggtccttcctaggctggctagagtttttcttctttctgccctttgataagaaggtgatcttcaggctggtgctggtttactggaaattctagtggtggtacctgtgctaaaagacttttagttttgagggaaaggaaagtggaagataaacgaagtatataatttctaagaaattgactttttgttttaaatgtggggacatcaacagtggactttgtagtctttggtgccttcttactgagaaatttcctttagcacctatttttattagtttctagaccaaagaaacccaaacaccattttatatttaataatgcttcttgtatgatttttatgccagataagctaaatttcacctttatattagtatactattaatgttaaacttagttttagtaaaactttgtatacgtatttattcagtttttaatgtcggaccataaggtaagatttttatagactctttttaaccttttataatctttgttaaagagcaggttagtgctttaagaaaaacccattgtgtttttactttaatgtccagttcacagaaaaactggatgatacccctttaacattagctaatatgtttacacacagattttttttataattaacattttaaaacttgccaaaaccttcaaaacaattttttttaaccttttaatgtaggtaaaaatttacattcttatgcctccttctaatctttttaccaaaggcatattttacgttccttatacaccttgcacataaactttttttttccaatagttttacatttaggaagcctagttagttttaaattatacaacatttcttgcataaattcttttttataacatttttctctttcacgactttcacagacaattcttcgacatgccttaactttctgacttattacaaacatttctttctttaaacaaccagttaatgtatttcaggataagaatttaccatataacactctttttactaaattctgcagcccctctttcccccgcttttttttttttttgaagatgataaccattcttttccaaagtgaacttcttttatgtctgtggactagactgtctaaggccacaagattagaaattactataatatatgttatattgttaacttttagcaaactttacttttgttgaaaaccttgtaagtttgggattttaattatcctttgctattaatcagaccttgttttgtccaaattaacttagaattggtatagatgactttttttttttttccttcagttacctgggaggaaccattgattgtcctgtcctgaagggagttcctcctaggtctggttggaactttgtatggtaattaagatttagttcccctgttaggaaacctgctgggttaagggaattttcagtggttaatgttaaatcatccttttcttttattgccttaggatacttctcaactggtgaggtgtgctcacaatgaggtttcctctaaaagttatttttttacttttttctgttagcaaagctcttgctgctatagattgaatgcatttgggccatccaggggttactgggttaaggatttttgataggaaggcttcagtgctttctggatatgcccttgtttacactgacaacaaagtggtattggagtgttatagggttacagagaataccttcaattaccaattataggtttttaatttaccttggcttttaaaggaatagggtacactttttttttcttaactacttgtatctctctctctctctctttctttctctctctctgtctctgattttctgtctctttttctctttgactttccttttacctctgtctctttctctctctctgcctctctctttctctctctctctgctgatctttccttacctctgccagctgcttatgctgctgctctctcaaccactgtggtgggggttggtggtggaggggtctaaaaccagctgtaaccaagtgtctatatatgggaactggtctgggtaccttggcttacaggttaccttgtgccatacctttgaaacaagggacctgtccaggcttccttctgatggccaacccacctctaatgctggccagtctatcttacaaaaagttttaacttttcctggtgtaatagtactccatcgtctcccttaaatcctttcttgaaatttttcaacatagttcctagtggagtgggcttactttgtgcctgacccatgcttcttcaagacaaaacaccacgcttacatcacacacacaccacaaaacaaagaatgggtaaaaagggcacataaacacttttacagtttacaccaaagcagaatcaaaaccaaaatcagagtatcaagaaatccaagccaggtcaaaactaaaaccaaagtatcaagcaatccaagtcaagtcaaaaaaaagaactaaagtgctggtacaggcacaccatgggtgatcaggccacgcttccactcaaatggagtaggcaagttccaaagactagtcttaccaactttcagatgtctggactccaggtgccatttccttcccggtgttcagccactgcattgatcctccacaggggcctgccatgcgctgctctggcaaggcattccactggggcaattgcctacttgggagcactctcaggatctgtgtcactcaagctggccagagtcccccgcagggatgctccacagggcaggcctaagccgcctaaggggctgcctcgactatctgttaatcaccttgcttcctggtcaaggaaccaagaaatgtagcaggaaaagccacagataaaacccctcagacactgagttaaagaaggaagggttttattcggccgggagcttcggcaagactcatgtctccaacaactgagctccctgagtgagcaattcctgtcccttttaagggctcacaactttaagggggtctgtgtgagagggttgtgatctattgagaaagcagggggtatgtgactgggggctgcattcactggtaattagaatggaacagaacaggacagggatttttacagtgcttttctatacagtgtctgtaatctacagataacataaccgattaggctggggttgatctttaactaccaggcccagggtgtggtgccgggctgtctgcttatggaattcatttctgccttttagtttttacttcttctttctttggaggcagaaattgggcataagtcaatatgaggggtggtctcctcccttactaagagaaaagtttaaacatttaaatgcctacatcaggaattctgaaaaagcatatatagacaatctatggtcatgcctcaaggaactggagaaacaagaacaaatcaagcccaaactcagcagaagaaaggaaataaccaagatcagagcagaactaaatacaactgaaacaaaaatatacaaaagataaatgaaataaaaaactggttctttgaaaagacaaataaaattgatagaccgttagggagattaaccaagaaaataagagaatccaaataagctcaactagaaaagaaacaggagatattacaactgataccatagaaattcaaaagatcactcaaggctactatgaacacctttacatgcataaactagaaaacctagagaagattgataaattcctggaaatatacaatgctcctagtttaaagcagaaagaaatagaaacctgtacagaccaacagcaagcaacgagattgaaatggtaataaaaaaattgccaacaacaacaaaaaacccagggtacacagctgaattctatcagacatgcaaagaagatttggtacccatgttattgacactattccaaaatacagagaaagatggaatcctcctcaaatcattttatgaagccagtgtcaccctaataccaaaaccaggaaaggacacaacaaaaaaagagaactacagaccaatatccctgatgaacatagatgcagaaatcctctatgaaatactggtgaatggaatccaacagcatatcaaaaataatctaccatgatcaggtgggtttcatacaaagtatgcagggatgttttaacacccaacagtaaataaatgtgatacaccacataaatagaattaaaaacaaaaattacatggtcatttcaatagatgcagaaaaagcatttgacaaaatctagcatccctcagtaaaatcggcatagaaggcgcataccttaaggtatgacaggccataccttaagatatgtcaagccatctatgacaaacccacaaccaacattatattgaatggggaaaagttgaaagccttccccctgagaactgaaacaagacaaggatgcccactttcaccacttctattcaacatattactggaaatcacacaagggaaagaaatcaagggcatccaaattggtaaagaggaagtcaaactgtcactgtttgctgatgacatgattgtatacctacaaaaccctaaagacacatctggaaagctcctagaactggtaaatgaattcagcaaagtttcagaatacaaaattaatatacacaaatcagtaccatttgtcataccagtacccagcaccttctgttgaatagggtattctttctacactttatgtttttgtttgctttgttgaagattagttgactgtaaacatttggctttatttctggttctctattctgttccattgctctatgtgcctttttttatactagtaccatgctgttttggtgactatggccttatagtatagtttaaagttgggtaatgtgattcctccagatttcttctttttgcttcaccttgctttggctatgtgggatcttttttggttccatatgaattttaggattttttttctagttctatgaagaataatgttggtattttgatggaaattgcattgaatgtaaaaaaatgaaactgaatcctcacctctcactgtattggtccattttcctgctgctgataaatacatacctgagactggacaatttacaaaagaaagaggtttaatggactcacagttccatgcagctggggagacctcacaatcagagcagaaggtgaaagtcacatcccacatggcagcagaaaagagaagagaatgaaaatcaagcaaaaggggtttcctcttataaaaccatcagttattgtgagacttatttactactatgagacagtatggaggaaagcacgcccatgattcaatgatctcccactgggtttctcccacaacatgaattataggagctacaattcaagatgagattcgtgtggaacacagcaaaaccatatcgctcaccttatataaaaatcaactcaagatggatcaaagtcttaaatctaagacctgaaaccataaaaattctagaagataacattggaaaaatccttctagacattggcttgtgccaagattttatgatcaagaacccaaaaacaaatgtatcaaaatcaaagataaatagatgggacttaaataaactaaagttactgcacagcaaaagaaataatcagtagaataaacagacatcccagagagtgagataaaatcttcataatctatacatctgacaaagtattaatatctggaatctacaaggaactcaaacaaatcagcaagaaaaaaaatcccatcaaaatgtgggctaaggacatgaatagacaattctcaaaagaagatatacaaatggccaaaaacatatggaaaaaaatgctcaacagcactaaggatcagggaaattcaaatcaaaaccacagtgtgatatcacattacttctgcaagaatggccatagtcaaaaaaataaaaaaaagtaatggatgttggcatggatatggtgaaaagggcacacttttaaactgttggcggaaatgtaaactagtacagcctctatggaaaacagtgtgaagattccttaaagaactagaagtagaactaccatttgatccagcaattccactcctgcgtatctacccagtgaaaagaagtcattatacgaaaaaagatacttgcacatgcatgtttatagcagcacgatttgcaattgcaaaaatatggaaccagcttaaatgcccatcaatcagagtggaaaaataaaatgtgagatagatatagatatagacatagacatagatatagacatagacatagatatagatatatagatatagatgtagatatatatgtgccatggaatactactcagacagaaaaagtaatgaaatagtagcatttgcagcaacctggatggaattggaaactgttattctaagtgaagtaactcaggaatggaaaaccaaatatcgtatattctcactcataagtgagagctgagctatgaggatgcaaatgcataagaatgatacaatgaactttggggattcaggggaaagggtgggagggaggtgagggataaaagactacacattgaatacagtgtacactgctcaggtgatgggtgcacaaaagtatcagaaatcaccactaaagaactcattcatgtaaccaaataccacctgttccccaaaaacctattgaaataaaaataaaacattttgaagactacctctataaagtaccttttccaagatgtttataccagatatatcttaatctctaaattgtattagatggcatagattctaataagctttgataagcttggaatttgttcctttcatcctactctccaaagaaaatttactctttttttttgttttgttttattatactttaagttttagggtacatgtgcacattgtgcaggttagttacatatatatacatgtgccatgctggtgcgctgcacccactaacccgtcatcttgcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgttcttgcgatagtttgctgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctatatccctgaggaatcgccacactgacttccacaatggttgaactagtttacagtcccaccaacagtgtaagagtgttcctatttctccacatcctctccagcacctgttgtttcctgacttttgaatgattgccattctaactggtgtgagatggtatctcatagtggttttgatttgcatttctctgatggccagtgatgatgaacattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttttaggttgcctgttcactctgatggtagtttcttttgctgtgcagaagctcttgagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaaaggatccagtttcagctttctacatatggctagccagttttcccagcaccatttattaaatagggaatcctttccccattgcttgtttttctcaggtttgtcaaagatcagatagttgtaggtatgcggcgtcatttctgagggctctgttctgttccattgatctatatctctgttttggtacaagtaccatgctgttttggttactgtagccttgtagtatagtttgaagtcaggtagtgtgatgcctccagctttgttcttttggcttaggattgacttggtgatgcgggctcttttttggttccatatgaactttgaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtatgttggattcctaggtattttattttctttgaagcaattgtgaatgggagttcactcatgatttggctctctgtttgtctgttgttggtgtataagaatgtttgtgatttttgtacattgattttgtatcctgagactttgctgaagttgcttatcagcttaaggagattttgggctgagacagtggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagttttttcccattcagtatgatattggctgtggatttgtcatagatagctcttattattttgaagtacgtcccatgaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattccgtttgccagtattttactgaggatttttgcatcaatgttcatcaaggctattggtctaaaattctcttttttggttgtgtctctgcccggctttggtatcagaatgatgctggcctcataaaatgagttagggaggattccctctttttctattgattggaatagaaaatttactctaagtgttgttacaataatactgcagaaggcatacagcttctcctgtatttagttttctcttaatagagaataaaaatccaacctagttatgacatcaaccataccactattgaaaatatgtaatatctgcttcagaatgctgacataagcaatttttatgttttaatataatgtccgtatgaaatcctagtgtagtattagtattgtcagttataaggttggttaatatgtggtgcaatgggggcatatgaaagttataatgtagcataacatcttatttttacgaaaacaattatagtctagtcaggagaaaactacctgtacacccaccttaatgataagctctcctatgtatcaatgtacaatatttaattttaaaatatataaaaaatacataaatagcaccaaaatacataaaatcattatgataaatgcatatggtatattctatcagtaaatctgatgccagatttactttttttagggtactgtaaattattacatagaaaaattataccctttgaaaagcttttgctctgtcatagtgatgtgtgattggacttaatgggcccaattattaaatatctggatttaggtatgagctgtattttataaggaccctgtatacaagtatatcaattatagtaccttaagagctaaccaaaaaatcattaacctacagaagcatgattatgatctaagcaaaaaatgggcttacttaagtaaaaatgcagcatattataaacaactttttacaaatatgtcacacgttaaaattaacatagtttacacaattaattacaaaacaccatacaaactgcctctgtatataaccaattggccaactggatatatatgtgtatgatgaactaattattgagaaaggatggtacatatgtgagcatgctgcaaaatcccaccaggtatgattcaccagcctcctgaaaggcatccatcactgccttaccaaacctcaagcctgttttgaggccccagagagcagttgtcatattagatgctttgttcatgtctggtaatgacaacaattctgggtctgtgaggaggctttgtagtgctttggctgagagtgttgctctttgtgtctgccttaattgccagctatttgtgaggagctttcctagagtggatttatgagcactgggcttactgagcagtttgtttggacagaacattttcttttgcccaatgttaaacttttaactacttcactgccaacattaaacattaaaaccattaacataaaaaaatttaagtaactcagtgaagaaaatcttcttcaacaatggctaatctgtgcatctagtattagatttttgtctttctcaaggaaacattattagtgactatactatatattaaaattaaattgaatatatacatttccaaaaagcataacatggaaatcaaggcatccatcaaatttatgtactgaaccaaagtcttgattttcagaattcactggtcagtcatgattctagaccaaggctgtcaaaacatgtttttatttttatgtatttatttatttagtttatttaatttttaattttttattttaagttcaggggtacatgttcaagtttgttatataggtaaacttgtgtcatggacatttgttgtacagactattatctcactgaggtactaagcctagtacccaatagttattttttctgatcctttccctcttcccacccctcacatttgagtaagctccagtgtctgttgttccctgatatgtgtccatgtgttcttatcatttagctcccacttataagtgagaacatgcagtatttggttttctgttcctgcattagtttgctaaggataatggcctccagctccatctatgtttctgccaaggacatgatctcattcttttttatggctgcgtaatctacagtgtacttataatgcttctttttttaaaaaaaaaaatccaatctactattgatgggcatttcagatgactctgtgtctttcctattgcgaatagtgctgcaatgaacatattcattcatgtctttatgatagaacaattcatattatttgagtatatacccagtaatgggattgctgagttgaatggtagttctgtttttatgtctgtgaggaatcgccatactgttttccaccatggttgaattaatttacactcccaccaacagtgtataagcattcccttttctctgcaatcttgccaccatctggtttttttttttgacattttaataataactgtatgggtatgagatgttatctcatgtggttttgattttttttttttagaggtagtcttgctctgttgcccatgctagactgcagttgcataatctcagctcactgcaacctccgcctcctgggttcaagcaattctcatgcctcagccttgcgggtagctgggattgcaggcacatgccaccacacctggctatcttttttgttttgttttgtatttttagtagagacggggtttcaccatgttgggcaggttggtcttgaactcctgacctcaagtgatctgcctacctcagcctcctaaaaagctgggattacaggcgtgaaccaccacacctggccattgagcagttttttttttcctatatgattgttggctgcatgtatgtcttcttttgagaagggtctgttcatgtcctttgcccacttttaaatggggttgtttttaccttgtaaatttgtttaagttccttatagatattgaatattagacccttcttggatgcatagtttgcaaaacttttttcaattctgtaggttttcagttcactcaattgatagtttctttcactgtgtagaaactctttagtttaactagatgccatttgtcaatttttgcttttgttgcaattacttcctgtgtcttcgtcatgaaatcattgcctttttgtagatccaggatggtattgcctaagttttcttccagtatttttatacttttggatttcacatttaagtctttaatccatattgagttgatttttgaataaggcgtaaggaaggggtccagtttcagtcttctgcatatggctagtgagttatcctagcaccatttattcaattaggggattgtttgtttccccactgcctgtttcatttttagctttgttgaagatcagatagttgtaggtatgtggccttctttttgggctcattatcctgttatattggtctatgtgtctatttttgtaccagtaccatgctgttttggttactgtagcttgttagtatagtttgaaatcaggtattgtgatgcctccagctttgctctttttgctttggtgaactatttgggctctttttggttccacatgaattttaaaatagtattttctatttatttgaaaaatggcatctgtagtttgataggaatagcattgaatctatacattgctttggactgtatggccattttagtgatattgattctgtctattcatgatcccatatttgcatttgtataatctctgatttctttggcagtgttttaggaatggaatggaatggaatggaatagcattcctgatttagctcgtggcttaactgttgttggtgtataggaatgctagtgattttcctgagactttgctgaagttgcttatcagcttaagagcttttgggctgacactgtgtggttttctagatataggatcatgttgcctgcacacagggatagtttgacttcctctcttcctattcatattccctttttttatttctcttacctgaatgctctggccagaacttccaatactatgttgattgggagttgtgggagagtgcatcctcttctcgtgctggttttcaagggacaaaaggtggtttccagtttttgcccattcagtatgatgttggctgtgtgtttgtcatagatggctcttattattttgagatatgttacctcattacctagtttattgagagtttttaacatgaaggagtgttgaatttcactgaaagcctttcctgcatctattgtgataatcatgtggtttttgtctttagttctgcttatgagatgaatcccatttattgatgtgcatatgttgaactgatcttgcatcccagggataaagccaattttatcatggtggataagccttttgatgtgctgtggaattcggtttgccagtattttgttgatgatattttcatcagtgttcatcaaggatatggcctgaagttttctacttttgttgtgtctctgtcgggttttggtatcagggtgatgctggcctcgtagaatgagttagggaggagtccctccttctcatttttttgcaataggtttagtaggaatggtagcagatctttgtacaccttgtagaattgggttgtgaatctgtctggtcctgtgctctttttttatggaggatgtggctggtaggctattactgattcaacttcagggctttttattggcctgttcagaaatttaattttttcctggctctgtcttgggagggcgtatatgtccagaaatttatcaatttcctctagattgtctagtttatgtgcatagaggtgttaataatattctttgttggctatctgtatttctgtagggtcaatggtaatatcccctttgtcatttctaattgtgtttatttggatattctttctttcttctttattaatctaactagaagtctattttattagttacttcaaaaaacaaacccctggattcattaatcttttgaatttttttttgtgtgtgtttgtgtttctcagtctccttcagttcagctctgatttttttttttcttctactagctttgggattgtttttttcttgtgcttctttagttcttttagttgtgatgttaggttgttaaatggagatctttccaactttgtgatgtgggcattttgtgctgtaaactttccttttccctcttcatactgccttagctgtgtcccagagattctgtaatgctgcacctttgttctcactggtttcaaagaaggccttgatttatgccttaatttcattatttaccaaaaagtcattcagaagcaggttattcagtttccatgtaattgtatggttttgagtgaatttcttagtcttgatttctaatatgattggactttgttctgagagactgttatgatttcagtttttttgcatttgcttagcagtattctgtgttcgattatgtggttgattttgatgtacatgtggtgatgagaaggatgcatattctgttgttttgggtggatagttatgtagatttctatcaagtccattttatccagtgctgagttcacatgttgaatatctttgttcattttctgcctcagtgatcagtctaatactgtaagtgggatgttgaagtattccactgttattgtgtgggagtctaaaagtatctttgaaggtctctaagaatttgctttatgaatctgtgtgctcttgtgttggatgcatatatatttgggatagttaggtgctcttgttgaagtgaaccctttgctattatgtaataccttttctttcttgatctttgttggtttaaagtctgttttgtcagaaacttggattgcaacccctgcttctttgtgtttccatttgcttggtagatttttttcatccctttattttaagcctgtaggtgtcactgcatgtgagataggtttcttgaggacagcatgccaacagggtcttggttccttacgcagcttgccactttgtgtcttttaaatgggggcctttagcccatttacattcaaggttagtataggtatgtgtggatttgaatctgtcatcatattagctggttattatgcagactcgttagtgtggttgctttatgttgtcattagtctgtgtacttcagtatttttctggagtggctggtaatggtctttcctttccatatttagtgtttccttcaggagctcttgtaaggcagttctggtgggagcaaattcccttgacatttgcttatctgaaaaggatcttatttttcctttgcttatgaagcttagcttggccagatatggaattctgagttgcaatttattttctttaagaatgttgaacttgggtggctgaagtgcgaggatcccttgagcccaggaattcaaggttgcatgtagctatgatcatgccactgcactccagcctgcatgacaaagtgagaccctgtcaaaacaaacaaacaaacaaacaaaagaatgttgaacattgcctggcttgtagggtttctgctgagaggtccactgttagtctgatgggtgtccttttgtaggtgacctgccctttctgtctagctgcatttaacatttttttcttttattttgaccttggagaaactgatgacacagaagtatagagctgtgaaatgggaaatcaggggtctcacagccttcagagctgagagccccaaacagagatttacccacgtatttattaacaacaagccagtcattagcattgtttctatagatattagattaactaaaagtatcccttatgggaaatgaaggaatgggccaaaataaagggatgggttgggctagttatctgcagcaggagcatgttctttaggcacagatcgctcatgctattgtttgtggtttaagaatgcctttaagtggttttctgccctgggtgggccaggtgttccttgccctcattccagtaaacccacaaccttccaatgtgggtgttatggccatcatgaacatcacagtgctgcagatattttgtttatggccagttttggggccagtttatggccagatttttggggcctgttcccaacatccagtatccctggtggttgaagggtctctttctgttggaatttcagaggcccgtggtgacaggaggttgctccttgtcggttcaactcacccattccccttaatttgttggggaccaggaataagtccgagtgcatggtagccccttgtagagtccccagagtcttcccccttcaacccagcttttgtgtcttccttccatctattctcagtatcttccatttgaatactttttaggagcatgccatttgtgtcagtacctcagtggcatctgttccacctggctgtgtctggtcagccactttacttaacaagtgtttataaatggttaagatttcttgttcataaatggaacagaccatcctctatgtgataattactttcacataatcattttggggtcctagatattttaattgttgttctacttcatcatgtgaagatatgcatgattctcagccagagaaaaatgtgaaaccaagcaggatctagaccctgacctcatagagcatggcctggccaaatcctatggttccagagcagaaaggacacactcttctaagatttttaaaatttaaattaaaactttatatttagtaaaattctctcataatgtagtgtttttatgagtttacaaaatgagtcatatatctaccataacaatcaagataaaaattaaatcacctcacaattatcccttatgctgtccctttgttgtcaagcccttctcccaccttcgtcacccttggtaaacactgccactattttctacgtttctaagctttatcttcttcacaatggcatataaatagaataatacagtccatactcctgagaaacaaacacatcaaacaaaccagattctgataatgatatagatgttggaaatgcctgaaagggaagtaaaaataactatgattaaaatgttaaaggctctaatagaaaaggtgaaccacctgcaaaataagatgggtaatttcattagagagattaaaactctaagaataaaatggaaatgctagaaattaaaaacacaataatagatatagtctctttattggccttatcaggagacttgacacagctgagaaaatcattagtgaccttaaagatatgtcgataaaactcgtccaaactgaaacactaggaaaaagaaaaggaagaaaatgaaatatatcatccaggatctgtgggataatatcaaactccctaatataaatgcaattctaattgtataaggaaaagaaatatgtgacagaagaaagacttcaaataaaatggctgataattttccaaaattgttgacagatattaaaccacagactcaaaaaactcaaagcaccacaacttggctaattattaaaaaaaaaaaaatgcacccaccccagacatacaacgtaaaatctactgaaaaccaaagacattcagaaaatcttaaaaaaacagagaaaataaaatgaaatatagaaagaaaagttatagcaattttttcatcagaagccacagaagccagaagttaatgttacaaaaatcttttacatgctgaaagaaaaaatagtttactcagaattctgtacactgaaaataaaaagaaaacacaaacaacattttcagaaagaaaagtctatgaggattcattccctacatacctatactacaaaaaatgttaaataaattacttcaggatgaacatccccaatacacatagtcatcagatcctgcaaggtcaacataaaagaaaaaatattacaccaggcccagtggatcatgcctgtaatcccagcattttgggaggccaaggcaggcagattgcttgaggtcaggagtttgcaataagcctggccaacttggagaaaccccatctctactaaaaatatagacaagcacttagcatttgttaagggaattcattaccaccacacctgtctcacaagaggtccttaaggaagtgctaaacatggaaataaaaaaccactaccatccacgacaaacaccaacttacatgaatagtccatggacactattaagcaactataggatcatgcctaaataaaaaccagctaacatcatgatgataggatcaaatctccacatatcagtattggccttgaatgaaaatgggctaaacacctcaattaaaaggcatggagtggcaagttggataaagaagcaatacccaattctatgctgtcttcaagaaacccaactcacatgcaatgacacccataggatcaaagtaaagtgatggaggaagatctatcaagaaaacagaaaacaaaaaagagctgaggtagctattattattcaagataaaacagactttaaaccaacaacaatcaaaaaggccaaacaggggtactatataatgataaagggtttaattcaacaggaagacataactatcctaaacataaatgcgttcaacattggagcacccagattgataaaacaagtttttagagacctatgaagatacttagataaccaaacaataatagtgggagactgcaacaccccaatgacaatgttggacagattatcaagagataatattaacaaagatatttgggacataaacttgacattcaaccaaatttcattcacaatagccacaaaaagaataaaatacttaggaatagagcaattcagggaggtggaggatgtctgtaacagaattacaaaacaccactcaaagaaatcagagatgacataaacaaatggaagaggattccatgctcatgggtagaaagaatcattattgttaaaatgaccataccacccaaaacaatttgtagattcaatggtattcctatcaaaccactaaggacattcttcacagaattagaaaaaaaactattttaaaatatatatgagccaaaaaatagcttgagtaggcaagacaatcctaagcagaaaaaaaaaaaaactgaaggcatcacattacccaactttaaactatactacaaggctatattaaccaaaacagtggggtattggtacaaaagcagacacatagaccaatataacaggttagagaatgaagaaataaagctgcacatgtagaaccatctgatcttttttaaatatgacaaaagcaaggaatgggaaaagaagttcctaatcaataaatgatgctgggataaatgactagcaatatgcagaagattgaaactggaccctttctttaatcatatacaaaaatcaactcaaaattgattaaagacttaaatgtaaaacctaaaactataaagaccctagaagaaacctaggacatatcattatgcacataggccttggcaagattttatgagaaatactccaaaatcaattgtagcaaaaacaaacattgtcaagtagaatctaattaaactaaaaagcttctgtaccaaataaactaccaacaaaggaaacagacagcctacagaatgggagaaaatattttcaaactatgcatccaacaaaggtctaatatccagaatctataaagaacttaaacaaatcaacaagcaagaatcaaacaaccctatggacaaaagacacgaacagatacttcttgaagacatagacgttatattctgtggccaacaagcatatgaaaaaattctcaacaacactaattattagagaaatgcagattgaaaccgcaatgagatgccatctcacacctgtcagagcagctgttattaaatagtcaaaaaccaacaaatgccaatgagattgtggataaaagggaatgctcatacactgctggcagaaatgtaaattagtttagtcactgtggaaagcagtttgaagatttctccaggaacttaaaacggaactactgtttgacccagcagtctcattaatgggtatataaccaaggaaatacaaataattctatcataaagacacctgacgtgcatattcatcacagcacttttcatgatagcatgaacagtgtattgaataataaaaagtggtactattcactatggtgtactaggcatccatgaaaaagaatgacatatttttgcagaaacatagatggaactggaggccataatcctaagtgaactaatgcagaaacagaaaaccaaatactgcatgttttcacttataagtgggagctaaacttagagtacaagcaaacgtgtactcaaagttatgggtaacaatagacaccagggtgtacttgagggtggaggatgccaggaggctaaggatcaaaaagctagttaggtatttttgttgaattgaaccctttaccattatggaatgctcttctttgtctttttttgatcattgttggtttaaagtctgttttgtctgaaattggaatagcaactcctgctttcttcagttttccatttgcttggtggatttttatccatctctatactttgaccctatgggtgtcattgcatatgatatggatctcttttaaacagcatgcagttgaatcttgcttgtttatccaacttggcacttcgtgcctttgaattggggcatttaaccagtttacattcggttaatattgatacatgtaggtttgatcctgtcattgtgttgttacctggttattatgcagacttgattgtgtgctttctttatagtgtcaatggtctacgtatttaatcatgtttttgtggtcattggtaagggtctttccttttccaggtttggcacttccttaatgacctcttgtaagccaggtgtgatgataactaattcccttagcatttgcctgcctgaaaaggatcttaggatcttatttctccttcttgtataaagcttagtttcactggttatgaaattcttggtttgaatttcttttctttaaagatgctttatataggcccccagtctcttctgccttgtagagtttctgctgagaagtacactgttagcccaatggggttcctttgtaggtgacctgcccctttcctctatctgcctttaacattttttcctctattttgaccttgaagaaaactgaagactatgcacactaggaatagtcatcttgtatagtatctttcaggtgtgctatgcaattcctggatttgaatgctggcttctcaagtgagctaggtgaaattttcatggatattttcaagtgtgtttttcaagttgtttgctctctctctttttcagggttgtcaatgagtcatagatttggtatctttacataatctgatatttctcagagattttgttcatttatttttatttttgtcttaatgggttatttcagagaactagtctccgagctttgaggttctttcctcagcttggttgattctgctgttaatacttgcaattttattatgaaattattgaggtgaattattcagctctatcagattagcttggttctttcttaaaatgcctattttcttttatctcctatatcattttattatatcccttagatttttttaaattgggtttctactttctcctgaatgttgatcttcattcctatccatactctgaattttatttctgacattttacccatttcagcctgattaagaaccatggctggataactagtgtggtcatttggaggtaagaggacactctagctttttgagttttcagagtttgtgtgctgattctttttcatctgtgtaggctgatgttccttcagtctttgaagttgctgtccttcagataagtttttcttgcttttatattctttgattcccttggggatttgattgtggtgcaaggtgggttcagtagaatgtttttttttttttaagtgatcctcttaaaaatattttagtacatagaaagtcatttatacatattattaaagcaaattatgaaacattatgtgtagaaaacttccatttatgtgaaaaataggccaactgaggaccaattgtaaagaccatcaaggctaggaagaaaccgcatcaactaatgagcaaaataaccagctaacatcataaagacaggatcaaattcacacataacagtattcaccttaaatgtaaatgggctaaatgctccaattaaaagacactgactggcaaattggataaagagtcaagacccatcagtgtgctgtattcaggaaacccatctcatgtgcagagacacacataggctcaaaataaagggatggaggaagatctaccaagcaaatggaaaacaaaaaaaggcaggggttgcaatcctagtctctgataaaacagactttcaaccaacaaagatcaaaagagaaaaagaaggccattacataatggtaaagggatcaagtcaacaagaagagctaactatcctaaatatatgtgcacccaatacaggagcacccagattcataaagcaagtccttagagacctacaaagagacttagatacccacacaataataatgggagactttaacaccccactgtcaacattagacagatcaacgagacagaaagttaacaaggatatccaggaactgaactcagctctgcaccaagtggacctaatagacatctacagagctctccactccaaatcaaaagaatatacattcttttcagcaccacaccacacctattccaaaattgaccacatagttggaagaaaagcactcctcagcaaatgtaaaagaacagaaattataacaaactatcactcagaccacagtgcaatcaaactagaactcaggattaagaaactcactcaaaaccgctcaactacatggaaactgagtagaatggttttgattctagtctactccttggtgtttaaataactccctctgattactgtctctgtgcctatgtttcttttgttgggtgttcttgtccatgaagctccctcaggcagaggctgcagttgcagacaggccatgtccttgccgggtcagctgtaatctgctgtcggagtatttcctgggggaacatggggttgtgcctgcccacagagtcccagcagaagtgggactgctgggttggaagctctagcaggtgtagcctgtctgtccatgagaggtggaggtggatggaattgattgccctgttgtctgggtgtttcctgggaaaacaggaagctgaataggactgagttcagacagaagtgagactgttgggttagaaaatctagcaggcattacctgcctggctaccagtggcaggagtgggtgggattgccctttctgccatctgggtgctttttaagacagcagggggctacagatgttggctgagtttaggtagaagtgagaccattgtgccagaagctggtgctaagccctgtctgatgaggggcagtagagcaatcttactccttctaggcaccatgactttagtctttattggggctgtggtgtcagtgctggtctattctgtggcctaagacttgtagagtttcccttggagtcaagagtttcccctgcaaagcatccaggtggtcctctgcctcagtctagaagcatggtgggggcagtgtgtgggggccagggtgattctgctgttcccagtcttgcataggctcctgtggaggatgtgagtatcccagaagattctcacttactcacctttcccctgttggagaggttcttctggctctttgctgtgcccatacaggctggtgctcagcttccctcttctctgatttctgtagccctgctaccttgatgaatcctgacatggtttctctgttgattggccttcagggccagtgtttattaaactttttgtttcttctctgtgagagtggagtacatgagctgcttctattctgccatattggcccctcccaccctctcatttttgaagggtcattttgtcaaatatagaattctttattgacgagtatttttttctttcagcactttaaatatgtcagttaacttatttctaacctccatggtctcagagaagaaattggctattaatcttattgagaatttcttttctgtgacaaatcttgttttgcatcttttcaggttctctttgtcttttttaaaatagtttaattacaatgtgccttggtgtgggtagagttttgctaatcctacttttagtcagctgagcttctcggatgtgtagatttacatgttttgtcaaatgtgagacatttttagccattattgtttcagatgttttttctcctttctctctcctccttctttgacttccataatacatatattaatccgcttgatgttgtcctacaggtcccttatgctctgttcacttttcttcattattctctccttctgctcctcatactagatattttccattgtcctatcatcaagttatctgattctgccttctgcctgctcaaatctgctgtttaactcttctagtgaattaaaatttcaattctccttttctattccagaatttgtttggttcctttttatttccatatctttatttatatttgaattttgttcagatatggttttaagtttttctttactttttatttatgttttcagttctttaagcatacttaagcagctgttataagtaattacatcagtgatatagtgggaacaaaagtcaagttacatgaaccaaaaagtaaaaaggagttgtgggaatgaaaatagggagtatcaacaacttttctcaaggcttgttttaaagggtattgaaaaatgggatattgtagttcgatagaaatgtgtgactaaggaaggttttttaaattgcatagtttgggctaactgtccaataccatagccaccagttacatatggctgtatgaacttaaattcattataattaaactaaattataaattaagttcctcagttatattagccacatgtgactactgtattggacagcactgaaaactcctctgatttgcaccatcttccctttcttttatccagttacaaataataaggcatcttttctctcattaaatattaattcctatcattcatactctggaccccattccctctccatttttttacttacctaagtcctatggttattatttctctctctctctcccacctaattatcagtctctccctctttgctagatcaacatgctctagtactgtagtaccacctcattcctggtttcactttctatgctttcaattattcatgttcaatcataatctgataatattaaatgaaaacttccagaaataaaccatttttaagttttaaactttgtataagtggtgtgataacatctcatactatcccacctgggatgagaatgtttcctttgtccagcatatccacactggatatgccacctgcccattcggcacttagctgtctcagttaccagatcaactgtcacagttttgcaattcttgcgttaatgtagcttttattttacttaataaaggccccaaagtggtagagtaatgatgctggcaatttgtatgtgccaaagagaagccgtaaagtgcttcttttagtgaaaaggtgaaagtttttgaattaataatgaaaaaacttgtatgctgaggttgctaagattgatggtaagaatgaatattctatctatgcaattgtgaagaaggaaaaataaattcatgcaggtttttctgtagcacttcaaactacaaaagctatggccacaatgtatgataagtgcttagttaagatgaaaaaggcattacatttgtgggtggaagatataaacagaaatgtgtttcaattgacagtaatcggcttcagtactatctgtgctttcaggtttccactggttttggaatgtatcctccttggatagaggggactactgtatagtgagagaagtttgcggattttacaatagtatgatgagagttttttctgatggtttcaattttcttattcatatctaagtaaaggccatcagtgttgtggaggtgggtgtgctggtgtaggaggtttgaagaaaaggaaaaaatgtatgaaattgttgattcaaagggtagaaaaacaaacttttctgagaaatggaataagactgatgaacagtatagaggacccacgtgagtagaaacacttccccctctgaggctcaagggcttggtagacatggataaggaatggaattttaaaggatgagagcttttgtagagtagtggtaaaaggaattttcaagatagactgcatgggctcaaatttcagctatgatgtgtgatcttcagaaagtgatataatatctatgagctgaagccttacttatttcatatatacaatggaattaatagtaatatctgtctcatagggattttgaattaatgtattttaagtgctatgcaagtttttgccaatattattcttattctgtgaaatttgagttgaattcagttgttgagagtgagaaggtaaggaacaaatgaggcttgaggagtgtattgaaagtttgtacttgtcacccagaggaacaggattggaagctattgaaccaaacagcactgaggacacaattgagactggaaaatagaaatttgaagaagcagcactacagaaggctgtagagttttctccagctgtgttcagcacatcacagtctaagatcagagaaggcagattgtaaaatacacctagggaggttagtggtacccaactttagtggacatgacaatcacttagagggattgttagattgcccataggctgctgagcccatgcccagagtttctgaatcttcaggtgtggagagattcccaacaatttgcatttctacaaattgctaagtggattctgatgctgctggtggaagaaataaactttgaggaccactgatttacaggaagttattatggggtgggagtggtgaaggggatgcattgtgtagaatagagtaacaggcaagaagacatgagagtgcaggatatttgtaaaagagtagttcaaatgctgaccatggcagtgagggaatttggaccagatagggaaaagaatggagtcaggaggaacctgattaaaaaaggtagaggagagtagggatcttctcaaggacatagcacttatcccaccttgtaattctacatggtttttttgttggtttacttgtatgttgtttcctctcctgactagattctaagaggacaggcactatgttgttttgttgatgactctttccaacactcaacatgtagtatttgttcaatacagctttgttgattgtatgagtgaaaaaaaattgcatgctttcacctctgactcttctttaagctctcctcattccttgagattcagaccaagcctaaactcttctataacactttatccggtgattaatacctctaaactcctgtagttgtttaagtcttacagtataattgacttttttgatgtacagttgtatgaattttagcacatgaatagattagtataatcaccaccgcaatcaggaattagagcagttactttcttgctatccccgccctctttgaaccactgatctggtctcaattcctattgttacatctttcctagaaaaaatatgcatatatatgtatatatattctttgatttacataagtgatatctacatataaatggaatatatttatgtatataaatggaataatacagtatgcaatacttcaggattaacctttttcactcagcgtaattctctggagattcatctaagttgttgtatgtgtcaatagtttactatttgttattgctgagtagtattccatggtatgaatgtaccacattttgtacaacttttcactgttaaagggaatttagattttatccagttattagctcttgttaataaaattactatgactatctgtatagaggcattgattgattgagacagagtctcgctctgtcacttaggctggagtttagtggcacaatcttggctaactgcaacctctgcccccaaggttcaaatgactctcatacatcagcctcccgagtagctgggattacaggtgcccaccaccacattaagctaatttttgtatttttagcagagataggttttgccatgttagccaggctggtctcaaactcctgacctcaagtgatccacccactgtggcctcccagtgtgctgggattacaggtgctgtgtagaagcttttgtgtgaacatcattcacatttctctttggtggatacctagaactaggatttctggatcatatagtaaggggatatttaactttataaggaactgccaaacttttttccagagtgtctgaaccattttacattcccatcagcaaagtgtgagtgattcagttgttccacatccttgccagcatttggtgttatcactgatttttaaaggccattgtgacaggtatgtaatgatatctcattgtaattttgatttgcattttccaaatggctaataatgtttaacatctatcatatgtttatttgtcattcttatatcttgtgttgtgaaatgtccgttcaatttttttttgcctatttttaattgggctgtttttattttgttaaaatttaagagttctttatgtattttggatacaagagtgaagccttgactactatggtcagtccagggctctctgaggaaattatatttaggctgatatttgaatgtagcatagaaatcagccatattaagaaagttacaggacagcttcaactgcaagtgtaaataccttgagacaggaatgatctcaatgtatttaaggaataataagaagacagtgtggctgtagcatactgagaatgatgaagaataataagaaatgagtttgtagatataaagaatgataagtaagatcatgtagagtctcgcaagccatggtagggaatttttgtttagatttactcacagtgaggagctgttgcagagatgtggcatggtttactttgtattttaaaaggttacatttgttgttatgtgaagcatatgttatgagaggaacaagagaggtggctattgtagtttttcaggtgccagaagataatagcgcagactatggtggtagcagtggagatgggtagaagtggataatatgagatagacttttcaggtagatccctcagaattttgatgatggatatgagatgtgaggagtgataataatcaaagataactcttgtgtttttggcttacataactggtggcactatctattgagataaggaagactgaagaggagaaggtttgggggaaaatcaaatatttatttttaatatgttgagtctgagataaaaattagacaaatggaggtgccaagaatgcagttgaataagtcttgaactcgatggagaggttggagagaagttcatgtaaacagaacaacatgacaaaagatacagagctgtgaaagtatgaggtatgcccagaggtgagcatgtagttaggttcgaccagtatatattttgcagaaccagaaagagtaagagatatggctgaaaaggcaggccagggctgagttagagagtgcttagctgatggggaaatttttgaaatttattatttgaatattagggagccattacaggcctttgataaaaggtatgacatgaacaaagagagattttggaaagattaatatggcatagccaaaacaatgttaaaaaagaacaacaaagttggagaactcatacttactggtttctaaacttactacaaagcatagaattcaagattgtgtggcattggcataaggatagacagatagatcaatagaatagaattgaagatccagaaataaaccctctaatttttggtcaattgattttcaacaaaagtgccaagacctttcaatggaaaaaaatagtcttttcaataaattgtgctgaggcaattggatatccacatgcaaaactatgaagttggacctctaactcacaacatacagaaaaatcaactcaaaatgggtcaaagacctaaatataaaagctaaagctataaaacttttagaagaaaacaaaggagcaaaccttcataaccttggattaggcaatggtttcttatatacaacactaaaagcacaagtgaacaaataaattgaaataccttaaaatttgaaatatgctttaaaggacaccataaaaaagtgaaaagacaatccacaggatgtgaaacaatttgacaatcatatatctgataagggacttgtatccagaatccataaggaactattgcttgatgtcattgttatttgacaatgctattatcaaaaaacccataacccaatttaaaatgggcaaaggatttgaataaacattgctcccaagaagatgttaaaatggatattaagcacaagagaagattctcaacatggttaaccgtcagagaaatggaaatcaaaactatagtgagataacacttttcacatgctaggataactaaaataaaagatttttaaaagcagacaataactaattttcatgcagatgttgagaaattggaaccctaatatgttgctggtgagaatgcaaaatggtgcacgtgctttggaaagcagtttggcaattctttaagtggttaaacatagcattaccatacaactcaggaataaatgaaaacatatatccacataaaaacttgtacacaaatgctgatagcagcactattcataataactaaaaagtggaaatgacccaaatgttcatcaactgaagaatgaatgaataaaatatggtgtatctattcaatggactattatttggcaataaacacaactaagtattgatatgtgctacaaagggggtggacaatgaaaacatattaaataaaaaaattcagtcacaaaataaaatgtatgatataattcaatatctatggaatgcccctaatggacaagtctatagagacagaaagtggaatattgattaccttgggtggggtggggcaggaatggatgggtggattaggggatgagggcagtacaggagtttttttggtggtaatgaaatggaaaatgaatcgtggtggttacaaagttctggtaatatactaaaaacattgaattgaacattttaaaagggtgaattgtatggcatgcaaattacatctcaataaagttgttagaaaagattaatatagcattatttggaagatgaattggagggggcaaggctggaggcagagaaacatgttaggaagctttgtaatggttgagttaagaaaacaagggtccaaactagggcaagagtaatgataattgaaaggagaagaggatggttctaaaatatagggtagaggtataatcaataagacctgccatttggttagatgttgaattacgaaagtgaagaagtaaagattaaagttttgagtctgagtaagtaaaagagtgataatgttatttctagatagacactgagagcacagattgggaaacggtggtttttcaaaggagggaggtgagttcatacaatctgttttcctggtgctgtcaggacaatctttaaaagatattcagcatctaattgaatatttggagttggagcttagtaacaaggggagtctggctggaactaagtatttaagagtcatcgatgcacagatcatagttgaagtcagaaaggtgactaaaggttccaaggagagagtatggaaagagagaagagaactgagacagaactttgtgcaaacaactgcatttaggatatagcagctggaaaaaataaaccaaagcagagcaccccaccccacccccgccccgcaaagaaaaagatgatattaaaagcagagaaaaaaaagtagcaaggctgccttactagaggattggacctgggcctttgaggatagggaaagtagaaaagaaaggttgagggtgtcccaggagggagaagagcaaggtcacaaaaataaaatgatggaggaatgatgaagaaagatcctaaagaagatgggattcactcaccactgcctcttggggagacctgggagttgagagaaatttctgacccggtgcaactggaggttccttgttacacttctaggtgaggtggtcacttatcagtggaacatcccagagaggtctggccctgggcccaatgactctgcttgtgtttcctggatctattattctgcagtggatcccatcaaggtaaatacaagattggctacctggaggtgggtcaaactccctggcaaaaagaagctattaaccaggtgtagtaagaagcttactcctgagattctagagcctagaatttggggaacattcttcaaaagctggacttattttaatagacaggaggagggacgaagggaatgggtagcaccagatatttgtcatgaagattttcttccttatcttttcattttggatcctataaagcaacatgttctcattataaaaaaaaacaaacacacaaacaaacaaaaaacacaaaagaaacctgggattggttgtacagagattgaggttctagtcccaaatttggttatagcatgcttttagagtgaccttaaataagtcattctgcctctgttttctcatctggaaaatggatttatcgatctagccatccatctacagccagccattagtaatcatttattgagtgcctaccacattttaggcattttacttggtgctttggatgatataaatttaagatacatttcccaccttcaaagagtatggtctagttgagcaagagggaacctggagaaggcatcacaatgggaggtgcatgtactctgggccttgaaagctgagtcacattatgccatcagataagggatatgatgatggagagggcattgcaggcagaggaaacagcacaaaaaaacactaggttgtaaaaatgcttggtaggctaagagatcaataaatagtttagcctagataaagcataggtcagatagtgcatcttaactgagtcccaagataattgttagaatgaattcaaataacatagtggggtacttataaatgtaagatatcatgaggaaatgctgagaggcacagtgggcttgtatgagaagctggctccctgcggagtactgctacccagaaacaactccatctctttctctctctcccacttcctcccttcctcaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatggtcagtagtaaaaaacctactcttgttccaaagcagtccctactggttacatggggatatttaataggcctattgctacctaagggaacataatcccagagaggacacgaacatgggaaggtgaaatggggatgagttagaagaagcatttcctattattgtacatttacatatacaaaggcagatatgtggtccaggttagattgggtgcccagaaagcaggaagttgactctgtaaattgccatggcgataccagaaaattttaacatattagagaaggcaaaatggacatgtatgaccttcaatgtacttgtcaagctggctgcttagtgcccctctattttaaaaccctgagtttagtctgccaatatcatcttatttatttaccactctaaatttgggatctgttttctcaatggattccaatacagccagatgaaagcttgtattttagtctctttttaaaagagtttcaatttatagatggaagaattgaagagatcctcagtgagaagcatactggatttatgtcagatacaaggaagaactttttggtacttgaatggattttggagagaaattgtgcatcaaagccttcctttgtttgagagatctgtgtagcttttcaaaaacaagagaaagaggggagagcataagtgcagtagaatgaagtgatctctcactattccttctagcccaagatttctttgatctgagaatgaggagcatctttgatagtgattctaatggaactaaaaagtcgtatattattatcccacagattttagctatttcaccttgatggagtgatgaatgattcacattagaacagatgattcacagacttcacaaggcagaaattttagcgcctgtcaaatcagagaaatggtccaggataaaaagggaaagaggacacagttaggtcctgttaatgcaggggtttggctaatgcttactttcttctgtttgtttatgtgtctatccacactcttcaggtataagtctacctacctatcgatcgagcaggtatttgttaagcagtttctgagtgctagccctggagatatttgcatctgaggggtaaataaataacatccctctcttccttttcaggttcctgaaccaactgagaaagagagatgcttaagatcaaatgtgaaccttaatactaagaaggctaattgaaaaactgatttcagttctacaactaaatgggcttactaacacttctctggcaacagatagacatttccaccttgtcattgacatagatgggcagcaatactcacctctttggcagagggagaatcataccccacagtgaaataatgaatcggctattgcccatttctgtggcctgattgatgagggagagaaaagatcaataagaggctgagttgatcatgtttagtttcctctctgaaatccacaatttggtagaggtagacatagagacagattataaatgattgcttcctctcttgggtgataaagtggaaattatcttctctctgtaagaacataagaagtgggggaaaattgtccagggaaaagtcctggaagtgtgaattattgtaacaatgagtagtttgatgtccttggagcataggatgtggcctgggaagagacccatgcattaatatcattattaattccatgcattaatatcattattaattctatgcattaatgttattaattccatgaatgtggcaggtatttttttaacatttattgtaggctcagctgtctactgggtgttctgagaaaatacaaggaagctatagtaatgcagtgtatacatacattctttcctgcatattaggaacctatagtctaattggggatgtaagctttcacgcatgaaaagacaggtaaatgtagaagacaatttcttatgagtttcagtgagtcatgcagacagtactggaggagttcacaggtggaaggggatgcagggaatgagagttatggagaggaactaggagatcaggaaagtctttctgggggagtgaagatttgactggactttaaaaaatgggtaaaagaaggcaggatttctagtagggaatcttagaaacacaaggacacaaagaacatgcatggaccatttgagggatggtgaagaaatcaccccaactggaataaatgtgttgggtagtgggagatgagtctaggaaggtggtttggagttatattttgaaggatcttgttgggtgaagtaaggatccatggacttgctctttggagcaggagagagtaattaaaatattttaagcagcagaatgatgtcatcagattcagtcacttagagagataattttgataatatcaatgtaagaagataccttgaagagggacagatggaaaaaagatgagacaaattagaagcccattgctatcttcggtaaaaaagattaggcctaggatagtggaaatgggaagtccaaaggagagatgtaagaagctttttcttttcttttcttttcttttctttttttttgacagcaatcaatgggaaactctatgccaaccttaggggtcttaccatgtaccaaggagaacgagtggcctggtacatgctggccatgggccaagatgtggatctacacaccatccactttcatgcagagagcttcctctatcgggtgagctggaaaatgggctgagtccctcaaggatgattagaacagtggtttaacagcaattgagaaaaaaggtaacagtgtggaacaggtaacaattagttaaagagcagaggtctagtacatggagcactgagctggaaattctagtctggctgtatatcctagactcaataacttcccgctaggccctagctttcccttctgatgtggaagacaaaaaaggcccatttatcagtaaggagactgaaggaatcaatatcaagtctcagtcaaggacttgagactcaatgagcagtgatttttaagaacaaggaatttcagagtggcatctcagaattgctgaaagtccttaatctattataagaagagcttcaacttagggggtacatggaacaatatgtagattttgaaaacagtttagtcttaggtaaaggaggaagagttgggggcattgatacagacttcgagatttagaagtgctgaaaaagacaatggcaaagataactttatttgaatcaatttctaaaggaaatatatgcctcattcataggggtcaaagcttaagccaaattccccatattttagcctgctgaaaattataaagatacttgttttgaaccttctaaagtaacctagaaattctttttctttgggacattttaagaggagaaagtcacctctgttgatttagcttcggtgggtgggttcattggagatatgaataaagtggactttttttttttttttgagatggagtctcactctgtcatccaggctggagtgcagtggtgtgatctcagttcactgcaagctacggcttctgggttcacaccattcttctgcctcagcctcccgagtagctgggactacaagcgcctgctaccatgcccggcaattttttttattttttttattttttattttttttagtagagacggggtttcatcatgttagccaggatggtcttggtaaagtggacttttaaaaccactcactggtctaggaaccttgaagtctcagctccctaatgtggacatcacaattttttggttcctgaaagctctaagatgatttttatacccttcacttcctctccctcattcccaatctctcttgcagaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacaggtaagtcctaacttccccaaaatgatcatcttctaacactttatctagcctataggaagcaggtaataccaaaaagcctcttgattgtctccttctgatcccacaataagcaggtcttaaggcagagcatagcctccctctaggtattgccccaaccagtatttctaatcctccattgcacctgtccctccattgccccaactgatatttctaatcccctgacacctgtccctctccaaattacttcaaaacctgttgagctcacatgaattgacccagcctgaaaccggtttggctctatgcattgaagcctagtgcaggcctgcttcttttgaaataaatttaacttatatacaaatgtattacttgacttcattagagtaactgattatttcaaggaatattgctgattagtctttctaaaaagagaataaaaataattctaatagtcacccattaaattgatttgttctatggggttgtgaaaggcaattctttctttttttctttttttttttcttagagtaaaggtcttgatctgtcacccaggctggagtgctgtggtgcaatcatggctcattggagcctcagactcttagactcaagcagtcctcccacatcagcctcccaagtagctgggactgcaggaatgtgccaccacataaggctaatttttatactttttgtagagaagggggtctacctatgttgcacaggctggttctaaactcttggcctccttctgcagcagcaatcctcccgccttggtctcccaaagtgctgggattgcaggcataaggcactgaacctggcctagtttttattttttaggcagggttttgcctaggctggtttcaaatttctgggctcaaaccatccttccacatcagcctcccaaatcgctgggattacaggaatgggccaccacatctagcaagacagttctttttggtttttgaatatcttcatctaaggctagaaagagagattgtccttcagttacagcttatctgagttactaccaagggtggaaacaactttttctttatattttatatggagagggagcagctgggacaatttctttaccagccactctttgttcctcaccaaaaaatgtagatgggtaggctgtgttggcttttgtgtctttgagtaattaaagggtcaaatgtcttacttcttaaggttcttgacctgagtccaatccccaacactatttgccttccaagaagccctgtagagccttttgggacccatacaaatcaaggctgtgttttttttttttttttctatgcttttaaagaatatatagccaccatttgaacaaaaatggttttctggggttgtcagtcattggcattctatcaacaagaatagtgaaggggaaaatgtctttgaatattcgtacagacttagcaaatgtgggtggagaatacaactcttctgtttacccttagagagagagatgaatgattgcacattatgacttcctatataatttaaaatatttattctctatcaactaatactgctagaatgcagcttccacttaactactcaggagctattccctagcacccagatttacagaaacttctttgttgtgttgtaagtacatagaacaaaagtcaagtgatcaattgatacatcatcaggttgatatagatccaagacaacaggttttctctatatgtagtaatgggttatcccaaatatgaaccatccaatatatgagaccatttcaatacatattgccagggtacttccatgaggaaggatagctcatatctctctatgacaatgagccagcccataaatcttttctatttgcccttttgtttttttataacccgctatggcctaatttcatattgtttcaactccatgtgtgttaacaggccaacaggaaggaagagttgaaaagacagagggaaaagactaatttttggaacaaggtttctgataaggcagcagggaatgagaatcagagctaacatgaaagattagtgcaagagtggaggaaagtcatctttctactctaagaagaaagaagacagaaaatataaggatcaatgtgtaggtttgaccagggggtttgacagactgacagataatttcagcctatggtctttctcttctctctgatggagcaaatagagtcatctgctgagaatgaaaggcaggttatagggtacagggcttgagaaaagtggatgaaagtttgaaatagccactctgggggatgggaaataaataattatcaccagccagcattgagggcttagttgaaattggacacaaaggataataatctttacaattgtgttattttctctaacagcaattaagcataccagacaaaatacagggtaattacagttactggagttttggtagattattgcaacactcttggtagattagtagttgaagtgatagaccttggagtctcacttggtcaggaatggaagaaaagacaggatgaagctactaggttgaggaaaaaaactgaaggttttgaaagctagaggtctcatggcaggggaggataacaggtttttgaaataaagtgtattagagcactgaaaggatgggaggttgttgttagattttagatttctgagatgtaacaattcttgataacaaggttaatgtgaccatgggagtggttggtagaattggagtagacatcaaagttattggagttaaaagggctagaaactgtgaggcttgagtatttgatgggtcagcacccatggttggaattgagggagaggaagactgagccaggtactaaagacttccataaatgaagagaactgctagctaacaataacaagaaatgattgtagttctagccaaataatatgagcctcaaaagagatatgtttttacaaaaagaggaggaacaatgatctcaaagaagtattgagatgatgtaaatgaagtatggtcctcagagaagaactcagctttattaaatcaaggagaggaagaagtgttctgagaagatgttgaatgtgtagagaagtaggtttcacaaggagcagggatttcctgaaggaagtgtggcaaatggttggaaatagagcaataatggggatagaggaagtgccaagaaatatttaaataatagcagaggggtgatttacattttggactccaagcctgttctcttgcccatatttcatgtcactgttcaaaatcaaatcaacataccaatattgacttggactataaagtagtaaattctgcctttattttgcttacttaatcacagagaaatttctgcaaccaatgttgacctttcatagggggcctatggattggtaggaagaacaataaggctaacctcttgtcttttttccccccaaccagaacacttaagccctctcaccgtcatcaccaaagagactgaaaaaggtacgtaaaatgatgcacagactgggtacttatacatagtgtgtctgtgtatgaggttgggtgaagtacctttagggtatgggacttatgtgactgagagttagaatacatcagcagaaagtatcctgagacttctgcaagacttcagaagccaaagaaccaaggtttagcttccctcagcaggtttattctctctggcttccacctcaaacctcctgagttggggaaaacagcctcctccccatttaaaggctgctgtcttagcctctcatctaatgtgtgaggggggaagtaaattctagatactagtcgaaaaccaaatactgcatgttctcacttataagtgggagttaagctatgaatatgcaaaggtatacagaatggcataatggacattggagactcagaagcaaggagagtagaagggcagtgaggaataaaaaactacctattaagtacaacgtacactacttgggtgatgggtgccctaaaatcccagactttacctctacacaattcatccatgtaaccaaaaaccacttgtactcctgaagctgttgaaatatatatatatatatgtaaaatatatatattaaatatatatatatattaaatctaggtcctgctgggttggacatggaaaagttatagcacaaatatgaatcccccctagggacagtatgagactagttccaacaccatatgttcttcaacagctatttttattcttgcctctttccctttcatctatggaataccaaggagttaaacctttggaaccagccatttctgaccttgaatactgtagagattatttttctgtgcagcccaggtccaaatagtgttgttattctccacctcatttgtctctggactaggaaagatccagaaaggtatgagagctaaaaggaacattagagataattagtagtttagtctgaggttttacagctgtttggagaagtcttaatgatctgcctaagtatctcatgaactgttaaccaggggaccaggatatgtcctggaggggatggggaaaggtaaggtgtgattgtgtgggtgggctttcaggccatgtctctttcaacctgagcaactaaattattttatatatatattatatatatatatttttatatatattttaaatatttaaatattttatatattttaaatattatatatatatttgtgttcacacatactttgtgtgtatatttgtatatatacatacatattttgtgtacatatatacattcctcataagctctcatttgttaaaaagtttctacaatggggaaaaaagcctttgaaactgttgttctaataaaactcaataattttctacatgagaagctgagaaattgaaaatgatttgttcaatgtcacaaaaggagtatgtggtagaatgtaaactcagaaccagaaagttttgagcttctatttgaactcattatattctgtcttctctcagttgtgttagaacattaattcaaccagttatgttgaattacattgattgatgttgatgaacaatcatcaaacaagtgtcaggtaccagggatatcaaaataagtaagacatagccgctatttttcagcgtctataaatggaatgaggcacagaaataataatgctggatgctgtgtgctgtacaaaaagggcaagcaataataacagttaacatgtattgggtacttcctgtctgctaggtgctatactagatattttataagtattaattcacttaaattttacaatatgcctctgtgttaggtatggttgttattctgattttataaaagaagaaactgaggtttagatgggaagtgagggattaggtctcttggcccaaggtcacacaataagttaattatgggggtacaaggtacaggcgcttggaaaacatagaggaaagaacaattgtctaatgaaatcaaagaaaactttgcagagacatgtaaaatttaaggtagggctagaaagataaggagtaaagtgtgttcagacaaagggattagcatgagcaaagtcttagaagcctgaaaggggatcactttttatgaggaggaaagaatgtgttgctatggctgaaaactagtagataggactagaaggatagattagagcctgatactgagagttggaatgtctggtttaaaagtctgagcttttctctgtaggctaattgggaatcatcaaaagtgtgtatgccaagaactaacaatcagatatttctcttggaaaggtctatgtgacatcagcgttaacatgacccaaagaggtaagactggacagcctagtagcaggttcttgtcatggtttaattgtcaaaattgctattgataagctggatgactgagtcaaatttctttctgaagtttcccttattgcctccaattctaccctctgaagccatacagaacaagtcaaattcatcttttttttttatatcacagtcctttagatatttgagaacatgtatcaagggccttcccaatctgagtcttagctctttccatgaatggactggggcctcagtgattctcaaggacccttatagctgttacatcatgttttcttgattctctaacctctaaatctgtcttcatcagctagttttgtgaaggataaggacaggcctcctgtcctatttggattgacttgtttttttcaggtgatgactatagatagttaccttttagagtactccccatcccaggatgcccattttttttttctccatttcagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactgaaa
